US007408052B2

(12) United States Patent
Cheikh et al.

(10) Patent No.: US 7,408,052 B2
(45) Date of Patent: Aug. 5, 2008

(54) NUCLEIC ACID MOLECULES AND OTHER MOLECULES ASSOCIATED WITH THE CARBON ASSIMILATION PATHWAY

(75) Inventors: Nordine Cheikh, Manchester, MO (US); Philip W. Miller, Ballwin, MO (US); Keith M. O'Connell, Kirkwood, MO (US); Jingdong Liu, Ballwin, MO (US)

(73) Assignee: Monsanto Technology, LLC, St. Louis, MO (US)

( * ) Notice: Subject to any disclaimer, the term of this patent is extended or adjusted under 35 U.S.C. 154(b) by 0 days.

(21) Appl. No.: 11/244,330

(22) Filed: Oct. 6, 2005

(65) Prior Publication Data

US 2006/0195932 A1 Aug. 31, 2006

Related U.S. Application Data

(63) Continuation of application No. 09/987,899, filed on Nov. 16, 2001, now abandoned, which is a continuation of application No. 09/262,979, filed on Mar. 4, 1999, now abandoned.

(60) Provisional application No. 60/076,912, filed on Mar. 6, 1998.

(51) Int. Cl.
C07H 21/04 (2006.01)
C12Q 1/68 (2006.01)

(52) U.S. Cl. .......................... 536/23.6; 435/6

(58) Field of Classification Search ....................... None
See application file for complete search history.

(56) References Cited

OTHER PUBLICATIONS

Adams et al., "Complementary DNA Sequencing: Expressed Sequence Tags and Human Genome Project," *Science*, 252(5013):1651-1656 (Jun. 21, 1991).
Anderson et al., "Chloroplast and Cytoplasmic Enzymes," *Plant Physiol.*, 45:583-585 (1970).
Ansari-Lari et al., Entrez Report, Accession No. AAB51316, (Apr. 2, 1997).
Ansari-Lari et al., Entrez Report, Accession No. U47924, M86525, U72506, (Jan. 5, 2001).
Ansari-Lari et al., "A Gene-Rich Cluster between the CD4 and Triosephosphate Isomerase Genes at Human Chromosome 12p13," *Genome Res.*, 6:314-326 (1996).
Ansari-Lari et al., "Large-Scale Sequencing in Human Chromosome 12p13: Experimental and Computational Gene Structure Determination," *Genome Res.*, 7:268-280 (1997).
Artus et al., "NAD-Malic Enzyme from Plants," *FEBS Letters*, 182(2):225-233 (Mar. 1985).
Attwood et al., "The Babel of Bioinformatics," *Science*, 290(5491):471-473 (Oct. 20, 2000).
Blattner, Entrez Report, Accession No. AE000374 U00096 (Nov. 12, 1998).
Blattner, Entrez Report, Accession No. 1789281 (Nov. 12, 1998).
Blattner, Entrez Report, Accession No. AAC75952 (Dec. 1, 2000).
Blattner et al., "The Complete Genome Sequence of *Escherichia coli* K-12," *Science*, 277:1453-1462 (Sep. 5, 1997).
Cho et al., Entrez Report, Accession No. U39567 (Nov. 9, 1995).
Dong et al., Entrez Report, Accession No. AB012228 (May 13, 1998).
Dong et al. Entrez Report, Accession No. 3132310 (May 13, 1998).
Du Jardin, Entrez Report, Accession No. Z36894 (May 9, 1996).
Du Jardin, Entrez Report, Accession No. 534916 (May 9, 1996).
Du Jardin, Entrez Report, Accession No. CAA85362 (May 9, 1996).
Du Jardin et al., "Molecular Cloning and Characterization of a Soluble Inorganic Pyrophosphatase in Potato," *Plant Physiol.*, 109(3):853-860 (Nov. 1995).
Dyer, Entrez Report, Accession No. X15233 (Sep. 12, 1993).
Ebert et al., "Identification of an Essential Upstream Element in the Nopaline Synthase Promoter by Stable and Transient Assays," *Proc. Natl. Acad. Sci.*, 84(16):5745-5749 (Aug. 1987).
Efstratiadis et al., "Enzymatic in Vitro Synthesis of Globin Genes," *Cell*, 7(2):279-288 (Feb. 1976).
Ellis, "The Most Abundant Protein in the World," *Trends in Biochemical Sciences*, pp. 241-244 (Nov. 1979).
Feierabend et al., "Plant Transketolase: Subcellular Distribution, Search for Multiple Forms, Site of Synthesis," *International Journal of Plant Physiology*, 110(3):247-258 (1983).
Flechner et al., Entrez Report, Accession Report No. L76554 (Jan. 10, 1997).
Flechner et al., Entrez Report, Accession Report No. 2529342 (Jan. 10, 1997).
Flechner et al., Entrez Report, Accession Report No. AAD10219 (Jan. 29, 1999).
Flechner et al., "Molecular Characterization of transketolase (EC 2.2.1.1) active in the Calvin cycle of spinach chloroplasts," *Plant Molecular Biology*, 32(3):475-484 (Nov. 1996).
Fushimi et al., Entrez Report, Accession Report No. D16499 (Feb. 4, 1999).
Fushimi et al., "Nucleotide sequence of a rice cDNA similar to a maize NADP-dependent malic enzyme," *Plant Molecular Biology*, 24:965-967 (1994).
Gerhold et al., "It's the Genes! EST Access to Human Genome Content," *BioEssays*, 18(12):973-981 (1996).
Glackin et al., Entrez Report, Accession Report No. X14928 (Jul. 19, 1995).

(Continued)

*Primary Examiner*—Marianne P Allen
(74) *Attorney, Agent, or Firm*—Lawrence M. Lavin, Jr.; Matthew L. Madsen; Arnold & Porter LLP

(57) ABSTRACT

The present invention is in the field of plant biochemistry. More specifically the invention relates to nucleic acid sequences from plant cells, in particular, nucleic acid sequences from maize and soybean associated with the carbon assimilation pathway enzymes. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

3 Claims, No Drawings

OTHER PUBLICATIONS

Glackin et al., Entrez Report, Accession Report No. CAA33055 (Jul. 19, 1995).

Glackin et al., "Organ-specific Transcripts of Different Size and Abundance Derive from the Same Pyruvate, Orthophosphate Dikinase Gene in Maize," *PNAS*, 87(8):3004-3008 (1990).

Hatch et al, "Activity, Location and Role of NAD Malic Enzyme in Leaves with $C_4$-pathway Photosynthesis," *Aust. J. Plant. Physiol.*, 1(3):357-369 (1974).

Hatch, "$C_4$ photosynthesis: a unique blend of modified biochemistry, anatomy and ultrastructure," *Biochimica et Biophysica Acta*, 895(2):81-106 (1987).

Hudspeth, Entrez Report, Accession Report No. X15239 (Jan. 27, 1994).

Hudspeth et al., "Structure and Expression of the Maize Gene Encoding the Phosphoenolpyruvate Carboxylase Isozyme Involved in $C_4$ Photosynthesis," *Plant Mol. Biol.*, 12:578-589 (1989).

Izui et al., Entrez Report, Accession No. BAA28170 (May 13, 1998).

Jenkins et al., "NADP-Malate Dehydrogenase from *Zea mays* Leaves: Amino Acid Composition and Thiol Content of Active and Inactive Forms," *Plant Science*, 45(1):1-7 (1986).

Jiang et al., "Purification and Characterization of Thylakoid Membrane-Bound Inorganic Pyrophosphatase from *Spinacia oleracia* L.," *Archives of Biochemistry and Biophysics*, 346(1):105-112 (Oct. 1, 1997).

Jiao et al., "Posttranslational Regulation of Phosphoenolpyruvate Carboxylase in $C_4$ and Crassulacean Acid Metabolism Plants," *Plant Physiol.*, 95:981-985 (1991).

Jones et al., Entrez Report, Accession Report No. X73528 (Jul. 4, 1998).

Jones et al., "Nucleotide Sequence of a Wheat Chloroplastic Phosphoglycerate Kinase Gene," *Plant Physiol.*, 107:1483-1484 (1995).

Karmali et al., "Purification, Properties and Assay of D-Ribulose 5-Phosphate 3-Epimerase from Human Erythrocytes," *Biochem. J.*, 211(3):617-623 (Jun. 1983).

Kim et al., Entrez Report, Accession Report No. L31899 (Apr. 4, 1995).

Kim et al., Entrez Report, Accession Report No. 567102 (Apr. 4, 1995).

Kim et al., Entrez Report, Accession Report No. AAA64739 (Apr. 4, 1995).

Kim et al., "Molecular Cloning of Cucumber Phosphoenolpyruvate Carboxykinase and Developmental Regulation of Gene Expression," *Plant Molecular Biology*, 26:423-434 (1994).

Ko, "An 'Equalized cDNA Library' by the Reassociation of Short Double-Stranded cDNAs," *Nucleic Acids Research*, 18(19):5705-5711 (Oct. 11, 1990).

Kurata et al., "A 300 Kilobase Interval Genetic Map of Rice Including 883 Expressed Sequences," *Nature Genetics*, 8:365-372 (Dec. 1994).

Lebrun et al., Entrez Report, Accession Report No. Y00322 (Feb. 10, 1999).

Lebrun et al., "Nucleotide Sequence of a Gene Encoding Corn Ribulose-1, 5-Bisphosphate Carboxylase/Oxgenase Small Subunit (rbcs)," *Nucleic Acids Research*, 15(10):4360 (1987).

Lloyd, Entrez Report, Accession Report No. X57952 (Sep. 2, 1991).

Lloyd, Entrez Report, Accession Report No. CAA41020 (Sep. 2, 1991).

Lloyd et al., "Structure and Sequence of a Wheat Phosphoribulokinase Gene," *Plant Molecular Biology*, 17(1):167-168 (1991).

Longstaff et al., "Wheat Phosphoglycerate Kinase: Evidence for Recombination Between the Genes for the Chloroplastic and Cytosolic Enzymes," *Nucl. Acids. Res.*, 17(16):6569-6580 (1989).

Lopez et al., "Whole-Genome Sequence Annotation: 'Going Wrong with Confidence'," *Molecular Microbiology*, 32:881-891 (1999).

Lopez-Becerra et al., Entrez Report, Accession Report No. CAA12157 (Jul. 14, 1998).

Marchionni et al., Entrez Report, Accession Report No. D00012 (Dec. 23, 1997).

Marchionni et al., Entrez Report, Accession Report No. 217974 (Dec. 23, 1997).

Marchionni et al., Entrez Report, Accession Report No. BAA00009 (Apr. 14, 2000).

Marchionni et al., "The Triosephosphate Isomerase Gene from Maize: Introns Antedate the Plant-Animal Divergence," *Cell*, 46:133-141 (Jul. 4, 1986).

Martin et al., Entrez Report, Accession Report No. L76555 (Jan. 10, 1997).

Martin et al., Entrez Report, Accession Report No. 2529374 (Jan. 10, 1997).

Martin et al., Entrez Report, Accession Report No. AAD10207 (Jan. 29, 1999).

Martin et al., Entrez Report, Accession Report No. L76556 (Jan. 10, 1997).

Martin et al., Entrez Report, Accession Report No. 2529376 (Jan. 10, 1997).

Martin et al., Entrez Report, Accession Report No. AAB81104 (Oct. 15, 1997).

Martin et al., "Higher-Plant Chloroplast and Cytosolic Fructose-1, 6-Bisphophosphatase Isoenzymes: Origins via Duplication rather than Prokaryote-Eukaryote Divergence," *Plant Molecular Biology*, 32(3):485-491 (Nov. 1996).

Matsuoka et al., Entrez Report, Accession Report No. X06535 (Nov. 14, 1997).

Matsuoka et al., Entrez Report, Accession Report No. 22474 (Nov. 14, 1997).

Matsuoka et al., Entrez Report, Accession Report No. CAA29784 (Nov. 14, 1997).

Matsuoka et al., "Nucleotide Sequence of cDNA Encoding the Small Subunit of Ribulose-1,5-Bisphosphate Carboxylase from Maize," *Journal of Biochemistry*, 102:673-676 (1987).

Matsuoka et al., Entrez Report, Accession Report No. D00170 (Nov. 13, 1997).

McCombie et al., "*Caenorhabditis elegans* Expressed Sequence Tags Indentify Gene Families and Potential Disease Gene Homologues," *Nature Genetics*, 1:124-131 (May 1992).

Miller et al., Entrez Report, Accession Report No. AF020269 (Feb. 1, 1998).

Miller et al., Entrez Report, Accession Report No. 2827076 (Sep. 23, 1997).

Miller et al., Entrez Report, Accession Report No. AAB99753 (Jul. 3, 2001).

Muench et al., Entrez Report, Accession Report No. AF055898 (Oct. 4, 1998).

Muench et al., Entrez Report, Accession Report No. 3694807 (Sep. 24, 1998).

Muench et al., Entrez Report, Accession Report No. AAC62456 (Oct. 4, 1998).

Muench et al., "Hypoxically Inducible Barley Alanine Aminotransferase: cDNA Cloning and Expression Analysis," *Plant Molecular Biology*, 24(3):417-427 (Feb. 1994).

Nishizawa et al., "Enzyme Regulation in $C_4$ Photosynthesis," *J. Biol. Chem.*, 256(12):6119-6126 (Jun. 25, 1981).

Nowitzki et al., Entrez Report, Accession Report No. L42328 (Jan. 19, 1996).

Nowitzki et al., Entrez Report, Accession Report No. 1162980 (Jan. 19, 1996).

Nowitzki et al., Entrez Report, Accession Report No. AAC41677 (Jan. 20, 1996).

Nowitzki et al., "Cloning of the Amphibolic Calvin Cycle/OPPP Enzyme D-Ribulose-5-Phosphate 3-Epimerase (EC 5.1.3.1) from Spinach Chloroplasts: Functional and Evolutionary Aspects," *Plant Molecular Biology*, 29(6):1279-1291 (1995).

Okubo et al., "Large Scale cDNA Sequencing for Analysis of Quantitative and Qualitative Aspects of Gene Expression," *Nature Genetics*, 2:173-179 (Nov. 1992).

O'Leary, "Phosphoenolpyruvate Carboxylase: An Enzymologist's View," *Ann. Rev. Plant Physiol.*, 33:297-315 (1982).

Pelzer-Reith, Entrez Report, Accession Report No. X66814 S54153 (Jun. 30, 1993).

Pelzer-Reith, Entrez Report, Accession Report No. 22633 (Jun. 30, 1993).

Pelzer-Reith, Entrez Report, Accession Report No. CAA47293 (Jun. 30, 1993).

Pelzer-Reith et al., "Plant Aldolase: cDNA and Deduced Amino-Acid Sequences of the Chloroplast and Cytosol Enzyme from Spinach," *Plant Molecular Biology*, 21(2):331-340 (1993).

Pichersky et al., "Plant Triose Phosphate Isomerase Isozyme," *Plant Physiol.*, 74(2):340-347 (1984).

Pupillo et al., "Subunit Structure of Three Glyceraldehyde 3-Phosphate Dehydrogenases of Some Flowering Plants," *Archives of Biochemistry and Biophysics*, 194(2):581-592 (May 1979).

Raines et al., "Chloroplast Fructose-1, 6-Bisphosphatase: The Product of a Mosaic Gene," *Nucleic Acids Research*, 16(16):7931-7942 (1988).

Rao et al., Entrez Report, Accession Report No. Z48977 (Aug. 7, 1996).

Rao et al., Entrez Report, Accession Report No. 1161600 (Aug. 7, 1996).

Rao et al., Entrez Report, Accession Report No. CAA88841 (Aug. 7, 1996).

Rao et al., "Nucleotide Sequences of cDNAs Encoding the Chlorplastic and Cytosolic Phosphoglycerate Kinases (Accession Nos. Z48976 and Z48977) from Tobacco," *Plant Physiol.*, 109(3):1125-1127 (1995).

Roesler et al., "Nucleotide Sequence of Spinach cDNA Encoding Phosphoribulokinase," *Nucleic Acids Research*, 16(14):7192 (1988).

Russell et al., "Structural Features Can Be Unconserved in Proteins with Similar Folds: An Analysis of Side-Chain to Side-Chain Contacts Secondary Structure and Accessibility," *Journal of Molecular Biology*, 244:332-350 (1994).

Rutner, "Spinach 5-Phosphoribose Isomerase, Purification and Properties of the Enzyme," *Biochemistry*, 9(1):178-184 (Jan. 6, 1970).

Sigma Chemical Catalog 1990, "BioChemicals Organic Compounds for Research and Diagnostic Reagents," Sigma Chemical Company (pub.), pp. 776-778 (1990).

Slack et al., "Distribution of Enzymes in Mesophyll and Parenchyma-Sheath Chloroplasts of Maize Leaves in Relation to the $C_4$-Dicarboxylic Acid Pathway of Photosynthesis," *Biochem. J.*, 114:489-498 (1969).

Son et al, Entrez Report, Accession Report No. X69421 S51461 (Jun. 30, 1993).

Son et al., "Molecular Cloning of an Alanine Aminotrasferase from NAD-Malic Enzyme Type C4 Plant *Panicum miliaceum*," *Plant Molecular Biology*, 20(4):705-713 (1992).

Sygusch et al., "Molecular Architecture of Rabbit Skeletal Muscle Aldolase at 2.7-Å Resolution," *PNAS*, 84(22):7846-7850 (Nov. 1987).

Takahashi et al., Entrez Report, Accession Report No. AJ224847 (Jul. 14, 1998).

Takahashi et al., Entrez Report, Accession No. 2950395 (Jul. 14, 1998).

Takahashi et al., "Cloning of a cDNA Encoding Plastidic Fructose-1, 6-Bisphosphatase from Rice (*Oryza sativa* L.) (Accession No. AB007194)," *Plant Physiol.*, 117(1):331-333 (1998).

Taniguchi, Entrez Report, Accession Report No. X63430 (Mar. 20, 1992).

Taniguchi, Entrez Report, Accession Report No. 20601 (Mar. 20, 1992).

Taniguchi, Entrez Report, Accession Report No. CAA45024 (Mar. 20, 1992).

Taniguchi et al., "Aspartate Aminotransferase from *Eleusine coracana*, a $C_4$ Plant: Purification, Characterization, and Preparation of Antibody," *Archives of Biochemistry and Biophysics*, 282(2):427-432 (Nov. 1, 1990).

Taniguchi, Entrez Report, Accession Report No. X63428 (Mar. 20, 1992).

Taniguchi et al., "Cloning and Sequence Analysis of cDNA Encoding Aspartate Aminotransferase Isozymes from *Panicum miliacum* L., a $C_4$ Plant," *Eur. J. Biochem.*, 204:611-620 (1992).

Walter et al., "Cinnamyl-Alcohol Dehydrogenase, a Molecular Marker Specific for Lignin Synthesis: cDNA Cloning and mRNA Induction by Fungal Elicitor," *PNAS*, 85(15):5546-5550 (Aug. 1988).

Walter et al., Entrez Report, Accession Report No. J03825 (Jul. 6, 1994).

Walter et al., Entrez Report, Accession Report No. 169327 (Jul. 6, 1994).

Walter et al., Entrez Report, Accession Report No. AAA19575 (Jul. 6, 1994).

Wells et al., "The Chemokine Information Source: Identification and Characterization of Novel Chemokines Using the WorldWideWeb and Expressed Sequence Tag Databases," *Journal of Leukocyte Biology*, 61(5):545-550 (1997).

Winning et al., Entrez Report, Accession Report No. Z23023 (Apr. 7, 1994).

Woodrow, "Control of the Rate of Photosynthetic Carbon Dioxide Fixation," *Biochimica et Biophysica Acta*, 851(2):181-192 (1986).

Yomo et al., "Histochemical Studies on Protease Formation in the Cotyledons of Germinating Bean Seeds," *Planta (Berl.)*, 112(1):35-43 (1973).

NUCLEIC ACID MOLECULES AND OTHER MOLECULES ASSOCIATED WITH THE CARBON ASSIMILATION PATHWAY

CROSS REFERENCE TO RELATED APPLICATIONS

This application is a continuation application under 35 U.S.C. § 121 of U.S. application Ser. No. 09/987,899 filed Nov. 16, 2001 now abandoned, which is a continuation application under 35 U.S.C. § 121 of U.S. application Ser. No. 09/262,979 filed Mar. 4, 1999 now abandoned, which claims priority under 35 U.S.C. § 119(e) of U.S. Application No. 60/076,912 filed Mar. 6, 1998, each of which is incorporated by reference in its entirety.

INCORPORATION OF SEQUENCE LISTING

This application contains a sequence listing, which is contained on three identical CD-ROMs: two copies of a sequence listing (Copy 1 and Copy 2) and a sequence listing Computer Readable Form (CRF), all of which are herein incorporated by reference. All three CD-ROMs each contain one file called "Seq_List.txt" which is 3,935,350 bytes in size (as measured in Windows XP) and was created on Oct. 6, 2005.

FIELD OF THE INVENTION

The present invention is in the field of plant biochemistry. More specifically the invention relates to nucleic acid sequences from plant cells, in particular, nucleic acid sequences from maize and soybean plants associated with the carbon assimilation pathway in plants. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

BACKGROUND OF THE INVENTION

I. Introduction

The primary sites of photosynthetic activity, generally referred to as "source organs", are mature leaves and to a lesser extent, other green tissues (e.g., stems). Photosynthesis may be broadly divided into two phases: a light phase, in which the electromagnetic energy of sunlight is trapped and converted into ATP and NADPH, and a dark or synthetic phase, in which the ATP and NADPH generated by the light phase are used, in part, for biosynthetic carbon reduction. In most plants, the major products of photosynthesis are starch (transitory storage, form of carbohydrate formed in chloroplasts), and sucrose (formed in the cytosol). Sucrose represents the predominant form of carbon transport in higher plants. Processes that play a role in plant growth and development, crop yield potential and stability, and crop quality and composition include: enhanced carbon assimilation, efficient carbon storage, and increased carbon export and partitioning.

Oxygen-evolving organisms are reported to have a common pathway for the reduction of $CO_2$ to sugar phosphates. This pathway is known as the reductive pentose phosphate (RPP), Calvin-Benson or C3 cycle (Calvin and Bassham, *The Photosynthesis of Carbon Compounds*, Benjamin, N.Y. (1962); Bassham and Buchanan, In: *Photosynthesis*, Govindjee, ed., Academic Press, New York, 141-189 (1982), both of which are herein incorporated by reference). A number of plants exhibit adaptations in which $CO_2$ is first fixed by a supplementary pathway and then released in cells in which the RPP cycle operates. From the point of view of the metabolic pathway operating for photosynthetic carbon assimilation, higher plants can be classified by the existence of supplemental pathway such as C3, C4, and crassulacean acid metabolism species (Edwards and Walker, *C3-C4: Mechanism and cellular and environmental regulation of photosynthesis*, Blackwell Scientific Publications, Oxford, (1983), herein incorporated by reference in its entirety).

The RPP pathway is reported to be the main route by which $CO_2$ is ultimately incorporated into organic compounds in all species of higher plants (Edwards and Walker, *C3-C4: Mechanism and cellular and environmental regulation of photosynthesis*, Blackwell Scientific Publications, Oxford, (1983); Macdonald and Buchanan, In: *Plant Physiology, Biochemistry and Molecular Biology*, Dennis and Turpin, eds., J. Wiley & Sons, Inc., New York, p. 239 (1990), herein incorporated by reference in its entirety; Robinson and Walker, In: *The Biochemistry of Plants*, Vol. 8, Hatch and Boardman, eds., Academic Press, New York, p. 193 (1981), herein incorporated by reference in its entirety). In C3 plants, the RPP pathway is the sole route for photosynthetic carbon assimilation, whereas in C4 and CAM plants an additional (not alternative) method of carbon fixation, is present seperated in space (C4 plants) or in time (CAM plants) from the RPP cycle (Edwards and Walker, *C3-C4: Mechanism and cellular and environmental regulation of photosynthesis*, Blackwell Scientific Publications, Oxford, (1983)). Carbon skeletons are required to incorporate other functional groups, the operation of the RPP cycle for photosynthetic $CO_2$ fixation is a requisite for the biochemical synthesis of carbohydrates, lipids, proteins, and nucleic acids.

II. The Reductive Pentose Phosphate Cycle

The RPP cycle is reported to be the primary carboxylating mechanism in plants. Enzymes which catalyze steps in the RPP cycle are water soluble and are located in the soluble portion of the chloroplast (stroma). Reviews on the mechanism and enzymes involved in the RPP cycle include: Bhagwat, In: *Handbook of Photosynthesis*, Pessaraki, ed., Marcel Dekker Inc, New York, 461-480 (1997), herein incorporated by reference in its entirety; Iglesias et al., In: *Handbook of Photosynthesis*, Pessaraki, ed., Marcel Dekker Inc, New York, 481-503 (1997), herein incorporated by reference in its entirety; Robinson and Walker, In: *The Biochemistry of Plants*, Vol. 8, Hatch and Boardman, eds., Academic Press, New York, 193-236 (1981); Macdonald and Buchanan, In: *Plant Metabolism*, Dennis et al., eds., Longman, Essex, England, 299-313 (1997).

The RPP pathway is an autocatalytic pathway for the de novo synthesis of carbohydrates from inorganic $CO_2$. The RPP cycle is reported to comprise three phases. The first phase of the cycle is the carboxylation phase, during which ribulose-1,5-bisphosphate (Rbu-1,5-$P_2$) is carboxylated to produce two molecules of 3-phosphoglycerate (3-PGA). The next phase is the reductive phase during which ATP and NADPH produced by the light reaction of photosynthesis are consumed in the reduction of 3-PGA to glyceraldehyde-3-phosphate (GA-3-P). The RPP cycle is completed by the regeneration phase where intermediates formed from GA-3-P are utilized via a series of isomerizations, condensations and rearrangements, resulting in the conversion of five molecules of triose phosphate to three molecules of pentose phosphate, and eventually ribulose 5-phosphate (Rbu-5-P). Phosphorylation of Rbu-5-P by ATP regenerates the original carbon acceptor Rbu-1,5-$P_2$, thus completing the cycle.

The RPP cycle is a metabolic pathway common to all photosynthetic organisms. Many of the enzymes of the metabolic route, as well as proteins involved in metabolite transport and regulation, have been purified.

Ribulose bisphosphate carboxylase (Rubisco, also refered to as ribulose-1,5-bisphosphate carboxylase/oxygenase (EC 4.1.1.39)) constitutes about 50% of the total soluble protein in green leaves. Ribulose bisphosphate carboxylase is reported to provide a quantitative link between the pools of inorganic and organic carbon in the biosphere. Ribulose bisphosphate carboxylase catalyses the conversion of atmospheric carbon dioxide into three carbon compounds. Subsequent reactions result in both regeneration of the acceptor molecule and translocation of three molecules of triose-phosphate to the cytosol for synthesis of sucrose and starch. Reviews of the ribulose bisphosphate carboxylase enzyme are provided by Ellis, *Trends Biochem. Sci.* 4: 241-244 (1979); Hartman and Harpel, *Annu. Rev. Biochem.* 63: 197-234 (1994); Miziorko and Lorimer, *Annu. Rev. Biochem.* 52: 507-535 (1983); Andrews and Lorimer, In: *The Biochemistry of Plants, Vol* 10, Hatch and Boardman, eds., Academic Press, San Diego, p. 131 (1987); Jensen, In: *Plant Physiology, Biochemistry, and Molecular Biology*, Dennis and Turpin, eds., J. Wiley & Sons, Inc., New York, p 224 (1990), all of which are herein incorporated by reference in their entirety.

Plants are reported to have two phosphoglycerate kinase isoenzymes (EC 2.7.2.3), one in the chloroplast and the other in the cytosol. The two isoenzymes are antigenically related, but can be distinguished on the basis of their isoelectric point (pI) values and on the basis of their affinity for magnesium and other substrates (Anderson and Advani, *Plant Physiol.* 45:583-585 (1970); Kopke-Secundo et al., *Plant Physiol.* 93:40-47 (1990), both of which are herein incorporated by reference in their entirety).

Three different glyceraldehyde 3-phosphate dehydrogenase (GAPDH (EC 1.2.1.13)) enzymes are found in eukaryotic cells (Pupillo and Faggiani, *Arch. Biochem. Biophys.* 194: 581-592 (1979); Iglesias, *Biochem. Educ.* 18: 2-5 (1990), both of which are herein incorporated by reference in their entirety). In higher plants there are two chloroplast GAPDH subunits: GapA (36 kDa) and GapB (42 kDa). The functional enzyme is reported to be a tetramer with either an $A_4$ or an $A_2B_2$ subunit structure (Cerff, In: *Methods in Chloroplast Molecular Biology*, Edelman, ed., Elsevier Press, Amsterdam: 683 (1982), the entirety of which is herein incorporated by reference). Sequence analysis of tobacco cDNA clones encoding the GapA and GapB subunits has revealed that they are homologous (Shih et al., *Cell* 47: 73-83 (1986), the entirety of which is herein incorporated by reference). The three-dimensional structure of GADPH from both eukaryotes and prokaryotes has been studied, and it seems that the initial binding of the NAD coenzyme triggers a number of structural changes (Skarzynski and Wonacott, *J. Mol. Biol.* 203: 1097-1118 (1988), the entirety of which is herein incorporated by reference).

Chloroplastic triose phosphate isomerase (TPI (EC 5.3.1.1)) is a homodimer with a subunit molecular weight of about 27 kDa (Pichersky and Gottlieb, *Plant Physiol.* 74: 340-347 (1984), the entirety of which is herein incorporated by reference). The chloroplastic enzyme is reported to be distinguishable from the cytosolic enzyme by isoelectric focusing and peptide digestion mapping (Pichersky and Gottlieb, *Plant Physiol.* 74: 340-347 (1984); Kurzok and Feierabend, *Biochim. Biophys. Acta* 788: 222-233 (1984), herein incorporated by reference in its entirety). TPI, like several other RPP cycle enzymes, binds the substrate in a pocket, which is then reported to be closed by a flexible loop which acts to shield the substrate from attack by water. Even though the active site is formed by residues from one subunit, the second subunit helps to exclude water from the active site domain.

Two reactions of the RPP cycle involve aldolase (EC 4.1.2.13), and both are catalyzed by the same enzyme, which is a tetramer of the 38 kDa subunit. It has been reported that each subunit of aldolase has a beta/alpha barrel structure (Sygusch et al., *Proc. Natl. Acad. Sci.* (*U.S.A.*) 84:7846-7850 (1987), the entirety of which is herein incorporated by reference) and that the C-terminal region covers the active site pocket, which is in the barrel and regulates access to the active site pocket.

Fructose-1,6-bisphosphatase (FBPase) (EC 3.1.3.11) is a homotetramer with a molecular weight of about 160 kDa. The amino acid sequence is reported to be highly conserved (Raines et al., *Nucleic Acid Res.* 16: 7931-7942 (1988), the entirety of which is herein incorporated by reference). In both wheat and spinach, 12 extra amino acid residues have been identified that seem to be involved in the regulation by light via the ferredoxin/thioredoxin system (Raines et al., *Nucleic Acid Res.* 16: 7931-7942 (1988); Marcus et al., *Proc. Natl. Acad. Sci.* (*U.S.A.*) 85:5379-5383 (1988), the entirety of which is herein incorporated by reference).

Transketolase (EC 2.2.1.1) (152 kDa tetramer) is found in cytosolic and chloroplastic forms. These forms are reported to have similar properties except for their response to $Mg^{2+}$ (Feierbend and Gringel, *Zeitschrift fur Pflanzenphysiol.* 110: 247-258 (1983); Murphy and Walker, *Planta* 155: 316-320 (1982), both of which are herein incorporated by reference in their entirety).

Sedoheptulose-1,7-bisphosphate phosphatase (SBPase (EC 3.1.3.37)) is not reported to have a cytosolic counterpart and is reported to be found only in the chloroplast. The enzyme is reported to be a homodimer with a subunit molecular weight of 35-38 kDa (Nishizawa and Buchanan, *J. Biol. Chem.* 256: 6119-6126 (1981); Cadet and Meunier, *Biochem. J.* 253: 243-248 (1988), both of which are herein incorporated by reference in their entirety).

D-ribulose-5-phosphate-3-epimerase (EC 5.1.3.1) has been reported in animals as a homodimer with a subunit molecular weight of 23 kDa (Karmali et al., *Biochem. J.* 211:617-623 (1983), the entirety of which is herein incorporated by reference).

Ribose-5-phosphate isomerase (EC 5.3.1.6) has been purified from tobacco and spinach and is reported to be a homodimer with a subunit molecular weight of 26 kDa (Rutner, *Biochemistry* 9: 178-184 (1970); Babadzhanova and Bakaeva, *Biokhimiya* 53: 134-140 (1987), both of which are herein incorporated by reference in their entirety).

III. Regulation of C3 Photosynthesis

The regulatory properties of the RPP cycle have been reported by Edwards and Walker, *C3-C4: Mechanism and Cellular and Environmental Regulation of Photosynthesis*, Blackwell Scientific Publications, Oxford, (1983); Leegood, *Photosynthesis Res.* 6: 247-259 (1985), herein incorporated by reference in its entirety; Woodrow, *Biochim. Biophys. Acta* 851:181-192 (1986), the entirety of which is herein incorporated by reference. The conservation of phosphate is reported to play a role in the regulation of C3 photosynthesis, as a change in the level of any phosphorylated intermediate is balanced by an equal and opposite change in terms of phosphate elsewhere in the cycle (Woodrow, *Biochim. Biophys. Acta.* 851:181-192 (1986); Fell and Sauro, *Eur. J. Biochem.* 148: 555-561 (1985), herein incorporated by reference in its entirety). Therefore, changes in the activity of any of the RPP cycle enzymes can affect both the substrate concentration and activities of other enzymes in the chloroplast.

IV. The C4 Pathway of Carbon Assimilation

In the C4 pathway, $CO_2$ is concentrated in bundle sheath cells at the site of the RPP cycle initiated by ribulose bisphosphate carboxylase. C3 photosynthesis is documented to be the only mode of carbon assimilation in algae, bryophytes, pteridophytes, gymnosperms, and the majority of angiosperm families. Only about 10 families of known monocots and dicots have been reported to possess the C4 pathway of photosynthesis, these include, for example, *Zea mays*, sorghum, sugar cane, etc. The C4 pathway has been reviewed by, for example, Edwards et al., In: *Co₂ Metabolism and Productivity of plants*, Burris and Black, eds., University Park Press, Baltimore, Md., p. 83 (1976); Hatch, *Biochim. Biophys. Acta* 895: 81-106 (1987); Ashton et al., In: *Methods In Plant Biochemistry*, Vol. 3, Academic Press Limited, New York, p. 39 (1990), all of which are herein incorporated by reference in their entirety. A feature reported to be common to the enzymes in the C4 pathway is that their activities are 15-100 times higher compared to those reported in C3 plants. For example, adenylate kinase and pyrophosphatase activities are reported to be 20-50 times higher in C4 plants than in C-3 plants. Adenylate kinase and pyrophosphatase are largely located in the mesophyll chloroplast together with pyruvate Pi dikinase (Slack et al., *Biochem. J.* 114: 489-498 (1969), herein incorporated by reference in its entirety).

In certain plant types (e.g., *Zea mays*, sorghum and sugar cane), $CO_2$ is initially assimilated in mesophyll cells (with PEP acting as a primary acceptor of $CO_2$) as oxaloacetate, which is reduced to malate by NADP-malate dehydrogenase. It has been reported that malate is moved to bundle sheath cells. In the chloroplast of bundle sheath cells, malate is decarboxylated by NADP-malic enzyme (malate formers) giving rise to pyruvate, and releasing $CO_2$ and NADPH. NADPH can be cycled back to NADP by coupling to PGA reduction in the RPP cycle. The carbon formed moves back to the mesophyll cells where it is converted to PEP by pyruvate Pi dikinase.

Plants of the PEP carboxykinase type are reported to have higher activities of aspartate and alanine aminotransferases than the malate formers. Such plants are reported to be aspartate formers rather than malate formers. In aspartate formers, the activity of PEP carboxykinase is reported to be higher and the activity of NADP-malic enzyme is reported to be lower (Edwards and Black, In: *Photosynthesis and Photorespiration*, Hatch et al., eds., Wiley Interscience, New York, p. 153 (1971), the entirety of which is herein incorporated by reference). It has been reported that the PEP carboxykinase is located in the cytosol of bundle sheath cells.

This group of C4 plants is not reported to contain either high levels of NAD-malic enzyme activity or high levels of PEP carboxykinase. It has been reported by Hatch and Kagawa (*Aust. J. Plant Physiol.* 1: 357-369 (1974), the entirety of which is herein incorporated by reference) that these plants contain high NAD-malic enzyme activity in mitochondria and that the number of mitochondria in these plants may be increased by a factor of 3-4.

V. Enzymes Involved in the C4 Pathway

Phosphoenolpyruvate carboxylase (PEP carboxykinase (EC 4.1.1.31)) is reported to initiate the carboxylative phase of the C4 metabolic route by catalyzing the irreversible beta-carboxylation of PEP. The reaction utilizes a divalent metal ion (e.g., $Mg^{2+}$) as a cofactor. In C4 plants, PEP carboxykinase is reported to play a role in catalyzing the initial fixation of atmospheric $CO_2$ in the cytoplasm of mesophyll cells (O'Leary, *Annu. Rev. Plant Physiol.* 33: 297-315 (1982); Andreo et al., *FEBS Lett.* 213: 1-8 (1987), both of which are herein incorporated by reference in their entirety). PEP carboxykinase from C4 plants is reported to be a homotetramer with molecular weight of 400 kDa (O'Leary, *Annu. Rev. Plant Physiol.* 33: 297-315 (1982); Andreo et al., *FEBS Lett.* 213: 1-8 (1987)). Each subunit is reported to contain at least one substrate-binding site. The monomeric form is reported to be inactive (Wagner et al., *Eur. J. Biochem.* 173: 561-568 (1988); Walker et al., *Plant Physiol.* 80: 848-855 (1986); Wagner et al., *Eur. J. Biochem.* 164: 661-666 (1987), all of which are herein incorporated by reference in their entirety).

In C4 plants, PEP carboxykinase is reported to be allosterically regulated. Glucose-6-phosphate, triose-phosphate and Pi are reported to be activators, and malate is reported to be an inhibitor of enzyme activity. C4 PEP carboxykinase is also reported to be subject to light regulation. Responses to light/dark involve a post-translational modification of the enzyme (Jiao and Chollet, *Plant Physiol.* 95: 981 (1991), herein incorporated by reference in its entirety). The PEP carboxykinase is phosphorylated, during the light phase, at a serine residue close to the N-terminal region of the enzyme (Ser-15 in *Zea mays*) (Jiao and Chollet, *Plant Physiol.* 95: 981 (1991)). The phosphorylation is reported to be catalyzed by a soluble protein-serine kinase. The phosphorylated form of PEP carboxykinase is reported to be less sensitive to malate inhibition.

NADP-dependent malate dehydrogenase (NADP-MDHase (EC 1.1.1.82)) is reported to be located in the chloroplast of mesophyll cells and is reported to reduce oxaloacetate (OAA) by using photosynthetically generated NADPH. The native enzyme is reported to be a dimer composed of a nuclear-encoded subunit of molecular mass 42 kDa (Jenkins et al., *Plant Sci.* 45: 1-7 (1986); Kagawa and Bruno, *Arch. Biochem. Biophys.* 260: 674-695 (1988), both of which are herein incorporated by reference in their entirety). In C4 plants, NADP-MDHase is reported to have an alkaline pH optimum and the reduction of OAA is reported to be inhibited by NADP+. NADP-MDHase is reported to be light regulated with the enzyme active during the light phase and inactive during the dark phase. The activation mechanism involves reversible thiol/disulfide interchanges mediated by ferredoxin and thioredoxin m. The reaction is promoted under conditions of high NADPH:NADP+ ratio in the chloroplast stroma.

Aspartate aminotransferase (EC 2.6.1.1) is a cytoplasmic enzyme that converts OAA and glutamate into aspartate and alpha-ketoglutarate (alpha-KG) in mesophyll cells (Taniguchi et al., *Arch. Biochem. Biophys.* 282: 427-432 (1990); Rastogi et al., *J. Bacteriol.* 173: 2879-2887 (1991); Reynolds et al., *Plant Mol. Biol.* 19: 465-472 (1992); Kirk et al., *Plant Physiol.* 105: 763-764 (1994); Schultz et al., *Plant J.* 7: 61-75 (1995), all of which are herein incorporated by reference in their entirety). Aspartate is exported into bundle sheath cells where decarboxylation takes place. Aspartate aminotransferase is reported to be present in aspartate forming C4 plants.

Alanine aminotransferase (EC 2.6.1.2) is reported to be present in C4 plants of the NAD-dependent malic acid enzyme (NAD-ME) type and interconverts in a revesible reaction the metabolites pyruvate and alanine in the cytoplasm of both mesophyll and bundle sheath cells (Son et al., *Plant Mol. Biol.* 20: 705-713 (1992); Umemura et al., *Biosci. Biotechnol. Biochem.* 58: 283-287 (1994), both of which are herein incorporated by reference in their entirety). The amino acid alanine is a metabolite transported in this C4 subtype.

NADP-dependent malic enzyme (NADP-ME (EC 1.1.1.40)) is reported to be present in NADP-ME type C4 plants and is located in the chloroplasts of bundle sheath cells. NADP-ME catalyses the conversion of malate into pyruvate and $CO_2$ in the presence of NADP+. This reaction is reported to require a metal ion (Ashton et al., In: *Methods in Plant Biochemistry*, Lea, ed., Academic Press, New York, p. 39 (1990); Leegood and Osmond, In: *Plant Physiology, Biochemistry and Molecular Biology*, Dennis and Turpin, eds., Wiley & Sons, Inc., New York, p. 274 (1990), herein incorporated by reference in its entirety). The NADP-ME enzyme in C4 plants is reported to comprise a single subunit with molecular weight of 62 kDa. At least two plastidic isoforms of NADP-ME, "dark" form and "light" form (the light form is also know as the "green" form), have been reported in *Zea mays* leaves (Andreo et al., In: *Proceedings of the International Congress on Photosynthesis*, Montepelier, France, Mathis, ed., Kluwer Academic Publishers, Amsterdam, (1995), the entirety of which is herein incorporated by reference). The dark form of the NADP-ME, which is present mainly in etiolated *Zea mays* leaves, has a molecular weight of 72 kDa and a lower specific activity compared to the "green" form of NADP-ME (62 kDa) found in green leaves (Andreo et al., In: *Proceedings of the International Congress on Photosynthesis*, Montepelier, France, Mathis, ed., Kluwer Academic Publishers, Amsterdam, (1995)). The "green" form of NADP-ME appears to be enhanced by light. The dark form of the enzyme resembles the NADP-MEs found in C-3 plants in both photosynthetic and nonphotosynthetic tissues.

NAD-dependent malic enzyme (NAD-ME (EC 1.1.1.39)) is reported to be located in the mitochondria where it catalyzes the NAD-dependent decarboxylation of malate in the presence of a divalent cation (e.g., $Mg^+$). NAD-ME is reported to be ineffective in the decarboxylation of OAA (Artus and Edwards, *FEBS Lett.* 182: 225-233 (1985), the entirety of which is herein incorporated by reference). NAD-ME is reported to comprise two subunits (alpha and beta) which differ in molecular weights (58 and 62 kDa, respectively).

In C4 plants of the PEP carboxykinase (EC 4.1.1.49) type, aspartate is converted into OAA in bundle sheath cells and ketoacid is decarboxylated by cytoplasmic PEP carboxykinase. PEP carboxykinase is reported to have a requirement for $Mn^{2+}$ and a preference for ATP (Ashton et al., In: *Methods in Plant Biochemistry*, Lea, ed., Academic Press, New York, p. 39 (1990)). The native enzyme is reported to be a homohexamer with a molecular weight of 380 kDa (subunit molecular weight of 64 kDa). PEP carboxykinase enzyme is reported to be inhibited by the metabolites 3PGA, fructose-6-phosphate, fructose1,6 bisphosphate and DHAP.

In all three subtypes of C4 plants, regeneration of PEP from pyruvate takes place in mesophyll chloroplasts by the reaction catalyzed by pyruvate Pi dikinase (PPDKase (EC 2.7.9.1)). This is a regulatory step in the C4 pathway (Hatch, *Biochim. Biophys. Acta* 895: 81-106 (1987); Ashton et al., In: *Methods in Plant Biochemistry*, Lea, ed., Academic Press, New York, p. 39 (1990)). PPDKase is a homotetrameric protein with a molecular weight of about 390 kDa (Ashton et al., In: *Methods in Plant Biochemistry*, Lea, ed., Academic Press, New York, p. 39 (1990)). PPDKase is reported to be inactivated by cold temperatures and the absence of $Mg^{2+}$ and is activated in the light period and inactivated in the dark period ((Ashton et al., In: *Methods in Plant Biochemistry*, Lea, ed., Academic Press, New York, p. 39 (1990)). Activation by light of PPDKase is a result of dephosphorylation and the switch to inactive dark form involves phosphorylation.

Pyrophosphatase (inorganic pyrophosphatase (EC 3.6.1.1)) promotes the reaction catalyzed by the enzyme pyruvate Pi dikinase in the direction of PEP synthesis through hydrolysis of PPi (Jiang et al., *Arch. Biochem. Biophys.* 346: 105-112 (1997); Mitchell et al., *Can. J. Microbiol.* 43: 734-743 (1997), both of which are herein incorporated by reference in their entirety). Pyrophosphatase has been isolated from potato (du Jardin et al., *Plant Physiol.* 109:853-860 (1995), herein incorporated by reference in its entirety) and *Arabidopisis* (Kieber and Signer, *Plant Mol. Biol.* 16: 345-348 (1991), herein incorporated by reference in its entirety).

Ribose-5-phosphate kinase (EC 2.7.1.19) is reported to be found in photosynthetic organisms possessing the CA4 pathway. This homodimeric enzyme has a subunit molecular weight of 39.2 kDa (Roeslier and Ogren, *Nucleic Acid Res.* 16: 7192 (1988); Milanez and Mural, *Gene* 66:55-63 (1988), both of which are herein incorporated by reference in their entirety). The N-terminal region seems to be involved in the regulation of catalytic activity. $Cys^{16}$ may form a part of the ATP-binding region. $Lys^{68}$ has also been implicated in ATP binding (Miziorko et al., *J. Biol. Chem.* 265: 3642-3647 (1990), the entirety of which is herein incorporated by reference).

VI. Expressed Sequence Tag Nucleic Acid Molecules

Expressed sequence tags, or ESTs are randomly sequenced members of a cDNA library (or complementary DNA)(McCombie et al., *Nature Genetics* 1:124-130 (1992); Kurata et al., *Nature Genetics* 8:365-372 (1994); Okubo et al., *Nature Genetics* 2:173-179 (1992), all of which references are incorporated herein in their entirety). The randomly selected clones comprise insets that can represent a copy of up to the full length of a mRNA transcript.

Using conventional methodologies, cDNA libraries can be constructed from the mRNA (messenger RNA) of a given tissue or organism using poly dT primers and reverse transcriptase (Efstratiadis et al., *Cell* 7:279-3680 (1976), the entirety of which is herein incorporated by reference; Higuchi et al., *Proc. Natl. Acad. Sci. (U.S.A.)* 73:3146-3150 (1976), the entirety of which is herein incorporated by reference; Maniatis et al., *Cell* 8:163-182 (1976) the entirety of which is herein incorporated by reference; Land et al., *Nucleic Acids Res.* 9:2251-2266 (1981), the entirety of which is herein incorporated by reference; Okayama et al., *Mol. Cell. Biol.* 2:161-170 (1982), the entirety of which is herein incorporated by reference; Gubler et al., *Gene* 25:263-269 (1983), the entirety of which is herein incorporated by reference).

Several methods may be employed to obtain full-length cDNA constructs. For example, terminal transferase can be used to add homopolymeric tails of dC residues to the free 3' hydroxyl groups (Land et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, *Mol. Cell. Biol.* 2:161-170 (1982), the entirety of which is herein incorporated by reference, report a method for obtaining full length cDNA constructs. This method has been simplified by using synthetic primer-adapters that have both homopolymeric tails for priming the synthesis of the first and second strands and restriction sites for cloning into plasmids (Coleclough et al., *Gene* 34:305-314 (1985), the entirety of which is herein incorporated by reference) and bacteriophage vectors (Krawinkel et al., *Nucleic Acids Res.* 14:1913 (1986), the entirety of which is herein incorporated by reference; Han et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences (Davidson, *Gene Activity in Early Development*, 2nd ed., Academic Press, New York (1976), the entirety of which is herein incorporated by reference). The number of clones required to achieve a given probability that a low-abundance mRNA will be present in a cDNA library is $N=(\ln(1-P))/(\ln(1-1/n))$ where N is the number of clones required, P is the probability desired and 1/n is the fractional proportion of the total mRNA that is represented by a single rare mRNA (Sambrook et al., *Molecular Cloning: A Laboratory Manual*, 2nd ed., Cold Spring Harbor Laboratory Press (1989), the entirety of which is herein incorporated by reference).

A method to enrich preparations of mRNA for sequences of interest is to fractionate by size. One such method is to fractionate by electrophoresis through an agarose gel (Pennica et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest et al., *Proc. Natl. Acad. Sci. (U.S.A.)* 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali et al., *Proc. Natl. Acad. Sci. (U.S.A.)* 88:1943-1947 (1991), the entirety of which is herein incorporated by reference). Typically, the cDNA population is normalized by subtractive hybridization (Schmid et al., *J. Neurochem.* 48:307-312 (1987), the entirety of which is herein incorporated by reference; Fargnoli et al., *Anal. Biochem.* 187:364-373 (1990), the entirety of which is herein incorporated by reference; Travis et al., *Proc. Natl. Acad. Sci (U.S.A.)* 85:1696-1700 (1988), the entirety of which is herein incorporated by reference; Kato, *Eur. J. Neurosci.* 2:704-711 (1990); and Schweinfest et al., *Genet. Anal. Tech. Appl.* 7:64-70 (1990), the entirety of which is herein incorporated by reference). Subtraction represents another method for reducing the population of certain sequences in the cDNA library (Swaroop et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci. (U.S.A.)* 74:5463-5467 (1977), the entirety of which is herein incorporated by reference and the chemical degradation method of Maxam and Gilbert, *Proc. Nat. Acad. Sci. (U.S.A.)* 74:560-564 (1977), the entirety of which is herein incorporated by reference. Automation and advances in technology such as the replacement of radioisotopes with fluorescence-based sequencing have reduced the effort required to sequence DNA (Craxton, *Methods* 2:20-26 (1991), the entirety of which is herein incorporated by reference; Ju et al., *Proc. Natl. Acad. Sci. (U.S.A.)* 92:4347-4351 (1995), the entirety of which is herein incorporated by reference; Tabor and Richardson, *Proc. Natl. Acad. Sci. (U.S.A.)* 92:6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117:265-281 (1997), all of which are herein incorporated by reference in their entirety).

ESTs longer than 150 nucleotides have been found to be useful for similarity searches and mapping (Adams et al., *Science* 252:1651-1656 (1991), herein incorporated by reference). ESTs, which can represent copies of up to the full length transcript, may be partially or completely sequenced. Between 150-450 nucleotides of sequence information is usually generated as this is the length of sequence information that is routinely and reliably produced using single run sequence data. Typically, only single run sequence data is obtained from the cDNA library (Adams et al., *Science* 252:1651-1656 (1991). Automated single run sequencing typically results in an approximately 2-3% error or base ambiguity rate (Boguski et al., *Nature Genetics* 4:332-333 (1993), the entirety of which is herein incorporated by reference).

EST databases have been constructed or partially constructed from, for example, *C. elegans* (McCombrie et al., *Nature Genetics* 1:124-131 (1992)), human liver cell line HepG2 (Okubo et al., *Nature Genetics* 2:173-179 (1992)), human brain RNA (Adams et al., *Science* 252:1651-1656 (1991); Adams et al., *Nature* 355:632-635 (1992)), *Arabidopsis*, (Newman et al., *Plant Physiol.* 106:1241-1255 (1994)); and rice (Kurata et al., *Nature Genetics* 8:365-372 (1994)).

VII. Sequence Comparisons

A characteristic feature of a DNA sequence is that it can be compared with other DNA sequences. Sequence comparisons can be undertaken by determining the similarity of the test or query sequence with sequences in publicly available or proprietary databases ("similarity analysis") or by searching for certain motifs ("intrinsic sequence analysis")(e.g. cis elements)(Coulson, *Trends in Biotechnology* 12:76-80 (1994), the entirety of which is herein incorporated by reference); Birren et al., *Genome Analysis* 1: Cold Spring Harbor Laboratory Press, Cold Spring Harbor, N.Y. 543-559 (1997), the entirety of which is herein incorporated by reference).

Similarity analysis includes database search and alignment. Examples of public databases include the DNA Database of Japan (DDBJ)(http://www.ddbj.nig.ac.jp/); Genebank (http://www.ncbi.nlm.nih.gov/Web/Search/Index.htlm); and the European Molecular Biology Laboratory Nucleic Acid Sequence Database (EMBL) (http://www.ebi.ac.uk/ebi_docs/embl_db/embl-db.html). Other appropriate databases include dbEST (http://www.ncbi.nlm.nih.gov/dbEST/index.html), SwissProt (http://www.ebi.ac.uk/ebi_docs/swisprot_db/swisshome.html), PIR (http://www-nbrt.georgetown.edu/pir/) and The Institute for Genome Research (http://www.tigr.ore/tdb/tdb.html)

A number of different search algorithms have been developed, one example of which are the suite of programs referred to as BLAST programs. There are five implementations of BLAST, three designed for nucleotide sequences queries (BLASTN, BLASTX and TBLASTX) and two designed for protein sequence queries (BLASTP and TBLASTN) (Coulson, *Trends in Biotechnology* 12:76-80 (1994); Birren et al., *Genome Analysis* 1, Cold Spring Harbor Laboratory Press, Cold Spring Harbor, N.Y. 543-559 (1997)).

BLASTN takes a nucleotide sequence (the query sequence) and its reverse complement and searches them against a nucleotide sequence database. BLASTN was designed for speed, not maximum sensitivity and may not find distantly related coding sequences. BLASTX takes a nucleotide sequence, translates it in three forward reading frames and three reverse complement reading frames and then compares the six translations against a protein sequence database. BLASTX is useful for sensitive analysis of preliminary (single-pass) sequence data and is tolerant of sequencing errors (Gish and States, *Nature Genetics* 3:266-272 (1993), the entirety of which is herein incorporated by reference). BLASTN and BLASTX may be used in concert for analyzing EST data (Coulson, *Trends in Biotechnology* 12:76-80 (1994); Birren et al., *Genome Analysis* 1:543-559 (1997)).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, *Proteins* 17:49-61 (1993), the entirety of which is herein incorporated by reference), which is currently the default choice for BLAST programs. BLOSUM62 is tailored for alignments of moderately diverged sequences and thus may not yield the best results under all conditions. Altschul, *J. Mol. Biol.* 36:290-300 (1993), the entirety of which is herein incorporated by reference, describes a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package that performs progressive multiple sequence alignments based on the method of Feng and Doolittle, *J. Mol. Evol.* 25:351-360 (1987), the entirety of which is herein incorporated by reference. Each pair of sequences is aligned and the distance between each pair is calculated; from this distance matrix, a guide tree is calculated and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both pairwise alignments and multiple alignments. CLUSTAL W for UNIX and VMS systems is available at: fRp.ebi.ac.uk. Another program is MACAW (Schuler et al., *Proteins Struct. Func. Genet.* 9:180-190 (1991), the entirety of which is herein incorporated by reference, for which both Macintosh and Microsoft Windows versions are available. MACAW uses a graphical interface, provides a choice of several alignment algorithms and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research* 22:3583-3589 (1994), the entirety of which is herein incorporated by reference). PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by Henikoff, *Trends Biochem Sci.* 18:267-268 (1993), the entirety of which is herein incorporated by reference; Henikoff and Henikoff, *Nucleic Acid Research* 19:6565-6572 (1991), the entirety of which is herein incorporated by reference; Henikoff and Henikoff, *Proteins* 17:49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein query or a nucleotide query can be submitted to the BLOCKS server; if a nucleotide sequence is submitted, the sequence is translated in all six reading frames and motifs are sought for these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches such as GCG program ProfileSearch and Hidden Markov Models (HMs)(Krough et al., *J. Mol. Biol.* 235:1501-1531, (1994); Eddy, *Current Opinion in Structural Biology* 6:361-365, (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, carbon assimilation pathway enzymes, signal transduction molecules and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al., *Proc. Natl. Acad. Sci.* (*U.S.A.*) 91:12091-12095 (1994), the entirety of which is herein incorporated by reference). On the basis of an aligned set of input sequences, a weight matrix is calculated by using one of four methods (selected by the user). A weight matrix is simply a representation, position by position of how likely a particular amino acid will appear. The calculated weight matrix is then used to search the databases. To increase sensitivity, newly found sequences are added to the original data set, the weight matrix is recalculated and the search is performed again. This procedure continues until no new sequences are found.

SUMMARY OF THE INVENTION

The present invention provides a substantially purified nucleic acid molecule that encodes a maize or soybean carbon assimilation pathway enzyme or fragment thereof, wherein the maize or soybean carbon assimilation pathway enzyme is selected from the group consisting of: (a) ribulose-bisphosphate carboxylase; (b) phosphoglycerate kinase; (c) glyceraldehyde 3-phosphate dehydrogenase; (d) putative glyceraldehyde 3-phosphate dehydrogenase; (e) triose phosphate isomerase; (f) aldolase; (g) fructose-1,6-bisphosphatase; (h) transketolase; (i) putative transketolase; (j) sedoheptulose-1,7-bisphophatase; (k) D-ribulose-5-phosphate-3-epimerase; (l) ribose-5-phosphate isomerase; (m) putative ribose-5-phosphate isomerase; (n) ribose-5-phosphate kinase; (o) phosphoenolpyruvate carboxylase; (p) NADP-dependent malate dehydrogenase; (q) aspartate aminotransferase; (r) putative aspartate aminotransferase; (s) alanine aminotransferase; (t) NADP-dependent malec enzyme; (u) NAD-dependent malic enzyme; (v) PEP carboxykinase; (w) putative PEP carboxykinase; (x) pyruvate, phosphate dikinase; and (y) pyrophosphatase.

The present invention also provides a substantially purified nucleic acid molecule that encodes a plant carbon assimilation pathway enzyme or fragment thereof, wherein the nucleic acid molecule is selected from the group consisting of a nucleic acid molecule that encodes a maize or soybean ribulose-bisphosphate carboxylase or fragment thereof, a nucleic acid molecule that encodes a maize or soybean phosphoglycerate kinase or fragment thereof, a nucleic acid molecule that encodes a maize or soybean glyceraldehyde 3-phosphate dehydrogenase or fragment thereof, a nucleic acid molecule that encodes a putative maize glyceraldehyde 3-phosphate dehydrogenase or fragment thereof, a nucleic acid molecule that encodes a maize or soybean triose phosphate isomerase or fragment thereof, a nucleic acid molecule that encodes a maize or soybean aldolase or fragment thereof, a nucleic acid molecule that encodes a maize or soybean fructose-1,6-bisphosphatase or fragment thereof, a nucleic acid molecule that encodes a maize or soybean transketolase or fragment thereof, a nucleic acid molecule that encodes a putative maize or soybean transketolase or fragment thereof, a nucleic acid molecule that encodes a maize or soybean sedoheptulose-1,7-bisphophatase or fragment thereof, a nucleic acid molecule that encodes a maize or soybean D-ribulose-5-phosphate-3-epimerase or fragment thereof, a nucleic acid molecule that encodes a maize or soybean ribose-5-phosphate isomerase or fragment thereof, a nucleic acid molecule that encodes a putative maize or soybean ribose-5-phosphate isomerase or fragment thereof, a nucleic acid molecule that encodes a maize or soybean ribose-5-phosphate kinase or fragment thereof, a nucleic acid molecule that encodes a maize or soybean phosphoenolpyruvate carboxylase or fragment thereof, a nucleic acid molecule that encodes a maize or soybean NADP-dependent malate dehydrogenase or fragment thereof, a nucleic acid molecule that encodes a maize or soybean aspartate aminotransferase or fragment thereof, a nucleic acid molecule that encodes a putative maize or soybean aspartate aminotransferase or fragment thereof, a nucleic acid molecule that encodes a maize or soybean alanine aminotransferase or fragment thereof, a nucleic acid molecule that encodes a maize or soybean NADP-dependent malic enzyme or fragment thereof, a nucleic acid molecule that encodes a maize or soybean NAD-dependent malic enzyme or fragment thereof, a nucleic acid molecule that encodes a maize or soybean PEP carboxykinase or fragment thereof, a nucleic acid molecule that encodes a putative soybean PEP carboxykinase or fragment thereof, a nucleic acid molecule that encodes a maize or soybean pyruvate, phosphate dikinase or fragment thereof and a nucleic acid molecule that encodes a maize or soybean pyrophospatase or fragment thereof.

The present invention also provides a substantially purified maize or soybean carbon assimilation pathway enzyme or fragment thereof, wherein the maize or soybean carbon assimilation pathway enzyme is selected from the group consisting of (a) ribulose-bisphosphate carboxylase or fragment thereof; (b) phosphoglycerate kinase; (c) glyceraldehyde 3-phosphate dehydrogenase; (d) putative glyceraldehyde 3-phosphate dehydrogenase; (e) triose phosphate isomerase; (f) aldolase; (g) fructose-1,6-bisphosphatase; (h) transketolase; (i) putative transketolase; (j) sedoheptulose-1,7-bisphophatase; (k) D-ribulose-5-phosphate-3-epimerase; (l) ribose-5-phosphate isomerase; (m) putative ribose-5-phosphate isomerase; (n) ribose-5-phosphate kinase; (o) phosphoenolpyruvate carboxylase; (p) NADP-dependent malate dehydrogenase; (q) aspartate aminotransferase; (r) putative aspartate aminotransferase; (s) alanine aminotransferase; (t) NADP-dependent malic enzyme; (u) NAD-dependent malic enzyme; (v) PEP carboxykinase; (w) putative PEP carboxykinase; (x) pyruvate, phosphate dikinase; and (y) pyrophosphatase.

The present invention also provides a substantially purified maize or soybean carbon assimilation pathway enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 7341.

The present invention also provides a substantially purified maize or soybean ribulose-bisphosphate carboxylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 281 and SEQ ID NO: 282 through SEQ ID NO: 847.

The present invention also provides a substantially purified maize or soybean ribulose-bisphosphate carboxylase enzyme or fragment thereof encoded by a nucleic acid sequence selected from the group consisting of SEQ ID NO: 1 through SEQ ID NO: 281 and SEQ BD NO: 282 through SEQ ID NO: 847.

The present invention also provides a substantially purified maize or soybean phosphoglycerate kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 848 through SEQ ID NO: 1090 and SEQ ID NO: 1091 through SEQ ID NO: 1307.

The present invention also provides a substantially purified maize or soybean phosphoglycerate kinase enzyme or fragment thereof encoded by a nucleic acid sequence selected from the group consisting of SEQ ID NO: 848 through SEQ ID NO: 1090 and SEQ ID NO: 1091 through SEQ ID NO: 1307.

The present invention also provides a substantially purified maize or soybean glyceraldehyde 3-phosphate dehydrogenase enzyme or fragment thereof encoded by a first nucleic acid molecule which specifically hybridizes to a second nucleic acid molecule, the second nucleic acid molecule having a nucleic acid sequence consisting of a complement of SEQ ID NO: 1308 through SEQ ID NO: 2383 and SEQ ID NO: 2397 through SEQ ID NO: 3540.

The present invention also provides a substantially purified maize or soybean glyceraldehyde 3-phosphate dehydrogenase enzyme or fragment thereof encoded by a nucleic acid sequence consisting of SEQ ID NO: 1308 through SEQ ID NO: 2383 and SEQ ID NO: 2397 through SEQ ID NO: 3540.

The present invention also provides a substantially purified putative maize glyceraldehyde 3-phosphate dehydrogenase enzyme or fragment thereof encoded by a first nucleic acid molecule which specifically hybridizes to a second nucleic acid molecule, the second nucleic acid molecule having a nucleic acid sequence consisting of a complement of SEQ ID NO: 2384 through SEQ ID NO: 2396.

The present invention also provides a substantially purified putative maize glyceraldehyde 3-phosphate dehydrogenase enzyme or fragment thereof encoded by a nucleic acid sequence consisting of SEQ ID NO: 2384 through SEQ ID NO: 2396.

The present invention also provides a substantially purified maize or soybean triose phosphate isomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 3541 through SEQ ID NO: 3746 and SEQ ID NO: 3747 through SEQ ID NO: 3918.

The present invention also provides a substantially purified maize or soybean triose phosphate isomerase enzyme or fragment thereof encoded by a nucleic acid sequence selected from the group consisting of SEQ ID NO: 3541 through SEQ ID NO: 3746 and SEQ ID NO: 3747 through SEQ ID NO: 3918.

The present invention also provides a substantially purified maize or soybean aldolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 3919 through SEQ ID NO: 3963 and SEQ ID NO: 3964 through SEQ ID NO: 4370.

The present invention also provides a substantially purified maize or soybean aldolase enzyme or fragment thereof encoded by a nucleic acid sequence selected from the group consisting of SEQ ID NO: 3919 through SEQ ID NO: 3963 and SEQ ID NO: 3964 through SEQ ID NO: 4370.

The present invention also provides a substantially purified maize or soybean fructose-1,6-bisphosphatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4371 through SEQ ID NO: 4421 and SEQ ID NO: 4422 through SEQ ID NO: 4475.

The present invention also provides a substantially purified soybean fructose-1,6-bisphosphatase enzyme or fragment thereof encoded by a nucleic acid sequence selected from the group consisting of SEQ ID NO: 4371 through SEQ ID NO: 4421 and SEQ ID NO: 4422 through SEQ ID NO: 4475.

The present invention also provides a substantially purified maize or soybean transketolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4476 through SEQ ID NO: 4513 and SEQ ID NO: 4525 through SEQ ED NO: 4605.

The present invention also provides a substantially purified maize or soybean transketolase or fragment thereof encoded by a nucleic acid sequence selected from the group consisting of SEQ ID NO: 4476 through SEQ ID NO: 4513 and SEQ ID NO: 4525 through SEQ ID NO:4605.

The present invention also provides a substantially purified putative maize or soybean transketolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4514 through SEQ ID NO: 4524 and SEQ ID NO: 4606 through SEQ ID NO: 4612.

The present invention also provides a substantially purified putative maize or soybean transketolase or fragment thereof encoded by a nucleic acid sequence selected from the group consisting of SEQ ID NO: 4514 through SEQ ID NO: 4524 and SEQ ID NO: 4606 through SEQ ID NO: 4612.

The present invention also provides a substantially purified maize or soybean sedoheptulose-1,7-bisphophatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4613 through SEQ ID NO: 4614 and SEQ ID NO: 4615 through SEQ ID NO: 4677.

The present invention also provides a substantially purified maize or soybean sedoheptulose-1,7-bisphosphatase enzyme or fragment thereof encoded by a nucleic acid sequence selected from the group consisting of SEQ ID NO: 4613 through SEQ ID NO: 4614 and SEQ ID NO: 4615 through SEQ ID NO: 4677.

The present invention also provides a substantially purified maize or soybean D-ribulose-5-phosphate-3-epimerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4678 through SEQ ID NO: 4723 and SEQ ID NO: 4724 through SEQ ID NO 4762.

The present invention also provides a substantially purified maize or soybean D-ribulose-5-phosphate-3-epimerase enzyme or fragment thereof en selected from the group consisting of SEQ ID NO: 4678 through SEQ ID NO: 4723 and SEQ ID NO: 4724 through SEQ ID NO 4762.

The present invention also provides a substantially purified maize or soybean ribose-5-phosphate isomerase enzyme or fragment thereof encoded by a first nucleic acid molecule which specifically hybridizes to a second nucleic acid molecule, the second nucleic acid molecule having a nucleic acid sequence consisting of a complement of SEQ ID NO: 4763 through SEQ ID NO: 4769 and SEQ ID NO: 4772 through SEQ ID NO: 4776.

The present invention also provides a substantially purified maize or soybean ribose-5-phosphate isomerase enzyme or fragment thereof encoded by a nucleic acid sequence consisting of SEQ ID NO: 4763 through SEQ ID NO: 4769 and SEQ ID NO: 4772 through SEQ ID NO: 4776.

The present invention also provides a substantially purified putative maize or soybean ribose-5-phosphate isomerase enzyme or fragment thereof encoded by a first nucleic acid molecule which specifically hybridizes to a second nucleic acid molecule, the second nucleic acid molecule having a nucleic acid sequence consisting of a complement of SEQ ID NO: 4770 through SEQ ID NO: 4771 and SEQ ID NO: 4777 through SEQ ID NO: 4781.

The present invention also provides a substantially purified putative maize or soybean ribose-5-phosphate isomerase enzyme or fragment thereof encoded by a nucleic acid sequence consisting of SEQ ID NO: 4770 through SEQ ID NO: 4771 and SEQ ID NO: 4777 through SEQ ID NO: 4781.

The present invention also provides a substantially purified maize or soybean ribose-5-phosphate kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4782 through SEQ ID NO: 4832 and SEQ ID NO: 4833 through SEQ ID NO: 4908.

The present invention also provides a substantially purified maize or soybean ribose-5-phosphate kinase enzyme or fragment thereof encoded by a nucleic acid sequence selected from the group consisting of SEQ ID NO: 4782 through SEQ ID NO: 4832 and SEQ ID NO: 4833 through SEQ ID NO: 4908.

The present invention also provides a substantially purified maize or soybean phosphoenolpyruvate carboxylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4909 through SEQ ID NO: 5282 and SEQ ID NO: 5283 through SEQ ID NO: 5371.

The present invention also provides a substantially purified maize or soybean phosphoenolpyruvate enzyme or fragment thereof encoded by a nucleic acid sequence selected from the group consisting of SEQ ID NO: 4909 through SEQ ID NO: 5282 and SEQ ID NO: 5283 through SEQ ID NO: 5371.

The present invention also provides a substantially purified maize or soybean NADP-dependent malate dehydrogenase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5372 through SEQ ID NO: 5419 and SEQ ID NO: 5420 through SEQ ID NO: 5423.

The present invention also provides a substantially purified soybean NADP-dependent malate dehadrogenase enzyme or fragment thereof encoded by a nucleic acid sequence selected from the group consisting of SEQ ID NO: 5372 through SEQ ID NO: 5419 and SEQ ID NO: 5420 through SEQ ID NO: 5423.

The present invention also provides a substantially purified maize or soybean aspartate aminotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5424 through SEQ ID NO: 5596 and SEQ ID NO: 5601 through SEQ ID NO: 5719.

The present invention also provides a substantially purified maize or soybean aspartate aminotransferase enzyme or fragment thereof encoded by a nucleic acid sequence selected from the group consisting of SEQ ID NO: 5424 through SEQ ID NO: 5596 and SEQ ID NO: 5601 through SEQ ID NO: 5719.

The present invention also provides a substantially purified putative maize or soybean aspartate aminotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5597 through SEQ ID NO: 5600 and SEQ ID NO: 5720 through SEQ ID NO: 5727.

The present invention also provides a substantially purified putative maize or soybean aspartate aminotransferase enzyme or fragment thereof encoded by a nucleic acid sequence selected from the group consisting of SEQ ID NO: 5597 through SEQ ID NO: 5600 and SEQ ID NO: 5720 through SEQ ID NO: 5727.

The present invention also provides a substantially purified maize or soybean alanine aminotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5728 through SEQ ID NO: 5888 and SEQ ID NO: 5889 through SEQ ID NO: 6004.

The present invention also provides a substantially purified maize or soybean alanine aminotransferase enzyme or fragment thereof encoded by a nucleic acid sequence selected from the group consisting of SEQ ID NO: 5728 through SEQ ID NO: 5888 and SEQ ID NO: 5889 through SEQ ID NO: 6004.

The present invention also provides a substantially purified maize or soybean NADP-dependent malic enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6005 through SEQ ID NO: 6223 and SEQ ID NO: 6224 through SEQ ID NO: 6287.

The present invention also provides a substantially purified maize or soybean NADP-dependent malic enzyme or fragment thereof encoded by a nucleic acid sequence selected from the group consisting of SEQ ID NO: 6005 through SEQ ID NO: 6223 and SEQ ID NO: 6224 through SEQ ID NO: 6287.

The present invention also provides a substantially purified maize or soybean NAD-dependent malic enzyme or fragment thereof encoded by a first nucleic acid molecule which specifically hybridizes to a second nucleic acid molecule, the second nucleic acid molecule having a nucleic acid sequence consisting of a complement of SEQ ID NO: 6022 through SEQ ID NO: 6023, SEQ ID NO: 6288 through SEQ ID NO: 6290 and SEQ ID NO: 6291 through SEQ ID NO: 6293.

The present invention also provides a substantially purified maize or soybean NAD-dependent malic enzyme or fragment thereof encoded by a nucleic acid sequence consisting of SEQ ID NO: 6022 through SEQ ID NO: 6023, SEQ ID NO: 6288 through SEQ ID NO: 6290 and SEQ ID NO: 6291 through SEQ ID NO: 6293.

The present invention also provides a substantially purified maize or soybean PEP carboxykinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6294 through SEQ ID NO: 6353 and SEQ ID NO: 6354 through SEQ ID NO: 6387.

The present invention also provides a substantially purified maize or soybean PEP carboxykinase enzyme or fragment thereof encoded by a nucleic acid sequence selected from the group consisting of SEQ ID NO: 6294 through SEQ ID NO: 6353 and SEQ ID NO: 6354 through SEQ ID NO: 6387.

The present invention also provides a substantially purified putative soybean PEP carboxykinase enzyme or fragment thereof encoded by a first nucleic acid molecule which specifically hybridizes to a second nucleic acid molecule, the second nucleic acid molecule having a nucleic acid sequence consisting of a complement of SEQ ID NO: 6388.

The present invention also provides a substantially purified putative soybean PEP carboxykinase enzyme or fragment thereof encoded by a nucleic acid sequence consisting of SEQ ID NO: 6388.

The present invention also provides a substantially purified maize or soybean pyruvate, phosphate dikinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6389 through SEQ ID NO: 6847 and SEQ ID NO: 6848 through SEQ ID NO: 6850.

The present invention also provides a substantially purified maize or soybean pyruvate, phosphate dikinase enzyme or fragment thereof encoded by a nucleic acid sequence selected from the group consisting of SEQ ID NO: 6389 through SEQ ID NO: 6847 and SEQ ID NO: 6848 through SEQ ID NO: 6850.

The present invention also provides a substantially purified maize or soybean pyrophosphatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6851 through SEQ ID NO: 7154 and SEQ ID NO: 7155 through SEQ ID NO: 7341.

The present invention also provides a substantially purified soybean pyrophophatase enzyme or fragment thereof encoded by a nucleic acid sequence selected from the group consisting of SEQ ID NO: 6851 through SEQ ID NO: 7154 and SEQ ID NO: 7155 through SEQ ID NO: 7341.

The present invention also provides a purified antibody or fragment thereof which is capable of specifically binding to a maize or soybean carbon assimilation pathway enzyme or fragment thereof, wherein the maize or soybean or carbon assimilation pathway enzyme or fragment thereof is encoded by a nucleic acid molecule comprising a nucleic acid sequence selected from the group consisting of SEQ ID NO: 1 through SEQ ID NO: 7341.

The present invention also provides a substantially purified antibody or fragment thereof, the antibody or fragment thereof capable of specifically binding to a maize or soybean ribulose-bisphosphate carboxylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 281 and SEQ ID NO: 282 through SEQ ID NO: 847.

The present invention also provides a substantially purified antibody or fragment thereof, the antibody or fragment thereof capable of specifically binding to a maize or soybean phosphoglycerate kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 848 through SEQ ID NO: 1090 and SEQ ID NO: 1091 through SEQ ID NO: 1307.

The present invention also provides a substantially purified antibody or fragment thereof, the antibody or fragment thereof capable of specifically binding to a maize or soybean glyceraldehyde 3-phosphate dehydrogenase enzyme or fragment thereof encoded by a first nucleic acid molecule which specifically hybridizes to a second nucleic acid molecule, the second nucleic acid molecule consisting of a compliment of a nucleic acid sequence having a nucleic acid sequence selected from the group consisting of SEQ ID NO: 1308 through SEQ ID NO: 2383 and SEQ ID NO: 2397 through SEQ ID NO: 3540

The present invention also provides a substantially purified antibody or fragment thereof, the antibody or fragment thereof capable of specifically binding to a putative maize glyceraldehyde 3-phosphate dehydrogenase enzyme or fragment thereof encoded by a first nucleic acid molecule which specifically hybridizes to a second nucleic acid molecule, the second nucleic acid molecule consisting of a compliment of a nucleic acid sequence having a nucleic acid sequence selected from the group consisting of SEQ ID NO: 2384 through SEQ ID NO: 2396.

The present invention also provides a substantially purified antibody or fragment thereof, the antibody or fragment thereof capable of specifically binding to a maize or soybean triose phosphate isomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 3541 through SEQ ID NO: 3746 and SEQ ID NO: 3747 through SEQ ID NO: 3918.

The present invention also provides a substantially purified antibody or fragment thereof, the antibody or fragment thereof capable of specifically binding to a maize or soybean aldolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 3919 through SEQ ID NO: 3963 and SEQ ID NO: 3964 through SEQ ID NO: 4370.

The present invention also provides a substantially purified antibody or fragment thereof, the antibody or fragment thereof capable of specifically binding to a maize or soybean fructose-1,6-bisphosphatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4371 through SEQ ID NO: 4421 and SEQ ID NO: 4422 through SEQ ID NO: 4475.

The present invention also provides a substantially purified antibody or fragment thereof, the antibody or fragment thereof capable of specifically binding to a maize or soybean transketolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4476 through SEQ ID NO: 4513 and SEQ ID NO: 4525 through SEQ ID NO: 4605.

The present invention also provides a substantially purified antibody or fragment thereof, the antibody or fragment thereof capable of specifically binding to a putative maize or soybean transketolase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4514 through SEQ ID NO: 4524 and SEQ ID NO: 4606 through SEQ ID NO: 4612.

The present invention also provides a substantially purified antibody or fragment thereof, the antibody or fragment thereof capable of specifically binding to a maize or soybean sedoheptulose-1,7-bisphosphatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4613 through SEQ ID NO: 4614 and SEQ ID NO: 4615 through SEQ ID NO: 4677.

The present invention also provides a substantially purified antibody or fragment thereof, the antibody or fragment thereof capable of specifically binding to a maize or soybean D-ribulose-5-phosphate-3-epimerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4678 through SEQ ID NO: 4723 and SEQ ID NO: 4724 through SEQ ID NO: 4762.

The present invention also provides a substantially purified antibody or fragment thereof, the antibody or fragment thereof capable of specifically binding to a maize or soybean ribose-5-phosphate isomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4763 through SEQ ID NO: 4769 and SEQ ID NO: 4772 through SEQ ID NO: 4776.

The present invention also provides a substantially purified antibody or fragment thereof, the antibody or fragment thereof capable of specifically binding to a putative maize or soybean ribose-5-phosphate isomerase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4770 through SEQ ID NO: 4771 and SEQ ID NO: 4777 through SEQ ID NO: 4781.

The present invention also provides a substantially purified antibody or fragment thereof, the antibody or fragment thereof capable of specifically binding to a maize or soybean ribose-5-phosphate kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4782 through SEQ ID NO: 4832 and SEQ ID NO: 4833 through SEQ ID NO: 4908.

The present invention also provides a substantially purified antibody or fragment thereof, the antibody or fragment thereof capable of specifically binding to a maize or soybean phosphoenolpyruvate carboxylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 4909 through SEQ ID NO: 5282 and SEQ ID NO: 5283 through SEQ ID NO: 5371.

The present invention also provides a substantially purified antibody or fragment thereof, the antibody or fragment thereof capable of specifically binding to a maize or soybean NADP-dependent malate dehydrogenase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5372 through SEQ ID NO: 5419 and SEQ ID NO: 5420 through SEQ ID NO: 5423.

The present invention also provides a substantially purified antibody or fragment thereof, the antibody or fragment thereof capable of specifically binding to a maize or soybean aspartate aminotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5424 through SEQ ID NO: 5596 and SEQ ID NO: 5601 through SEQ ID NO: 5719.

The present invention also provides a substantially purified antibody or fragment thereof, the antibody or fragment thereof capable of specifically binding to a putative maize or soybean aspartate aminotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5597 through SEQ ID NO: 5600 and SEQ ID NO: 5720 through SEQ ID NO: 5727.

The present invention also provides a substantially purified antibody or fragment thereof, the antibody or fragment thereof capable of specifically binding to a maize or soybean alanine aminotransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 5728 through SEQ ID NO: 5888 and SEQ ID NO: 5889 through SEQ ED NO: 6004.

The present invention also provides a substantially purified antibody or fragment thereof, the antibody or fragment thereof capable of specifically binding to a maize or soybean NADP-dependent malic enzyme or fragment thereof encoded by a first nucleic acid molecule which specifically hybridizes to a second nucleic acid molecule, the second nucleic acid molecule consisting of a compliment of a nucleic acid sequence having a nucleic acid sequence selected from the group consisting of SEQ ID NO: 6005 through SEQ ID NO: 6223 and SEQ ID NO: 6224 through SEQ ID NO: 6287.

The present invention also provides a substantially purified antibody or fragment thereof, the antibody or fragment thereof capable of specifically binding to a maize or soybean NAD-dependent malic enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6022 through SEQ ID NO: 6023, SEQ ID NO: 6288 through SEQ ID NO: 6290 and SEQ ID NO: 6291 through SEQ ID NO: 6293.

The present invention also provides a substantially purified antibody or fragment thereof, the antibody or fragment thereof capable of specifically binding to a maize or soybean PEP carboxykinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6294 through SEQ ID NO: 6353 and SEQ ID NO: 6354 through SEQ ID NO: 6387.

The present invention also provides a substantially purified antibody or fragment thereof, the antibody or fragment thereof capable of specifically binding to a putative soybean PEP carboxykinase enzyme or fragment thereof encoded by a first nucleic acid molecule which specifically hybridizes to a second nucleic acid molecule, the second nucleic acid molecule having a nucleic acid sequence consisting of a complement of SEQ ID NO: 6388.

The present invention also provides a substantially purified antibody or fragment thereof, the antibody or fragment thereof capable of specifically binding to a maize or soybean pyruvate, phosphate dikinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6389 through SEQ ID NO: 6847 and SEQ ID NO: 6848 through SEQ ID NO: 6850.

The present invention also provides a substantially purified antibody or fragment thereof, the antibody or fragment thereof capable of specifically binding to a maize or soybean pyrophosphatase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 6851 through SEQ ID NO: 7154 and SEQ ID NO: 7155 through SEQ ID NO: 7341.

The present invention also provides a transformed plant having a nucleic acid molecule which comprises: (A) an exogenous promoter region which functions in a plant cell to cause the production of a mRNA molecule; (B) a structural nucleic acid molecule comprising a nucleic acid sequence selected from the group consisting of (a) a nucleic acid sequence which encodes for a maize or soybean ribulose-bisphosphate carboxylase enzyme or fragment thereof; (b) a nucleic acid sequence which encodes for a maize or soybean phosphoglycerate kinase enzyme or fragment thereof; (c) a nucleic acid sequence which encodes for a maize or soybean glyceraldehyde 3-phosphate dehydrogenase enzyme or fragment thereof; (d) a nucleic acid sequence which encodes for a putative maize glyceraldehyde 3-phosphate dehydrogenase enzyme or fragment thereof; (e) a nucleic acid sequence which encodes for a maize or soybean triose phosphate isomerase enzyme or fragment thereof; (f) a nucleic acid sequence which encodes for a maize or soybean aldolase enzyme or fragment thereof; (g) a nucleic acid sequence which encodes for a maize or soybean fructose-1,6-bisphosphatase enzyme or fragment thereof; (h) a nucleic acid sequence which encodes for a maize or soybean transketolase enzyme or fragment thereof; (i) a nucleic acid sequence which encodes for a putative maize or soybean transketolase enzyme or fragment thereof; (j) a nucleic acid sequence which encodes for a maize or soybean sedoheptulose-1,7-bisphophatase enzyme or fragment thereof; (k) a nucleic acid sequence which encodes for a maize or soybean D-ribulose-5-phosphate-3-epimerase enzyme or fragment thereof; (l) a nucleic acid sequence which encodes for a maize or soybean ribose-5-phosphate isomerase enzyme or fragment thereof; (m) a nucleic acid sequence which encodes for a putative maize or soybean ribose-5-phosphate isomerase enzyme or fragment thereof; (n) a nucleic acid sequence which encodes for a maize or soybean ribose-5-phosphate kinase enzyme or fragment thereof; (o) a nucleic acid sequence which encodes for a maize or soybean phosphoenolpyruvate dehydrogenase enzyme or fragment thereof; (p) a nucleic acid sequence which encodes for a maize or soybean NADP-dependent malate dehydrogenase enzyme or fragment thereof; (q) a nucleic acid sequence which encodes for a maize or soybean aspartate aminotransferase enzyme or fragment thereof; (r) a nucleic acid sequence which encodes for a putative maize or soybean aspartate aminotransferase enzyme or fragment thereof; (s) a nucleic acid sequence which encodes for a maize or soybean alanine aminotrasferase enzyme or fragment thereof; (t) a nucleic acid sequence which encodes for a maize or soybean NADP-dependent malic enzyme or fragment thereof; (u) a nucleic acid sequence which encodes for a maize or soybean NAD-dependent malic enzyme or fragment thereof; (v) a nucleic acid sequence which encodes for a maize or soybean PEP carboxykinase enzyme or fragment thereof; (w) a nucleic acid sequence which encodes for a putative soybean PEP carboxykinase enzyme or fragment thereof; (x) a nucleic acid sequence which encodes for a maize or soybean pyruvate, phosphate dikinase enzyme or fragment thereof; and (y) a nucleic acid sequence which encodes for a maize or soybean pyrophosphatase enzyme or fragment thereof; (z) a nucleic acid sequence which is complementary to any of the nucleic acid sequences of (a) through (y); and (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule encodes a plant carbon assimilation pathway enzyme or fragment thereof, the structural nucleic acid molecule comprising a nucleic acid sequence selected from the group consisting of SEQ ID NO: 1 through SEQ ID NO: 7341 or fragment thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule is selected from the group consisting of a nucleic acid molecule that encodes a maize or soybean ribulose-bisphosphate carboxylase enzyme or fragment thereof, a nucleic acid molecule that encodes a maize or soybean phosphoglycerate kinase enzyme or fragment thereof, a nucleic acid molecule that encodes a maize or soybean glyceraldehyde 3-phosphate dehydrogenase enzyme or fragment thereof, a nucleic acid molecule that encodes a putative maize glyceraldehyde 3-phosphate dehydrogenase enzyme or fragment thereof, a nucleic acid molecule that encodes a maize or soybean triose phosphate isomerase enzyme or fragment thereof, a nucleic acid molecule that encodes a maize or soybean aldolase enzyme or fragments thereof, a nucleic acid molecule that encodes a maize or soybean fructose-1,6-bisphosphatase enzyme or fragment thereof, a nucleic acid molecule that encodes a maize or soybean transketolase enzyme or fragments thereof, a nucleic acid molecule that encodes a putative maize or soybean transketolase enzyme or fragments thereof, a nucleic acid molecule that encodes a maize or soybean sedoheptulose-1,7-bisphosphatase enzyme or fragment thereof, a nucleic acid molecule that encodes a maize or soybean D-ribulose-5-phosphate-3-epimerase enzyme or fragment thereof, a nucleic acid molecule that encodes a maize or soybean ribose-5-phosphate isomerase enzyme or fragment thereof, a nucleic acid molecule that encodes a putative maize or soybean ribose-5-phosphate isomerase enzyme or fragment thereof, a nucleic acid molecule that encodes a maize or soybean ribose-5-phosphate kinase enzyme or fragment thereof, a nucleic acid molecule that encodes a maize or soybean phosphoenolpyruvate carboxylase enzyme or fragment thereof, a nucleic acid molecule that encodes a maize or soybean NADP-dependent malate dehydrogenase enzyme or fragments thereof, a nucleic acid molecule that encodes a maize or soybean aspartate aminotransferase enzyme or fragment thereof, a nucleic acid molecule that encodes a putative maize or soybean aspartate aminotransferase enzyme or fragment thereof, a nucleic acid molecule that encodes a maize or soybean alanine aminotransferase enzyme or fragments thereof, a nucleic acid molecule that encodes a maize or soybean NADP-dependent malic enzyme or fragment thereof, a nucleic acid molecule that encodes a maize or soybean NAD-dependent malic enzyme or fragment thereof, a nucleic acid molecule that encodes a maize or soybean PEP carboxykinase enzyme or fragment thereof, a nucleic acid molecule that encodes a putative soybean PEP carboxykinase enzyme or fragment thereof, a nucleic acid molecule that encodes a maize or soybean pyruvate, phosphate dikinase enzyme or fragment thereof, and a nucleic acid molecule that encodes a maize or soybean pyrophosphatase enzyme or fragments thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a transcribed nucleic acid molecule with a transcribed strand and a non-transcribed strand, wherein the transcribed strand is complementary to a nucleic acid molecule comprising a nucleic acid sequence selected from the group consisting of SEQ ID NO: 1 through SEQ ID NO: 7341 or fragment thereof; which is linked to (C) a 3' non-translated sequence that functions in plant cells to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to: (B) a transcribed nucleic acid molecule with a transcribed strand and a non-transcribed strand, wherein a transcribed mRNA of the transcribed strand is complementary to an endogenous mRNA molecule having a nucleic acid sequence selected from the group consisting of an endogenous mRNA molecule that encodes a maize or soybean ribulose-bisphosphate carboxylase enzyme or fragment thereof; an endogenous mRNA molecule that encodes a maize or soybean phosphoglycerate kinase enzyme or fragment thereof; an endogenous mRNA molecule that encodes a maize or soybean glyceraldehyde 3-phosphate dehydrogenase enzyme or fragment thereof; an endogenous mRNA molecule that encodes a putative maize glyceraldehyde 3-phosphate dehydrogenase enzyme or fragment thereof; an endogenous mRNA molecule that encodes a maize or soybean triose phosphate isomerase enzyme or fragment thereof; an endogenous mRNA molecule that encodes a maize or soybean aldolase enzyme or fragment thereof; an endogenous mRNA molecule that encodes a maize or soybean fructose-1,6-bisphosphatase enzyme or fragment thereof; an endogenous mRNA molecule that encodes a maize or soybean transketolase enzyme or fragment thereof; an endogenous mRNA molecule that encodes a putative maize or soybean transketolase enzyme or fragment thereof; an endogenous mRNA molecule that encodes a maize or soybean sedoheptulose-1,7-bisphosphatase enzyme or fragment thereof; an endogenous mRNA molecule that encodes a maize or soybean D-ribulose-5-phosphate-3-epimerase enzyme or fragment thereof; an endogenous mRNA molecule that encodes a maize or soybean ribose-5-phosphate isomerase enzyme or fragment thereof; an endogenous mRNA molecule that encodes a putative maize or soybean ribose-5-phosphate isomerase enzyme or fragment thereof; an endogenous mRNA molecule that encodes a maize or soybean ribose-5-phosphate kinase enzyme or fragment thereof; an endogenous mRNA molecule that encodes a maize or soybean phosphoenolpyruvate carboxylase enzyme or fragment thereof; an endogenous mRNA molecule that encodes a maize or soybean NADP-dependent malate dehydrogenase enzyme or fragment thereof; an endogenous mRNA molecule that encodes a maize or soybean aspartate aminotransferase enzyme or fragment thereof; an endogenous mRNA molecule that encodes a putative maize or soybean aspartate aminotransferase enzyme or fragment thereof; an endogenous mRNA molecule that encodes a maize or soybean alanine aminotransferase enzyme or fragment thereof; an endogenous mRNA molecule that encodes a maize or soybean NADP-dependent malic enzyme or fragment thereof; an endogenous mRNA molecule that encodes a maize or soybean NAD-dependent malic enzyme or fragment thereof; an endogenous mRNA molecule that encodes a maize or soybean PEP carboxykinase enzyme or fragment thereof; an endogenous mRNA molecule that encodes a putative soybean PEP carboxykinase enzyme or fragment thereof; an endogenous mRNA molecule that encodes a maize or soybean pyruvate, phosphate dikinase enzyme or fragment thereof; and an endogenous mRNA molecule that encodes a maize or soybean pyrophosphatase enzyme or fragment thereof; which is linked to (C) a 3' non-translated sequence that functions in the plant cell to cause termination of transcription and addition of polyadenylated ribonucleotides to a 3' end of the mRNA molecule.

The present invention also provides a method for determining a level or pattern of a plant carbon assimilation pathway enzyme in a plant cell or plant tissue comprising: (A) incubating, under conditions permitting nucleic acid hybridization, a marker nucleic acid molecule, the marker nucleic acid molecule having a nucleic acid sequence selected from the group consisting of SEQ ID NO: 1 through SEQ ID NO: 7341 or complements thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant carbon assimilation pathway enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant carbon assimilation pathway enzyme.

The present invention also provides a method for determining a level or pattern of a plant carbon assimilation pathway enzyme in a plant cell or plant tissue comprising: (A) incubating, under conditions permitting nucleic acid hybridization, a marker nucleic acid molecule, the marker nucleic acid molecule comprising a nucleic acid molecule that encodes a maize or soybean ribulose-bisphosphate carboxylase enzyme or complement thereof or fragment of either, a nucleic acid molecule that encodes a maize or soybean phosphoglycerate kinase enzyme or complement thereof or fragment of either, a nucleic acid molecule that encodes a maize or soybean glyceraldehyde 3-phosphate dehydrogenase enzyme or complement thereof or fragment of either, a nucleic acid molecule that encodes a putative maize glyceraldehyde 3-phosphate dehydrogenase enzyme or complement thereof or fragment of either, a nucleic acid molecule that encodes a maize or soybean triose phosphate isomerase enzyme or complement thereof or fragment of either, a nucleic acid molecule that encodes a maize or soybean aldolase enzyme or complement thereof or fragment of either, a nucleic acid molecule that encodes a maize or soybean fructose-1,6-bisphosphatase enzyme or complement thereof or fragment of either, a nucleic acid molecule that encodes a maize or soybean transketolase enzyme or complement thereof or fragment of either, a nucleic acid molecule that encodes a putative maize or soybean transketolase enzyme or complement thereof or fragment of either, a nucleic acid molecule that encodes a maize or soybean sedoheptulose-1,7-bisphosphatase enzyme or complement thereof or fragment of either, a nucleic acid molecule that encodes a maize or soybean D-ribulose-5-phosphate-3-epimerase enzyme or complement thereof or fragment of either, a nucleic acid molecule that encodes a maize or soybean ribose-5-phosphate isomerase enzyme or complement thereof or fragment of either, a nucleic acid molecule that encodes a putative maize or soybean ribose-5-phosphate isomerase enzyme or complement thereof or fragment of either, a nucleic acid molecule that encodes a maize or soybean ribose-5-phosphate kinase enzyme or complement thereof or fragment of either, a nucleic acid molecule that encodes a maize or soybean phosphoenolpyruvate carboxylase enzyme or complement thereof or fragment of either, a nucleic acid molecule that encodes a maize or soybean NADP-dependent malate dehydrogenase enzyme or complement thereof or fragment of either, a nucleic acid molecule that encodes a maize or soybean aspartate aminotransferase enzyme or complement thereof or fragment of either, a nucleic acid molecule that encodes a putative maize or soybean aspartate aminotransferase enzyme or complement thereof or fragment of either, a nucleic acid molecule that encodes a maize or soybean alanine aminotransferase enzyme or complement thereof or fragment of either, a nucleic acid molecule that encodes a maize or soybean NADP-dependent malic enzyme or complement thereof or fragment of either, a nucleic acid molecule that encodes a maize or soybean NAD-dependent malic enzyme or complement thereof or fragment of either, a nucleic acid molecule that encodes a maize or soybean PEP carboxykinase enzyme or complement thereof or fragment of either, a nucleic acid molecule that encodes a putative soybean PEP carboxykinase enzyme or complement thereof or fragment of either, a nucleic acid molecule that encodes a maize or soybean pyruvate, phosphate dikinase enzyme or complement thereof or fragment of either and a nucleic acid molecule that encodes a maize or soybean pyrophosphatase enzyme or complement thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant carbon assimilation pathway enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant carbon assimilation pathway enzyme.

The present invention also provides a method for determining a level or pattern of a plant carbon assimilation pathway enzyme in a plant cell or plant tissue under evaluation which comprises assaying the concentration of a molecule, whose concentration is dependent upon the expression of a gene, the gene specifically hybridizes to a nucleic acid molecule having a nucleic acid sequence selected from the group consisting of SEQ ID NO: 1 through SEQ ID NO: 7341 or complements thereof, in comparison to the concentration of that molecule present in a reference plant cell or a reference plant tissue with a known level or pattern of the plant carbon assimilation pathway enzyme, wherein the assayed concentration of the molecule is compared to the assayed concentration of the molecule in the reference plant cell or reference plant tissue with the known level or pattern of the plant carbon assimilation pathway enzyme.

The present invention also provides a method for determining a level or pattern of a plant carbon assimilation pathway enzyme in a plant cell or plant tissue under evaluation which comprises assaying the concentration of a molecule, whose concentration is dependent upon the expression of a gene, the gene specifically hybridizes to a nucleic acid molecule selected from the group consisting of a nucleic acid molecule that encodes a maize or soybean ribulose-bisphosphate carboxylase enzyme or complement thereof, a nucleic acid molecule that encodes a maize or soybean phosphoglycerate kinase enzyme or complement thereof, a nucleic acid molecule that encodes a maize or soybean glyceraldehyde 3-phosphate dehydrogenase enzyme or complement thereof, a nucleic acid molecule that encodes a putative maize glyceraldehyde 3-phosphate dehydrogenase enzyme or complement thereof, a nucleic acid molecule that encodes a maize or soybean triose phosphate isomerase enzyme or complement thereof, a nucleic acid molecule that encodes a maize or soybean aldolase enzyme or complement thereof, a nucleic acid molecule that encodes a maize or soybean fructose-1,6-bisphosphatase enzyme or complement thereof, a nucleic acid molecule that encodes a maize or soybean transketolase enzyme or complement thereof, a nucleic acid molecule that encodes a putative maize or soybean transketolase enzyme or complement thereof, a nucleic acid molecule that encodes a maize or soybean sedoheptulose-1,7-bisphosphatase enzyme or complement thereof, a nucleic acid molecule that encodes a maize or soybean D-ribulose-5-phosphate-3-epimerase enzyme or complement thereof, a nucleic acid molecule that encodes a maize or soybean ribose-5-phosphate isomerase enzyme or complement thereof, a nucleic acid molecule that encodes a putative maize or soybean ribose-5-phosphate isomerase enzyme or complement thereof, a nucleic acid molecule that encodes a maize or soybean ribose-5-phosphate kinase enzyme or complement thereof, a nucleic acid molecule that encodes a maize or soybean phosphoenolpyruvate carboxylase enzyme or complement thereof, a nucleic acid molecule that encodes a maize or soybean NADP-dependent malate dehydrogenase enzyme or complement thereof, a nucleic acid molecule that encodes a maize or soybean aspartate aminotransferase enzyme or complement thereof, a nucleic acid molecule that encodes a putative maize or soybean aspartate aminotransferase enzyme or complement thereof, a nucleic acid molecule that encodes a maize or soybean alanine aminotransferase enzyme or complement thereof, a nucleic acid molecule that encodes a maize or soybean NADP-dependent malic enzyme or complement thereof, a nucleic acid molecule that encodes a maize or soybean NAD-dependent malic enzyme enzyme or complement thereof, a nucleic acid molecule that encodes a maize or soybean PEP carboxykinase enzyme or complement thereof, a nucleic acid molecule that encodes a putative soybean PEP carboxykinase enzyme or complement thereof, a nucleic acid molecule that encodes a maize or soybean pyruvate, phosphate dikinase enzyme or complement thereof and a nucleic acid molecule that encodes a maize or soybean pyrophosphatase enzyme or complement thereof, in comparison to the concentration of that molecule present in a reference plant cell or a reference plant tissue with a known level or pattern of the plant carbon assimilation pathway enzyme, wherein the assayed concentration of the molecule is compared to the assayed concentration of the molecule in the reference plant cell or the reference plant tissue with the known level or pattern of the plant carbon assimilation pathway enzyme.

The present invention provides a method of determining a mutation in a plant whose presence is predictive of a mutation affecting a level or pattern of a protein comprising the steps: (A) incubating, under conditions permitting nucleic acid hybridization, a marker nucleic acid, the marker nucleic acid selected from the group of marker nucleic acid molecules which specifically hybridize to a nucleic acid molecule having a nucleic acid sequence selected from the group of SEQ ID NO: 1 through SEQ ID NO: 7341 or complements thereof or fragment of either and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the protein in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of a plant carbon assimilation pathway enzyme comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule having a nucleic acid sequence selected from the group consisting of SEQ ID NO: 1 through SEQ ID NO: 7341 or complements thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant carbon assimilation pathway enzyme in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of a plant carbon assimilation pathway enzyme comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule selected from the group consisting of a nucleic acid molecule that encodes a maize or soybean ribulose-bisphosphate carboxylase enzyme or complement thereof, a nucleic acid molecule that encodes a maize or soybean phosphoglycerate kinase enzyme or complement thereof, a nucleic acid molecule that encodes a maize or soybean glyceraldehyde 3-phosphate dehydrogenase enzyme or complement thereof, a nucleic acid molecule that encodes a putative maize glyceraldehyde 3-phosphate dehydrogenase enzyme or complement thereof, a nucleic acid molecule that encodes a maize or soybean triose phosphate isomerase enzyme or complement thereof, a nucleic acid molecule that encodes a maize or soybean aldolase enzyme or complement thereof, a nucleic acid molecule that encodes a maize or soybean fructose-1,6-bisphosphatase enzyme or complement thereof, a nucleic acid molecule that encodes a maize or soybean transketolase enzyme or complement thereof, a nucleic acid molecule that encodes a putative maize or soybean transketolase enzyme or complement thereof, a nucleic acid molecule that encodes a maize or soybean sedoheptulose-1,7-bisphosphatase enzyme or complement thereof, a nucleic acid molecule that encodes a maize or soybean D-ribulose-5-phosphate-3-epimerase enzyme or complement thereof, a nucleic acid molecule that encodes a maize or soybean ribose-5-phosphate isomerase enzyme or complement thereof, a nucleic acid molecule that encodes a putative maize or soybean ribose-5-phosphate isomerase enzyme or complement thereof, a nucleic acid molecule that encodes a maize or soybean ribose-5-phosphate kinase enzyme or complement thereof, a nucleic acid molecule that encodes a maize or soybean phosphoenolpyruvate carboxylase enzyme or complement thereof, a nucleic acid molecule that encodes a maize or soybean NADP-dependent malate dehydrogenase enzyme or complement thereof, a nucleic acid molecule that encodes a maize or soybean aspartate animotransferase enzyme or complement thereof, a nucleic acid molecule that encodes a putative maize or soybean aspartate animotransferase enzyme or complement thereof, a nucleic acid molecule that encodes a maize or soybean alanine aminotransferase enzyme or complement thereof, a nucleic acid molecule that encodes a maize or soybean NADP-dependent malic enzyme or complement thereof, a nucleic acid molecule that encodes a maize or soybean NAD-dependent malic enzyme or complement thereof, a nucleic acid molecule that encodes a maize or soybean PEP carboxykinase enzyme or complement thereof, a nucleic acid molecule that encodes a putative soybean PEP carboxykinase enzyme or complement thereof, a nucleic acid molecule that encodes a maize or soybean pyruvate, phosphate dikinase enzyme or complement thereof and a nucleic acid molecule that encodes a maize or soybean pyrophosphatase enzyme or complement thereof, and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant carbon assimilation pathway enzyme in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method of producing a plant containing an overexpressed protein comprising: (A) transforming the plant with a functional nucleic acid molecule, wherein the functional nucleic acid molecule comprises a promoter region, wherein the promoter region is linked to a structural region, wherein the structural region has a nucleic acid sequence selected from group consisting of SEQ ID NO: 1 through SEQ ID NO: 7341; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the protein; and (B) growing the transformed plant.

The present invention also provides a method of producing a plant containing an overexpressed plant carbon assimilation pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 7341 or fragment thereof; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the plant carbon assimilation pathway enzyme; and (B) growing the transformed plant.

The present invention also provides a method of producing a plant containing an overexpressed plant carbon assimilation pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule selected from the group consisting of a nucleic acid molecule that encodes a maize or soybean ribulose-bisphosphate carboxylase enzyme or fragment thereof, a nucleic acid molecule that encodes a maize or soybean phosphoglycerate kinase enzyme or fragment thereof, a nucleic acid molecule that encodes a maize or soybean glyceraldehyde 3-phosphate dehydrogenase enzyme or fragment thereof, a nucleic acid molecule that encodes a putative maize glyceraldehyde 3-phosphate dehydrogenase enzyme or fragment thereof, a nucleic acid molecule that encodes a maize or soybean triose phosphate isomerase enzyme or fragment thereof, a nucleic acid molecule that encodes a maize or soybean aldolase enzyme or fragment thereof, a nucleic acid molecule that encodes a maize or soybean fructose-1,6-bisphosphatase enzyme or fragment thereof, a nucleic acid molecule that encodes a maize or soybean transketolase enzyme or fragment thereof, a nucleic acid molecule that encodes a putative maize or soybean transketolase enzyme or fragment thereof a nucleic acid molecule that encodes a maize or soybean sedoheptulose-1,7-bisphosphatase enzyme or fragment thereof, a nucleic acid molecule that encodes a maize or soybean D-ribulose-5-phosphate-3-epimerase enzyme or fragment thereof, a nucleic acid molecule that encodes a maize or soybean ribose-5-phosphate isomerase enzyme or fragment thereof, a nucleic acid molecule that encodes a putative maize or soybean ribose-5-phosphate isomerase enzyme or fragment thereof, a nucleic acid molecule that encodes a maize or soybean ribose-5-phosphate kinase enzyme or fragment thereof, a nucleic acid molecule that encodes a maize or soybean phosphoenolpyruvate carboxylase enzyme or fragment thereof, a nucleic acid molecule that encodes a maize or soybean NADP-dependent malate dehydrogenase enzyme or fragment thereof, a nucleic acid molecule that encodes a maize or soybean aspartate aminotransferase enzyme or fragment thereof, a nucleic acid molecule that encodes a putative maize or soybean aspartate aminotransferase enzyme or fragment thereof, a nucleic acid molecule that encodes a maize or soybean alanine aminotransferase enzyme or fragment thereof, a nucleic acid molecule that encodes a maize or soybean NADP-dependent malic enzyme or fragment thereof, a nucleic acid molecule that encodes a maize or soybean NAD-dependent malic enzyme or fragment thereof, a nucleic acid molecule that encodes a maize or soybean PEP carboxykinase enzyme or fragment thereof, a nucleic acid molecule that encodes a putative soybean PEP carboxykinase enzyme or fragment thereof, a nucleic acid molecule that encodes a maize or soybean pyruvate, phosphate dikinase enzyme or fragment thereof and a nucleic acid molecule that encodes a maize or soybean pyrophosphatase enzyme or fragment thereof; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the plant carbon assimilation pathway enzyme; and (B) growing the transformed plant.

The present invention also provides a method of producing a plant containing reduced levels of a plant carbon assimilation pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 7341; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant carbon assimilation pathway enzyme; and (B) growing the transformed plant.

The present invention also provides a method of producing a plant containing reduced levels of a plant carbon assimilation pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of a nucleic acid molecule that encodes a maize or soybean ribulose-bisphosphate carboxylase enzyme or fragment thereof, a nucleic acid molecule that encodes a maize or soybean phosphoglycerate kinase enzyme or fragment thereof, a nucleic acid molecule that encodes a maize or soybean glyceraldehyde 3-phosphate dehydrogenase enzyme or fragment thereof, a nucleic acid molecule that encodes a putative maize glyceraldehyde 3-phosphate dehydrogenase enzyme or fragment thereof, a nucleic acid molecule that encodes a maize or soybean triose phosphate isomerase enzyme or fragment thereof, a nucleic acid molecule that encodes a maize or soybean aldolase enzyme or fragment thereof, a nucleic acid molecule that encodes a maize or soybean fructose-1,6-bisphosphatase enzyme or fragment thereof, a nucleic acid molecule that encodes a maize or soybean transketolase enzyme or fragment thereof, a nucleic acid molecule that encodes a putative maize or soybean transketolase enzyme or fragment thereof, a nucleic acid molecule that encodes a maize or soybean sedoheptulose-1,7-bisphosphatase enzyme or fragment thereof, a nucleic acid molecule that encodes a maize or soybean D-ribulose-5-phosphate-3-epimerase enzyme or fragment thereof, a nucleic acid molecule that encodes a maize or soybean ribose-5-phosphate isomerase enzyme or fragment thereof, a nucleic acid molecule that encodes a putative maize or soybean ribose-5-phosphate isomerase enzyme or fragment thereof, a nucleic acid molecule that encodes a maize or soybean ribose-5-phosphate kinase enzyme or fragment thereof, a nucleic acid molecule that encodes a maize or soybean phosphoenolpyruvate carboxylase enzyme or fragment thereof, a nucleic acid molecule that encodes a maize or soybean NADP-dependent malate dehydrogenase enzyme or fragment thereof, a nucleic acid molecule that encodes a maize or soybean aspartate aminotransferase enzyme or fragment thereof, a nucleic acid molecule that encodes a putative maize or soybean aspartate aminotransferase enzyme or fragment thereof, a nucleic acid molecule that encodes a maize or soybean alanine aminotransferase enzyme or fragment thereof, a nucleic acid molecule that encodes a maize or soybean NADP-dependent malic enzyme or fragment thereof, a nucleic acid molecule that encodes a maize or soybean NAD-dependent malic enzyme or fragment thereof, a nucleic acid molecule that encodes a maize or soybean PEP carboxykinase enzyme or fragment thereof, a nucleic acid molecule that encodes a putative soybean PEP carboxykinase enzyme or fragment thereof, a nucleic acid molecule that encodes a maize or soybean pyruvate, phosphate dikinase enzyme or fragment thereof and a nucleic acid molecule that encodes a maize or soybean pyrophosphatase enzyme or fragment thereof wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant carbon assimilation pathway enzyme; and (B) growing the transformed plant.

The present invention also provides a method for reducing expression of a plant carbon assimilation pathway enzyme in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein the transcribed strand is complementary to a nucleic acid molecule having a nucleic acid sequence selected from the group consisting of SEQ ID NO: 1 through SEQ ID NO: 7341 or complements thereof or fragments of either and the transcribed strand is complementary to an endogenous mRNA molecule; and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method for reducing expression of a plant carbon assimilation pathway enzyme in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein a transcribed mRNA of the transcribed strand is complementary to a nucleic acid molecule selected from the group consisting of an endogenous mRNA molecule that encodes a maize or soybean ribulose-bisphosphate carboxylase enzyme or fragment thereof, an endogenous mRNA molecule that encodes a maize or soybean phosphoglycerate kinase enzyme or fragment thereof, an endogenous mRNA molecule that encodes a maize or soybean glyceraldehyde 3-phosphate dehydrogenase enzyme or fragment thereof, an endogenous mRNA molecule that encodes a putative maize glyceraldehyde 3-phosphate dehydrogenase enzyme or fragment thereof an endogenous mRNA molecule that encodes a maize or soybean triose phosphate isomerase enzyme or fragment thereof, an endogenous mRNA molecule that encodes a maize or soybean aldolase enzyme or fragment thereof, an endogenous mRNA molecule that encodes a maize or soybean fructose-1,6-bisphosphatase enzyme or fragment thereof, an endogenous mRNA molecule that encodes a maize or soybean transketolase enzyme or fragment thereof, an endogenous mRNA molecule that encodes a putative maize or soybean transketolase enzyme or fragment thereof, an endogenous mRNA molecule that encodes a maize or soybean sedoheptulose-1,7-bisphosphatase enzyme or fragment thereof, an endogenous mRNA molecule that encodes a maize or soybean D-ribulose-5-phosphate-3-epimerase enzyme or fragment thereof, an endogenous mRNA molecule that encodes a maize or soybean ribose-5-phosphate isomerase enzyme or fragment thereof, an endogenous mRNA molecule that encodes a putative maize or soybean ribose-5-phosphate isomerase enzyme or fragment thereof, an endogenous mRNA molecule that encodes a maize or soybean ribose-5-phosphate kinase enzyme or fragment thereof, an endogenous mRNA molecule that encodes a maize or soybean phosphoenolpyruvate carboxylase enzyme or fragment thereof, an endogenous mRNA molecule that encodes a maize or soybean NADP-dependent malate dehydrogenase enzyme or fragment thereof, an endogenous mRNA molecule that encodes a maize or soybean aspartate aminotransferase enzyme or fragment thereof, an endogenous mRNA molecule that encodes a putative maize or soybean aspartate aminotransferase enzyme or fragment thereof, an endogenous mRNA molecule that encodes a maize or soybean alanine aminotransferase enzyme or fragment thereof, an endogenous mRNA molecule that encodes a maize or soybean NADP-dependent malic enzyme or fragment thereof, an endogenous mRNA molecule that encodes a maize or soybean NAD-dependent malic enzyme or fragment thereof, an endogenous mRNA molecule that encodes a maize or soybean PEP carboxykinase enzyme or fragment thereof, an endogenous mRNA molecule that encodes a putative soybean PEP carboxykinase enzyme or fragment thereof, an endogenous mRNA molecule that encodes a maize or soybean pyruvate, phosphate dikinase enzyme or fragment thereof and an endogenous mRNA molecule that encodes a maize or soybean pyrophosphatase enzyme or fragment thereof, and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method of determining an association between a polymorphism and a plant trait comprising: (A) hybridizing a nucleic acid molecule specific for the polymorphism to genetic material of a plant, wherein the nucleic acid molecule has a nucleic acid sequence selected from the group consisting of SEQ ID NO: 1 through SEQ ID NO: 7341 or complements thereof or fragment of either; and (B) calculating the degree of association between the polymorphism and the plant trait.

The present invention also provides a method of determining an association between a polymorphism and a plant trait comprising: (A) hybridizing a nucleic acid molecule specific for the polymorphism to genetic material of a plant, wherein the nucleic acid molecule is selected from the group consisting of a nucleic acid molecule that encodes a maize or soybean ribulose-bisphosphate carboxylase enzyme or complement thereof or fragment of either, a nucleic acid molecule that encodes a maize or soybean phosphoglycerate kinase enzyme or complement thereof or fragment of either, a nucleic acid molecule that encodes a maize or soybean glyceraldehyde 3-phosphate dehydrogenase enzyme or complement thereof or fragment of either, a nucleic acid molecule that encodes a putative maize glyceraldehyde 3-phosphate dehydrogenase enzyme or complement thereof or fragment of either, a nucleic acid molecule that encodes a maize or soybean triose phosphate isomerase enzyme or complement thereof or fragment of either, a nucleic acid molecule that encodes a maize or soybean aldolase enzyme or complement thereof or fragment of either, a nucleic acid molecule that encodes a maize or soybean fructose-1,6-bisphosphatase enzyme or complement thereof or fragment of either, a nucleic acid molecule that encodes a maize or soybean transketolase enzyme or complement thereof or fragment of either, a nucleic acid molecule that encodes a putative maize or soybean transketolase enzyme or complement thereof or fragment of either, a nucleic acid molecule that encodes a maize or soybean sedoheptulose-1,7-bisphophatase enzyme or complement thereof or fragment of either, a nucleic acid molecule that encodes a maize or soybean D-ribulose-5-phosphate-3-epimerase enzyme or complement thereof or fragment of either, a nucleic acid molecule that encodes a maize or soybean ribose-5-phosphate isomerase enzyme or complement thereof or fragment of either, a nucleic acid molecule that encodes a putative maize or soybean ribose-5-phosphate isomerase enzyme or complement thereof or fragment of either, a nucleic acid molecule that encodes a maize or soybean ribose-5-phosphate kinase enzyme or complement thereof or fragment of either, a nucleic acid molecule that encodes a maize or soybean phosphoenolpyruvate carboxylase enzyme or complement thereof or fragment of either, a nucleic acid molecule that encodes a maize or soybean NADP-dependent malate dehydrogenase enzyme or complement thereof or fragment of either, a nucleic acid molecule that encodes a maize or soybean aspartate aminotransferase enzyme or complement thereof or fragment of either, a nucleic acid molecule that encodes a putative maize or soybean aspartate aminotransferase enzyme or complement thereof or fragment of either, a nucleic acid molecule that encodes a maize or soybean alanine aminotransferase enzyme or complement thereof or fragment of either, a nucleic acid molecule that encodes a maize or soybean NADP-dependent malic enzyme or complement thereof or fragment of either, a nucleic acid molecule that encodes a maize or soybean NAD-dependent malic enzyme or complement thereof or fragment of either, a nucleic acid molecule that encodes a maize or soybean PEP carboxykinase enzyme or complement thereof or fragment of either, a nucleic acid molecule that encodes a putative soybean PEP carboxykinase enzyme or complement thereof or fragment of either, a nucleic acid molecule that encodes a maize or soybean pyruvate, phosphate dikinase enzyme or complement thereof or fragment of either and a nucleic acid molecule that encodes a maize or soybean pyrophosphatase enzyme or complement thereof or fragment of either; and (B) calculating the degree of association between the polymorphism and the plant trait.

The present invention also provides a method of isolating a nucleic acid that encodes a plant carbon assimilation pathway enzyme or fragment thereof comprising: (A) incubating under conditions permitting nucleic acid hybridization, a first nucleic acid molecule comprising a nucleic acid sequence selected from the group consisting of SEQ ID NO: 1 through SEQ ID NO: 7341 or complements thereof or fragment of either with a complementary second nucleic acid molecule obtained from a plant cell or plant tissue; (B) permitting hybridization between the first nucleic acid molecule and the second nucleic acid molecule obtained from the plant cell or plant tissue; and (C) isolating the second nucleic acid molecule.

The present invention also provides a method of isolating a nucleic acid molecule that encodes a plant carbon assimilation pathway enzyme or fragment thereof comprising: (A) incubating under conditions permitting nucleic acid hybridization, a first nucleic acid molecule selected from the group consisting of a nucleic acid molecule that encodes a maize or soybean ribulose-bisphosphate carboxylase enzyme or complement thereof or fragment of either, a nucleic acid molecule that encodes a maize or soybean phosphoglycerate kinase enzyme or complement thereof or fragment of either, a nucleic acid molecule that encodes a maize or soybean glyceraldehyde 3-phosphate dehydrogenase enzyme or complement thereof or fragment of either, a nucleic acid molecule that encodes a putative maize glyceraldehyde 3-phosphate dehydrogenase enzyme or complement thereof or fragment of either, a nucleic acid molecule that encodes a maize or soybean triose phosphate isomerase enzyme or complement thereof or fragment of either, a nucleic acid molecule that encodes a maize or soybean aldolase enzyme or complement thereof or fragment of either, a nucleic acid molecule that encodes a maize or soybean fructose-1,6-bisphosphatase enzyme or complement thereof or fragment of either, a nucleic acid molecule that encodes a maize or soybean transketolase enzyme or complement thereof or fragment of either, a nucleic acid molecule that encodes a putative maize or soybean transketolase enzyme or complement thereof or fragment of either a nucleic acid molecule that encodes a maize or soybean sedoheptulose-1,7-bisphophatase enzyme or complement thereof or fragment of either, a nucleic acid molecule that encodes a maize or soybean D-ribulose-5-phosphate-3-epimerase enzyme or complement thereof or fragment of either, a nucleic acid molecule that encodes a maize or soybean ribose-5-phosphate isomerase enzyme or complement thereof or fragment of either, a nucleic acid molecule that encodes a putative maize or soybean ribose-5-phosphate isomerase enzyme or complement thereof or fragment of either, a nucleic acid molecule that encodes a maize or soybean ribose-5-phosphate kinase enzyme or complement thereof or fragment of either, a nucleic acid molecule that encodes a maize or soybean phosphoenolpyruvate carboxylase enzyme or complement thereof or fragment of either, a nucleic acid molecule that encodes a maize or soybean NADP-dependent malate dehydrogenase enzyme or complement thereof or fragment of either, a nucleic acid molecule that encodes a maize or soybean aspartate aminotransferase enzyme or complement thereof or fragment of either, a nucleic acid molecule that encodes a putative maize or soybean aspartate aminotransferase enzyme or complement thereof or fragment of either, a nucleic acid molecule that encodes a maize or soybean alanine aminotransferase enzyme or complement thereof or fragment of either, a nucleic acid molecule that encodes a maize or soybean NADP-dependent malic enzyme or complement thereof or fragment of either, a nucleic acid molecule that encodes a maize or soybean NAD-dependent malic enzyme or complement thereof or fragment of either, a nucleic acid molecule that encodes a maize or soybean PEP carboxykinase enzyme or complement thereof or fragment of either, a nucleic acid molecule that encodes a putative soybean PEP carboxykinase enzyme or complement thereof or fragment of either, a nucleic acid molecule that encodes a maize or soybean pyruvate, phosphate dikinase enzyme or complement thereof or fragment of either and a nucleic acid molecule that encodes a maize or soybean pyrophosphatase enzyme or complement thereof or fragment of either; with a complementary second nucleic acid molecule obtained from a plant cell or plant tissue; (B) permitting hybridization between the plant carbon assimilation pathway enzyme nucleic acid molecule and the complementary nucleic acid molecule obtained from the plant cell or plant tissue; and (C) isolating the second nucleic acid molecule.

DETAILED DESCRIPTION OF THE INVENTION

Agents of the Present Invention

Agents
(a) Nucleic Acid Molecules

Agents of the present invention include plant nucleic acid molecules and more preferably include maize and soybean nucleic acid molecules and more preferably include nucleic acid molecules of the maize genotypes B73 (Illinois Foundation Seeds, Champaign, Ill. U.S.A.), B73xMo17 (Illinois Foundation Seeds, Champaign, Ill. U.S.A.), DK604 (Dekalb Genetics, Dekalb, Ill. U.S.A.), H99 (Illinois Foundation Seeds, Champaign, Ill. U.S.A.), RX601 (Asgrow Seed Company, Des Moines, Iowa), Mo17 (Illinois Foundation Seeds, Champaign, Ill. U.S.A.), and soybean types Asgrow 3244 (Asgrow Seed Company, Des Moines, Iowa), C1944 (United States Department of Agriculture (USDA) Soybean Germplasm Collection, Urbana, Ill. U.S.A.), Cristalina (USDA Soybean Germplasm Collection, Urbana, Ill. U.S.A.), FT108 (Monsoy, Brazil), Hartwig (USDA Soybean Germplasm Collection, Urbana, Ill. U.S.A.), BW211S Null (Tohoku University, Morioka, Japan), PI507354 (USDA Soybean Germplasm Collection, Urbana, Ill. U.S.A.), Asgrow A4922 (Asgrow Seed Company, Des Moines, Iowa U.S.A.), PI227687 (USDA Soybean Germplasm Collection, Urbana, Ill. U.S.A.), PI229358 (USDA Soybean Germplasm Collection, Urbana, Ill. U.S.A.) and Asgrow A3237 (Asgrow Seed Company, Des Moines, Iowa U.S.A.).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

Fragment nucleic acid molecules may encode significant portion(s) of, or indeed most of, these nucleic acid molecules. Alternatively, the fragments may comprise smaller oligonucleotides (having from about 15 to about 250 nucleotide residues and more preferably, about 15 to about 30 nucleotide residues).

As used herein, an agent, be it a naturally occurring molecule or otherwise may be "substantially purified," if desired, such that one or more molecules that is or may be present in a naturally occurring preparation containing that molecule will have been removed or will be present at a lower concentration than that at which it would normally be found.

The agents of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

It is understood that the agents of the present invention may be labeled with reagents that facilitate detection of the agent (e.g. fluorescent labels, Prober et al, *Science* 238:336-340 (1987); Albarella et al, EP 144914; chemical labels, Sheldon et al., U.S. Pat. No. 4,582,789; Albarella et al., U.S. Pat. No. 4,563,417; modified bases, Miyoshi et al., EP 119448, all of which are hereby incorporated by reference in their entirety).

It is further understood, that the present invention provides recombinant bacterial, mammalian, microbial, insect, fungal and plant cells and viral constructs comprising the agents of the present invention. (See, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells)

Nucleic acid molecules or fragments thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Molecular Cloning*, A Laboratory Manual, 2nd Ed., Cold Spring Harbor Press, Cold Spring Harbor, N.Y. (1989) and by Haymes et al., *Nucleic Acid Hybridization, A Practical*

*Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2× SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 7341 or complements thereof under moderately stringent conditions, for example at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO: 1 through SEQ ID NO: 7341 or complements thereof under high stringency conditions such as 0.2×SSC and about 65° C.

In one aspect of the present invention, the nucleic acid molecules of the present invention have one or more of the nucleic acid sequences set forth in SEQ ID NO: 1 through SEQ ID NO: 7341 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO: 7341 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO: 7341 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO: 7341 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO: 7341 or complements thereof.

In a further more preferred aspect of the present invention, one or more of the nucleic acid molecules of the present invention exhibit 100% sequence identity with a nucleic acid molecule present within MONN01, SATMON001, SAT-MON003 through SATMON014, SATMON016, SAT-MON017, SATMON019 through SATMON031, SAT-MON033, SATMON034, SATMON-001, SATMONN01, SATMONN04 through SATMONN06, CMz029 through CMz031, CMz033 through CMz037, CMz039 through CMz042, CMz044 through CMz045, CMz047 through CMz050, SOYMON001 through SOYMON038, Soy51 through Soy56, Soy58 through Soy62, Soy65 through Soy71, Soy 73 and Soy76 through Soy77 (Monsanto Company, St. Louis, Mo. U.S.A.).

(i) Nucleic Acid Molecules Encoding Proteins or Fragments Thereof

Nucleic acid molecules of the present invention can comprise sequences that encode a carbon assimilation pathway enzyme or fragment thereof. Such carbon assimilation pathway enzymes or fragments thereof include homologues of known carbon assimilation pathway enzymes in other organisms.

In a preferred embodiment of the present invention, a maize or soybean carbon assimilation pathway enzyme or fragment thereof of the present invention is a homologue of another plant carbon assimilation pathway enzyme. In another preferred embodiment of the present invention, a maize or soybean carbon assimilation pathway enzyme or fragment thereof of the present invention is a homologue of a fungal carbon assimilation pathway enzyme. In another preferred embodiment of the present invention, a maize or soybean carbon assimilation pathway enzyme or fragment thereof of the present invention is a homologue of a bacterial carbon assimilation pathway enzyme. In another preferred embodiment of the present invention, a soybean carbon assimilation pathway enzyme or fragment thereof of the present invention is a homologue of a maize carbon assimilation pathway enzyme. In another preferred embodiment of the present invention, a maize carbon assimilation pathway enzyme homologue or fragment thereof of the present invention is a homologue of a soybean carbon assimilation pathway enzyme. In another preferred embodiment of the present invention, a maize or soybean carbon assimilation pathway enzyme homologue or fragment thereof of the present invention is a homologue of an *Arabidopsis thaliana* carbon assimilation pathway enzyme.

In a preferred embodiment of the present invention, the nucleic molecule of the present invention encodes a maize or soybean carbon assimilation pathway enzyme or fragment thereof where a maize or soybean carbon assimilation pathway enzyme exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a maize or soybean carbon assimilation pathway enzyme or fragment thereof exhibits a % identity with its homologue of between about 25% and about 40%, more preferably of between about 40 and about 70%, even more preferably of between about 70% and about 90% and even more preferably between about 90% and 99%. In another preferred embodiment, of the present invention, a maize or soybean carbon assimilation pathway enzyme or fragments thereof exhibits a % identity with its homologue of 100%.

In a preferred embodiment of the present invention, the nucleic molecule of the present invention encodes a maize or soybean carbon assimilation pathway enzyme or fragment thereof where a maize or soybean carbon assimilation pathway enzyme exhibits a BLAST score of greater than 120, preferably a BLAST score of between about 1450 and about 120, even more preferably a BLAST score of greater than 1450 with its homologue.

Nucleic acid molecules of the present invention also include non-maize, non-soybean homologues. Preferred non-maize, non-soybean homologues are selected from the group consisting of alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm and *Phaseolus*.

In a preferred embodiment, nucleic acid molecules having SEQ ID NO: 1 through SEQ ID NO: 7341 or complements and fragments of either can be utilized to obtain such homologues.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding a maize or soybean carbon assimilation pathway enzyme or fragment thereof in SEQ ID NO: 1 through SEQ ID NO: 7341 due to the degeneracy in the genetic code in that they encode the same carbon assimilation pathway enzyme but differ in nucleic acid sequence.

In another further aspect of the present invention, one or more of the nucleic acid molecules of the present invention differ in nucleic acid sequence from those encoding a maize or soybean carbon assimilation pathway enzyme or fragment thereof in SEQ ID NO: 1 through SEQ ID NO: 7341 due to fact that the different nucleic acid sequence encodes a carbon assimilation pathway enzyme having one or more conservative amino acid residue. Examples of conservative substitutions are set forth in Table 1. It is understood that codons capable of coding for such conservative substitutions are known in the art.

TABLE 1

| Original Residue | Conservative Substitutions |
| --- | --- |
| Ala | Ser |
| Arg | Lys |
| Asn | Gln; His |
| Asp | Glu |
| Cys | Ser; Ala |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

In a further aspect of the present invention, one or more of the nucleic acid molecules of the present invention differ in nucleic acid sequence from those encoding a maize or soybean carbon assimilation pathway enzyme or fragment thereof set forth in SEQ ID NO: 1 through SEQ ID NO: 7341 or fragment thereof due to the fact that one or more codons encoding an amino acid has been substituted for a codon that encodes a nonessential substitution of the amino acid originally encoded.

Agents of the present invention include nucleic acid molecules that encode a maize or soybean carbon assimilation pathway enzyme or fragment thereof and particularly substantially purified nucleic acid molecules selected from the group consisting of a nucleic acid molecule that encodes a maize or soybean ribulose-bisphosphate carboxylase enzyme or fragment thereof, a nucleic acid molecule that encodes a maize or soybean phosphoglycerate kinase enzyme or fragment thereof, a nucleic acid molecule that encodes a maize or soybean glyceraldehyde 3-phosphate dehydrogenase enzyme or fragment thereof, a nucleic acid molecule that encodes a putative maize glyceraldehyde 3-phosphate dehydrogenase enzyme or fragment thereof, a nucleic acid molecule that encodes a maize or soybean triose phosphate isomerase enzyme or fragment thereof, a nucleic acid molecule that encodes a maize or soybean aldolase enzyme or fragment thereof, a nucleic acid molecule that encodes a maize or soybean fructose-1,6-bisphosphatase enzyme or fragment thereof, a nucleic acid molecule that encodes a maize or soybean transketolase enzyme or fragment thereof, a nucleic acid molecule that encodes a putative maize or soybean transketolase enzyme or fragment thereof, a nucleic acid molecule that encodes a maize or soybean sedoheptulose-1,7-bisphosphatase enzyme or fragment thereof, a nucleic acid molecule that encodes a maize or soybean D-ribulose-5-phosphate-3-epimerase enzyme or fragment thereof, a nucleic acid molecule that encodes a maize or soybean ribose-5-phosphate isomerase enzyme or fragment thereof, a nucleic acid molecule that encodes a putative maize or soybean ribose-5-phosphate isomerase enzyme or fragment thereof, a nucleic acid molecule that encodes a maize or soybean ribose-5-phosphate kinase enzyme or fragment thereof, a nucleic acid molecule that encodes a maize or soybean phosphoenolpyruvate carboxylase enzyme or fragment thereof, a nucleic acid molecule that encodes a maize or soybean NADP-dependent malate dehydrogenase enzyme or fragment thereof, a nucleic acid molecule that encodes a maize or soybean aspartate aminotransferase enzyme or fragment thereof, a nucleic acid molecule that encodes a putative maize or soybean aspartate aminotransferase enzyme or fragment thereof, a nucleic acid molecule that encodes a maize or soybean alanine aminotrasferase enzyme or fragment thereof, a nucleic acid molecule that encodes a maize or soybean NADP-dependent malic enzyme or fragment thereof, a nucleic acid molecule that encodes a maize or soybean NAD-dependent malic enzyme or fragment thereof, a nucleic acid molecule that encodes a maize or soybean PEP carboxykinase enzyme or fragment thereof, a nucleic acid molecule that encodes a putative soybean PEP carboxykinase enzyme or fragment thereof, a nucleic acid molecule that encodes a maize or soybean pyruvate, phosphate dikinase enzyme or fragment thereof and a nucleic acid molecule that encodes a maize or soybean pyrophopatase enzyme or fragment thereof.

Non-limiting examples of such nucleic acid molecules of the present invention are nucleic acid molecules comprising: SEQ ID NO: 1 through SEQ ID NO: 7341 or fragment thereof that encode for a plant carbon assimilation pathway enzyme or fragment thereof, SEQ ID NO: 1 through SEQ ID NO: 281 and SEQ ID NO: 282 through SEQ ID NO: 847 or fragment thereof that encode for a ribulose-bisphosphate carboxylase enzyme or fragment thereof, SEQ ID NO: 848 through SEQ ID NO: 1090 and SEQ ID NO: 1091 through SEQ ID NO: 1307 or fragment thereof that encode for a phosphoglycerate kinase enzyme or fragment thereof, SEQ ID NO: 1308 through SEQ ID NO: 2383 and SEQ ID NO: 2397 through SEQ ID NO: 3450 or fragment thereof that encodes for a glyceraldehyde 3-phosphate dehydrogenase enzyme or fragment thereof, SEQ ID NO: 2384 through SEQ ID NO: 2396 or fragment thereof that encodes for a putative glyceraldehyde 3-phosphate dehydrogenase enzyme or fragment thereof, SEQ ID NO: 3541 through SEQ ID NO: 3746 and SEQ ID NO: 3747 through SEQ ID NO: 3918 or fragment thereof that encode for a triose phosphate isomerase enzyme or fragment thereof, SEQ ID NO: 3919 through SEQ ID NO: 3963 and SEQ ID NO: 3964 through SEQ ID NO: 4370 or fragment thereof that encode for an aldolase enzyme or fragment thereof, SEQ ID NO: 4371 through SEQ ID NO: 4421 and SEQ ID NO: 4422 through SEQ ID NO: 4475 or fragment thereof that encode for a fructose-1,6-bisphosphatase enzyme or fragment thereof, SEQ ID NO: 4476 through SEQ ID NO: 4513 and SEQ ID NO: 4525 through SEQ ID NO: 4605 or fragment thereof that encode for a transketolase enzyme or fragment thereof, SEQ ID NO: 4514 through SEQ ID NO: 4524 and SEQ ID NO: 4606 through SEQ ID NO: 4612 or fragment thereof that encode for a putative transketolase enzyme or fragment thereof, SEQ ID NO: 4613 through SEQ ID NO: 4614 and SEQ ID NO: 4615 through SEQ ID NO: 4677 or fragment thereof that encode for a sedoheptulose-1,7-bisphosphatase enzyme or fragment thereof, SEQ ID NO: 4678 through SEQ ID NO: 4723 and SEQ ID NO: 4724 through SEQ ID NO: 4762 or fragment thereof that encode for a ribulose-5-phosphate-3-epimerase enzyme or fragment thereof, SEQ ID NO: 4763 through SEQ ID NO: 4769 and SEQ ID NO: 4772 through SEQ ID NO: 4776 or fragment thereof that encodes for a D-ribose-5-phosphate isomerase enzyme or fragment thereof, SEQ ID NO: 4770 through SEQ ID NO: 4771 and SEQ ID NO: 4777 through SEQ ID NO: 4781 or fragment thereof that encodes for a putative ribose-5-phosphate isomerase enzyme or fragment thereof, SEQ ID NO: 4782 through SEQ ID NO: 4832 and SEQ ID NO: 4833 through SEQ ID NO: 4908 or fragment thereof that encode for a ribose-5-phosphate kinase enzyme or fragment thereof, SEQ ID NO: 4909 through SEQ ID NO: 5282 and SEQ ID NO: 5283 through SEQ ID NO: 5371 or fragment thereof that encode for a phosphoenolpyruvate carboxylase enzyme or fragment thereof, SEQ ID NO: 5372 through SEQ ID NO: 5419 and SEQ ID NO: 5420 through SEQ ID NO: 5423 or fragment thereof that encode for a NADP-dependent malate dehydrogenase enzyme or fragment thereof, SEQ ID NO: 5424 through SEQ ID NO: 5596 and SEQ ID NO: 5601 through SEQ ID NO: 5719 or fragment thereof that encode for an asparate aminotransferase enzyme or fragment thereof, SEQ ID NO: 5597 through SEQ ID NO: 5600 and SEQ ID NO: 5720 through SEQ ID NO: 5727 or fragment thereof that encode for a putative asparate aminotransferase enzyme or fragment thereof, SEQ ID NO: 5728 through SEQ ID NO: 5888 and SEQ ID NO: 5889 through SEQ ID NO: 6004 or fragment thereof that encode for an alanine aminotransferase enzyme or fragment thereof, SEQ ID NO: 6005 through SEQ ID NO: 6223 and SEQ ID NO: 6224 through SEQ ID NO: 6287 or fragment thereof that encode for a NADP-dependent malic enzyme or fragment thereof, SEQ ID NO: 6022 through SEQ ID NO: 6023, SEQ ID NO: 6288 through SEQ ID NO: 6290 and SEQ ID NO: 6291 through SEQ ID NO: 6293 or fragment thereof that encodes for a NAD-dependent malic enzyme or fragment thereof, SEQ ID NO: 6294 through SEQ ID NO: 6353 and SEQ ID NO: 6354 through SEQ ID NO: 6387 or fragment thereof that encode for a PEP carboxykinase enzyme or fragment thereof, SEQ ID NO: 6388 or fragment thereof that encode for a putative PEP carboxykinase enzyme or fragment thereof, SEQ ID NO: 6389 through SEQ ID NO: 6847 and SEQ ID NO: 6848 through SEQ ID NO: 6850 or fragment thereof that encode for a pyruvate, phosphate dikinase enzyme or fragment thereof, and SEQ ID NO: 6851 through SEQ ID NO: 7154 and SEQ ID NO: 7155 through SEQ ID NO: 7341 or fragment thereof that encode for a pyrophosphatase enzyme or fragment thereof.

A nucleic acid molecule of the present invention can also encode an homologue of a maize or soybean ribulose-bisphosphate carboxylase enzyme or fragment thereof, a maize or soybean phosphoglycerate kinase enzyme or fragment thereof, a maize or soybean glyceraldehyde 3-phosphate dehydrogenase enzyme or fragment thereof, a putative maize or soybean glyceraldehyde 3-phosphate dehydrogenase enzyme or fragment thereof, a maize or soybean triose phosphate isomerase enzyme or fragment thereof, a maize or soybean aldolase enzyme or fragment thereof, a maize or soybean fructose-1,6-bisphosphatase enzyme or fragment thereof, a maize or soybean transketolase enzyme or fragment thereof, a putative maize or soybean transketolase enzyme or fragment thereof, a maize or soybean sedoheptulose-1,7-bisphosphatase enzyme or fragment thereof, a maize or soybean D-ribulose-5-phosphate-3-epimerase enzyme or fragment thereof, a maize or soybean ribose-5-phosphate isomerase enzyme or fragment thereof, a putative maize or soybean ribose-5-phosphate isomerase enzyme or fragment thereof, a maize or soybean ribose-5-phosphate kinase enzyme or fragment thereof, a maize or soybean phosphoenolpyruvate carboxylase enzyme or fragment thereof, a maize or soybean NADP-dependent malate dehydrogenase enzyme or fragment thereof, a maize or soybean aspartate aminotransferase enzyme or fragment thereof, a putative maize or soybean aspartate aminotransferase enzyme or fragment thereof, a maize or soybean alanine aminotransferase enzyme or fragment thereof, a maize or soybean NADP-dependent malic enzyme or fragment thereof, a maize or soybean NAD-dependent malic enzyme or fragment thereof, a maize or soybean PEP carboxykinase enzyme or fragment thereof, a putative maize or soybean PEP carboxykinase enzyme or fragment thereof, a maize or soybean pyruvate, phosphate dikinase enzyme or fragment thereof or a maize soybean pyrophosphatase enzyme or fragment thereof. As used herein a homologue protein molecule or fragment thereof is a counterpart protein molecule or fragment thereof in a second species (e.g., maize ribulose-bisphosphate carboxylase is a homologue of *Arabidopsis* ribulose-bisphosphate carboxylase).

(ii) Nucleic Acid Molecule Markers and Probes

One aspect of the present invention concerns markers that include nucleic acid molecules SEQ ID NO: 1 through SEQ ID NO: 7341 or complements thereof or fragments of either that can act as markers or other nucleic acid molecules of the present invention that can act as markers. Genetic markers of the present invention include "dominant" or "codominant" markers "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformly throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a results of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al., *Nature* 313:495-498 (1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad. Sci.* (*U.S.A.*) 86:2757-2760 (1989), the entirety of which is herein incorporated by reference), ligase chain reaction (Barany, *Proc. Natl. Acad. Sci.* (*U.S.A.*) 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TaqMan assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smirnov, *Genome Res.* 7:378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits,* 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure to with another nucleic acid. Various methods for determining the structure of PCR probes and PCR techniques exist in the art. Computer generated searches using programs such as Primer3 (www-genome.wi.mit.edu/cgi-bin/primer/primer3.cgi), STSPipeline (www-genome.wi.mit.edu/cgi-bin/www-STS_Pipeline), or GeneUp (Pesole et al., *BioTechniques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or fragments thereof or peptide molecules encoded by SEQ ID NO: 1 through SEQ ID NO: 7341 or one or more of the protein or fragment thereof and peptide molecules encoded by other nucleic acid agents of the present invention. As used herein, the term "protein molecule" or "peptide molecule" includes any molecule that comprises five or more amino acids. It is well known in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine and homoserine.

Non-limiting examples of the protein or fragment thereof of the present invention include a maize or soybean carbon assimilation pathway enzyme or fragment thereof; a maize or soybean ribulose-bisphosphate carboxylase enzyme or fragment thereof, a maize or soybean phosphoglycerate kinase enzyme or fragment thereof, a maize or soybean glyceraldehyde 3-phosphate dehydrogenase enzyme or fragment thereof, a putative maize glyceraldehyde 3-phosphate dehydrogenase enzyme or fragment thereof, a maize or soybean triose phosphate isomerase enzyme or fragment thereof, a maize or soybean aldolase enzyme or fragment thereof, a maize or soybean fructose-1,6-bisphosphatase enzyme or fragment thereof, a maize or soybean transketolase enzyme or fragment thereof, a putative maize or soybean transketolase enzyme or fragment thereof, a maize or soybean sedoheptulose-1,7-bisphosphatase enzyme or fragment thereof, a maize or soybean D-ribulose-5-phosphate-3-epimerase enzyme or fragment thereof, a maize or soybean ribose-5-phosphate isomerase enzyme or fragment thereof, a putative maize or soybean ribose-5-phosphate isomerase enzyme or fragment thereof, a maize or soybean ribose-5-phosphate kinase enzyme or fragment thereof, a maize or soybean phosphoenolpyruvate carboxylase enzyme or fragment thereof, a maize or soybean NADP-dependent malate dehydrogenase enzyme or fragment thereof, a maize or soybean aspartate aminotransferase enzyme or fragment thereof, a maize or soybean alanine aminotransferase enzyme or fragment thereof, a maize or soybean NADP-dependent malic enzyme or fragment thereof, a maize or soybean NAD-dependent malic enzyme or fragment thereof, a maize or soybean PEP carboxykinase enzyme or fragment thereof, a putative soybean PEP carboxykinase enzyme or fragment thereof, a maize or soybean pyruvate, phosphate dikinase enzyme or fragment thereof, or a maize or soybean pyrophosphatase enzyme or fragment thereof.

Non-limiting examples of the protein or fragment molecules of the present invention are a carbon assimilation pathway enzyme or fragment thereof encoded by: SEQ ID NO: 1 through SEQ ID NO: 7341 or fragment thereof that encode for a carbon assimilation pathway enzyme or fragment thereof, SEQ ID NO: 1 through SEQ ID NO: 281 and SEQ ID NO: 282 through SEQ ID NO: 847 or fragment thereof that encode for a ribulose-bisphosphate carboxylase enzyme or fragment thereof, SEQ ID NO: 848 through SEQ ID NO: 1090 and SEQ ID NO: 1091 through SEQ ID NO: 1307 or fragment thereof that encode for a phosphoglycerate kinase enzyme or fragment thereof, SEQ ID NO: 1308 through SEQ ID NO: 2383 and SEQ ID NO: 2384 through SEQ ID NO: 3540 or fragment thereof that encodes for a glyceraldehyde 3-phosphate dehydrogenase enzyme or fragment thereof, SEQ ID NO: 2384 through SEQ ID NO: 2396 or fragment thereof that encodes for a putative glyceraldehyde 3-phosphate dehydrogenase enzyme or fragment thereof, SEQ ID NO: 3541 through SEQ ID NO: 3746 and SEQ ID NO: 3747 through SEQ ID NO: 3918 or fragment thereof that encode for a triose phosphate isomerase enzyme or fragment thereof, SEQ ID NO: 3919 through SEQ ID NO: 3963 and SEQ ID NO: 3964 through SEQ ID NO: 4370 or fragment thereof that encode for an aldolase enzyme or fragment thereof, SEQ ID NO: 4371 through SEQ ID NO: 4421 and SEQ ID NO: 4422 through SEQ ID NO: 4475 or fragment thereof that encode for a fructose-1,6-bisphosphatase enzyme or fragment thereof, SEQ ID NO: 4476 through SEQ ID NO: 4513 and SEQ ID NO: 4525 through SEQ ID NO: 4605 or fragment thereof that encode for a transketolase enzyme or fragment thereof, SEQ ID NO: 4514 through SEQ ID NO: 4524 and SEQ ID NO: 4606 through SEQ ID NO: 4612 or fragment thereof that encode for a putative transketolase enzyme or fragment thereof, SEQ ID NO: 4613 through SEQ ID NO: 4614 and SEQ ID NO: 4615 through SEQ ID NO: 4677 or fragment thereof that encode for a sedoheptulose-1,7-bisphosphatase enzyme or fragment thereof, SEQ ID NO: 4678 through SEQ ID NO: 4723 and SEQ ID NO: 4724 through SEQ ID NO: 4762 or fragment thereof that encode for a D-ribulose-5-phosphate-3-epimerase enzyme or fragment thereof, SEQ ID NO: 4763 through SEQ ID NO: 4769 and SEQ ID NO: 4772 through SEQ ID NO: 4776 or fragment thereof that encodes for a ribose-5-phosphate isomerase enzyme or fragment thereof, SEQ ID NO: 4770 through SEQ ID NO: 4771 and SEQ ID NO: 4777 through SEQ ID NO: 4781 or fragment thereof that encodes for a putative ribose-5-phosphate isomerase enzyme or fragment thereof, SEQ ID NO: 4782 through SEQ ID NO: 4832 and SEQ ID NO: 4833 through SEQ ID NO: 4908 or fragment thereof that encode for a ribose-5-phosphate kinase enzyme or fragment thereof, SEQ ID NO: 4909 through SEQ ID NO: 5282 and SEQ ID NO: 5283 through SEQ ID NO: 5371 or fragment thereof that encode for a phosphoenolpyruvate carboxylase enzyme or fragment thereof, SEQ ID NO: 5372 through SEQ ID NO: 5419 and SEQ ID NO: 5420 through SEQ ID NO: 5423 or fragment thereof that encode for a NADP-dependent malate dehydrogenase enzyme or fragment thereof, SEQ ID NO: 5424 through SEQ ID NO: 5596 and SEQ ID NO: 5601 through SEQ ID NO: 5719 or fragment thereof that encode for an asparate aminotransferase enzyme or fragment thereof, SEQ ID NO: 5597 through SEQ ID NO: 5600 and SEQ ID NO: 5720 through SEQ ID NO: 5727 or fragment thereof that encode for a putative asparate aminotransferase enzyme or fragment thereof, SEQ ID NO: 5728 through SEQ ID NO: 5888 and SEQ ID NO: 5889 through SEQ ID NO: 6004 or fragment thereof that encode for an alanine aminotransferase enzyme or fragment thereof, SEQ ID NO: 6005 through SEQ ID NO: 6223 and SEQ ID NO: 6224 through SEQ ID NO: 6287 or fragment thereof that encode for a NADP-dependent malic enzyme or fragment thereof, SEQ ID NO: 6022 through SEQ ID NO: 6023, SEQ ID NO: 6288 through SEQ ID NO: 6290 and SEQ ID NO: 6291 through SEQ ID NO: 6293 or fragment thereof that encodes for a NAD-dependent malic enzyme or fragment thereof, SEQ ID NO: 6294 through SEQ ID NO: 6353 and SEQ ID NO: 6354 through SEQ ID NO: 6387 or fragment thereof that encode for a PEP carboxykinase enzyme or fragment thereof, SEQ ID NO: 6388 or fragment thereof that encode for a putative PEP carboxykinase enzyme or fragment thereof, SEQ ID NO: 6389 through SEQ ID NO: 6847 and SEQ ID NO: 6848 through SEQ ID NO: 6850 or fragment thereof that encode for a pyruvate, phosphate dikinase enzyme or fragment thereof, and SEQ ID NO: 6851 through SEQ ID NO: 7154 and SEQ ID NO: 7155 through SEQ ID NO: 7341 or fragment thereof that encode for a pyrophosphatase enzyme or fragment thereof.

One or more of the protein or fragment of peptide molecules may be produced via chemical synthesis, or more preferably, by expressing in a suitable bacterial or eucaryotic host. Suitable methods for expression are described by Sambrook et al., (In: *Molecular Cloning, A Laboratory Manual, 2nd Edition*, Cold Spring Harbor Press, Cold Spring Harbor, N.Y. (1989)), or similar texts. For example, the protein may be expressed in, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecules of the present invention are preferably produced via recombinant means.

Another class of agents comprise protein or peptide molecules or fragments or fusions thereof encoded by SEQ ID NO: 1 through SEQ ID NO: 7341 or complements thereof in which conservative, non-essential or non-relevant amino acid residues have been added, replaced or deleted. Computerized means for designing modifications in protein structure are known in the art (Dahiyat and Mayo, *Science* 278:82-87 (1997), the entirety of which is herein incorporated by reference).

The protein molecules of the present invention include plant homologue proteins. An example of such a homologue is a homologue protein of a non-maize or non-soybean plant species, that include but not limited to alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm, *Phaseolus* etc. Particularly preferred non-maize or non-soybean for use for the isolation of homologs would include, *Arabidopsis*, barley, cotton, oat, oilseed rape, rice, canola, ornamentals, sugarcane, sugarbeet, tomato, potato, wheat and turf grasses. Such a homologue can be obtained by any of a variety of methods. Most preferably, as indicated above, one or more of the disclosed sequences (SEQ ID NO: 1 through SEQ ID NO: 7341 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal and may comprise intact immunoglobulins, or antigen binding portions of immunoglobulins fragments (such as (F(ab'), F(ab')$_2$), or single-chain immunoglobulins producible, for example, via recombinant means. It is understood that practitioners are familiar with the standard resource materials which describe specific conditions and procedures for the construction, manipulation and isolation of antibodies (see, for example, Harlow and Lane, In: *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 µg of purified protein (or fragment thereof) that has been emulsified in a suitable adjuvant (such as TiterMax adjuvant (Vaxcel, Norcross, Ga.)). Immunization is preferably conducted at two intramuscular sites, one intraperitoneal site and one subcutaneous site at the base of the tail. An additional i.v. injection of approximately 25 µg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 µg of the same protein or fragment. The splenic leukocytes from this animal may be recovered 3 days later and then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs"), preferably by direct ELISA.

In one embodiment, anti-protein or peptide monoclonal antibodies are isolated using a fusion of a protein or peptide of the present invention, or conjugate of a protein or peptide of the present invention, as immunogens. Thus, for example, a group of mice can be immunized using a fusion protein emulsified in Freund's complete adjuvant (e.g. approximately 50 µg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96 well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbor cells. Desirably, the fusion plates are screened several times since the rates of hybridoma growth vary. In a preferred sub-embodiment, a different antigenic form may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

Nucleic acid molecules and fragments thereof of the present invention may be employed to obtain other nucleic acid molecules from the same species (e.g., ESTs or fragment thereof from maize may be utilized to obtain other nucleic acid molecules from maize). Such nucleic acid molecules include the nucleic acid molecules that encode the complete coding sequence of a protein and promoters and flanking sequences of such molecules. In addition, such nucleic acid molecules include nucleic acid molecules that encode for other isozymes or gene family members. Such molecules can be readily obtained by using the above-described nucleic acid molecules or fragments thereof to screen cDNA or genomic libraries obtained from maize or soybean. Methods for forming such libraries are well known in the art.

Nucleic acid molecules and fragments thereof of the present invention may also be employed to obtain nucleic acid homologues. Such homologues include the nucleic acid molecule of other plants or other organisms (e.g., alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm, *Phaseolus*, etc.) including the nucleic acid molecules that encode, in whole or in part, protein homologues of other plant species or other organisms, sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO: 1 through SEQ ID NO: 7341 or complements thereof because complete complementarity is not needed for stable hybridization. The nucleic acid molecules of the present invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci.* (*U.S.A.*) 83:4143-4146 (1986), the entirety of which is herein incorporated by reference; Goodchild et al., *Proc. Natl. Acad. Sci.* (*U.S.A.*) 85:5507-5511 (1988), the entirety of which is herein incorporated by reference; Wickstrom et al., *Proc. Natl. Acad. Sci.* (*U.S.A.*) 85:1028-1032 (1988), the entirety of which is herein incorporated by reference; Holt et al., *Molec. Cell. Biol.* 8:963-973 (1988), the entirety of which is herein incorporated by reference; Gerwirtz et al., *Science* 242:1303-1306 (1988), the entirety of which is herein incorporated by reference; Anfossi et al., *Proc. Natl. Acad. Sci.* (*U.S.A.*) 86:3379-3383 (1989), the entirety of which is herein incorporated by reference; Becker et al., *EMBO J.* 8:3685-3691 (1989); the entirety of which is herein incorporated by reference). Automated nucleic acid synthesizers may be employed for this purpose. In lieu of such synthesis, the disclosed nucleic acid molecules may be used to define a pair of primers that can be used with the polymerase chain reaction (Mullis et al., *Cold Spring Harbor Symp. Quant. Biol.* 51:263-273 (1986); Erlich et al., European Patent 50,424; European Patent 84,796; European Patent 258,017; European Patent 237,362; Mullis, European Patent 201,184; Mullis et al., U.S. Pat. No. 4,683,202; Erlich, U.S. Pat. No. 4,582,788; and Saiki et al., U.S. Pat. No. 4,683,194, all of which are herein incorporated by reference in their entirety) to amplify and obtain any desired nucleic acid molecule or fragment.

Promoter sequence(s) and other genetic elements, including but not limited to transcriptional regulatory flanking sequences, associated with one or more of the disclosed nucleic acid sequences can also be obtained using the disclosed nucleic acid sequence provided herein. In one embodiment, such sequences are obtained by incubating EST nucleic acid molecules or preferably fragments thereof with members of genomic libraries (e.g. maize and soybean) and recovering clones that hybridize to the EST nucleic acid molecule or fragment thereof. In a second embodiment, methods of "chromosome walking," or inverse PCR may be used to obtain such sequences (Frohman et al., *Proc. Natl. Acad. Sci.* (*U.S.A.*) 85:8998-9002 (1988); Ohara et al., *Proc. Natl. Acad. Sci.* (*U.S.A.*) 86:5673-5677 (1989); Pang et al., *Biotechniques* 22:1046-1048 (1977); Huang et al., *Methods Mol. Biol.* 69:89-96 (1997); Huang et al., *Method Mol. Biol.* 67:287-294 (1997); Benkel et al., *Genet. Anal.* 13:123-127 (1996); Hartl et al., *Methods Mol. Biol.* 58:293-301 (1996), all of which are herein incorporated by reference in their entirety).

The nucleic acid molecules of the present invention may be used to isolate promoters of cell enhanced, cell specific, tissue enhanced, tissue specific, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et al., *Genome Analysis: Analyzing DNA,* 1, (1997), Cold Spring Harbor Laboratory Press, Cold Spring Harbor, N.Y., the entirety of which is herein incorporated by reference). Promoters obtained utilizing the nucleic acid molecules of the present invention could also be modified to affect their control characteristics. Examples of such modifications would include but are not limited to enhanced sequences as reported in Uses of the Agents of the Invention, Section (a) Plant Constructs and Plant Transformants. Such genetic elements could be used to enhance gene expression of new and existing traits for crop improvements.

In one sub-aspect, such an analysis is conducted by determining the presence and/or identity of polymorphism(s) by one or more of the nucleic acid molecules of the present invention and more preferably one or more of the EST nucleic acid molecule or fragment thereof which are associated with a phenotype, or a predisposition to that phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s) and more preferably within 100 kb of the polymorphism(s) and most preferably within 100 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist and the polymorphism is thus said to be di-allelic. In other cases, the species' population may contain multiple alleles and the polymorphism is termed tri-allelic, etc. A single gene may have multiple different unrelated polymorphisms. For example, it may have a di-allelic polymorphism at one site and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour et al., *FEBS Lett.* 307:113-115 (1992); Jones et al., *Eur. J. Haematol.* 39:144-147 (1987); Horn et al., PCT Patent Application WO91/14003; Jeffreys, European Patent Application 370,719; Jeffreys, U.S. Pat. No. 5,175,082; Jeffreys et al., *Amer. J. Hum. Genet.* 39:11-24 (1986); Jeffreys et al., *Nature* 316:76-79 (1985); Gray et al., *Proc. R. Acad. Soc. Lond.* 243:241-253 (1991); Moore et al., *Genomics* 10:654-660 (1991); Jeffreys et al., *Anim. Genet.* 18:1-15 (1987); Hillel et al., *Anim. Genet.* 20:145-155 (1989); Hillel et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis et al., *Cold Spring Harbor Symp. Quant. Biol.* 51:263-273 (1986); Erlich et al., European Patent Appln. 50,424; European Patent Appln. 84,796; European Patent Application 258,017; European Patent Appln. 237,362; Mullis, European Patent Appln. 201,184; Mullis et al., U.S. Pat. No. 4,683,202; Erlich, U.S. Pat. No. 4,582,788; and Saiki et al., U.S. Pat. No. 4,683,194), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci. (U.S.A.)* 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren et al., *Science* 241:1077-1080 (1988), the entirety of which is herein incorporated by reference). The OLA protocol uses two oligonucleotides which are designed to be capable of hybridizing to abutting sequences of a single staand of a target. OLA, like LCR, is particularly suited for the detection of point mutations. Unlike LCR, however, OLA results in "linear" rather than exponential amplification of the target sequence.

Nickerson et al., have described a nucleic acid detection assay that combines attributes of PCR and OLA (Nickerson et al., *Proc. Natl. Acad. Sci. (U.S.A.)* 87:8923-8927 (1990), the entirety of which is herein incorporated by reference). In this method, PCR is used to achieve the exponential amplification of target DNA, which is then detected using OLA. In addition to requiring multiple and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu et al., *Genomics* 4:560-569 (1989), the entirety of which is herein incorporated by reference) and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek et al., U.S. Pat. No. 5,130,238; Davey et al., European Patent Application 329,822; Schuster et al., U.S. Pat. No. 5,169,766; Miller et al., PCT Patent Application WO 89/06700; Kwoh et al., *Proc. Natl. Acad. Sci. (U.S.A.)* 86:1173-1177 (1989); Gingeras et al., PCT Patent Application WO 88/10315; Walker et al., *Proc. Natl. Acad. Sci. (U.S.A.)* 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick et al., *Cytogen. Cell Genet.* 32:58-67 (1982); Botstein et al., *Ann. J. Hum. Genet.* 32:314-331 (1980); Fischer et al., (PCT Application WO90/13668); Uhlen, PCT Application WO90/11369).

Polymorphisms can also be identified by Single Strand Conformation Polymorphism (SSCP) analysis. SSCP is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996), the entirety of which is herein incorporated by reference); Orita et al., *Genomics* 5:874879 (1989), the entirety of which is herein incorporated by reference). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to, Lee et al., *Anal. Biochem.* 205:289-293 (1992), the entirety of which is herein incorporated by reference; Suzuki et al., *Anal. Biochem.* 192:82-84 (1991), the entirety of which is herein incorporated by reference; Lo et al., *Nucleic Acids Research* 20:1005-1009 (1992), the entirety of which is herein incorporated by reference; Sarkar et al., *Genomics* 13:441-443 (1992), the entirety of which is herein incorporated by reference. It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA (Vos et al., *Nucleic Acids Res.* 23:4407-4414 (1995), the entirety of which is herein incorporated by reference). This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on *Salix* (Beismann et al., *Mol. Ecol.* 6:989-993 (1997), the entirety of which is herein incorporated by reference), *Acinetobacter* (Janssen et al., *Int. J. Syst. Bacteriol.* 47:1179-1187 (1997), the entirety of which is herein incorporated by reference), *Aeromonas popoffi* (Huys et al., *Int. J. Syst. Bacteriol.* 47:1165-1171 (1997), the entirety of which is herein incorporated by reference), rice (McCouch et al., *Plant Mol. Biol.* 35:89-99 (1997), the entirety of which is herein incorporated by reference; Nandi et al., *Mol. Gen. Genet.* 255:1-8 (1997), the entirety of which is herein incorporated by reference; Cho et al., *Genome* 39:373-378 (1996), the entirety of which is herein incorporated by reference), barley (*Hordeum vulgare*)(Simons et al., *Genomics* 44:61-70 (1997), the entirety of which is herein incorporated by reference; Waugh et al., *Mol. Gen. Genet.* 255:311-321 (1997), the entirety of which is herein incorporated by reference; Qi et al., *Mol. Gen Genet.* 254:330-336 (1997), the entirety of which is herein incorporated by reference; Becker et al., *Mol. Gen. Genet.* 249:65-73 (1995), the entirety of which is herein incorporated by reference), potato (Van der Voort et al., *Mol. Gen. Genet.* 255:438-447 (1997), the entirety of which is herein incorporated by reference; Meksem et al., *Mol. Gen. Genet.* 249:74-81 (1995), the entirety of which is herein incorporated by reference), *Phytophthora infestans* (Van der Lee et al., *Fungal Genet. Biol.* 21:278-291 (1997), the entirety of which is herein incorporated by reference), *Bacillus anthracis* (Keim et al., *J. Bacteriol.* 179:818-824 (1997), the entirety of which is herein incorporated by reference), *Astragalus* cremnophylax (Travis et al., *Mol. Ecol.* 5:735-745 (1996), the entirety of which is herein incorporated by reference), *Arabidopsis* (Cnops et al., *Mol. Gen. Genet.* 253:32-41 (1996), the entirety of which is herein incorporated by reference), *Escherichia coli* (Lin et al., *Nucleic Acids Res.* 24:3649-3650 (1996), the entirety of which is herein incorporated by reference), *Aeromonas* (Huys et al., *Int. J. Syst. Bacteriol.* 46:572-580 (1996), the entirety of which is herein incorporated by reference), nematode (Folkertsma et al., *Mol. Plant Microbe Interact.* 9:47-54 (1996), the entirety of which is herein incorporated by reference), tomato (Thomas et al., *Plant J.* 8:785-794 (1995), the entirety of which is herein incorporated by reference) and human (Latorra et al., *PCR Methods Appl.* 3:351-358 (1994), the entirety of which is herein incorporated by reference). AFLP analysis has also been used for fingerprinting mRNA (Money et al., *Nucleic Acids Res.* 24:2616-2617 (1996), the entirety of which is herein incorporated by reference; Bachem et al., *Plant J.* 9:745-753 (1996), the entirety of which is herein incorporated by reference). It is understood that one or more of the nucleic acids of the present invention, may be utilized as markers or probes to detect polymorphisms by AFLP analysis or for fingerprinting RNA.

Polymorphisms may also be found using random amplified polymorphic DNA (RAPD) (Williams et al., *Nucl. Acids Res.* 18:6531-6535 (1990), the entirety of which is herein incorporated by reference) and cleaveable amplified polymorphic sequences (CAPS) (Lyamichev et al., *Science* 260:778-783

(1993), the entirety of which is herein incorporated by reference). It is understood that one or more of the nucleic acid molecules of the present invention, may be utilized as markers or probes to detect polymorphisms by RAPD or CAPS analysis.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Ards and Moreno-Gonzalez, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which is herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Stam, *Genetics* 136:1447-1455 (1994), the entirety of which is herein incorporated by reference and Zeng, *Genetics* 136:1457-1468 (1994) the entirety of which is herein incorporated by reference. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp. 195-204 (1994), the entirety of which is herein incorporated by reference, thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping populations is important to map construction. The choice of appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Linkage in Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or BCF2) can be used in map construction. Marker-assisted selection can then be applied to cross progeny based on marker-trait map associations ($F_2$, $F_3$), where linkage groups have not been completely disassociated by recombination events (i.e., maximum disequillibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci. (U.S.A.)* 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., Proc. Natl. Acad. Sci. (U.S.A.) 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., Proc. Natl. Acad. Sci. (U.S.A.) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plants cells or tissues. Any source of nucleic acid may be used. Preferably, the nucleic acid is genomic DNA. The nucleic acid is subjected to restriction endonuclease digestion. For example, one or more nucleic acid molecule or fragment thereof of the present invention can be used as a probe in accordance with the above-described polymorphic methods. The polymorphism obtained in this approach can then be cloned to identify the mutation at the coding region which alters the protein's structure or regulatory region of the gene which affects its expression level.

In an aspect of the present invention, one or more of the nucleic molecules of the present invention are used to determine the level (i.e., the concentration of mRNA in a sample, etc.) in a plant (preferably maize or soybean) or pattern (i.e., the kinetics of expression, rate of decomposition, stability profile, etc.) of the expression of a protein encoded in part or whole by one or more of the nucleic acid molecule of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether an Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance such as tolerance to abiotic stress, male sterility, quality improvement or yield etc.). A change in genotype or phenotype may be transient or permanent. Also as used herein, a tissue sample is any sample that comprises more than one cell. In a preferred aspect, a tissue sample comprises cells that share a common characteristic (e.g. derived from root, seed, flower, leaf, stem or pollen etc.).

In one aspect of the present invention, an evaluation can be conducted to determine whether a particular mRNA molecule is present. One or more of the nucleic acid molecules of the present invention, preferably one or more of the EST nucleic acid molecules or fragments thereof of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., Dev. Biol. 101:477-484 (1984), the entirety of which is herein incorporated by reference; Angerer et al., Dev. Biol. 112:157-166 (1985), the entirety of which is herein incorporated by reference; Dixon et al., EMBO J. 10:1317-1324 (1991), the entirety of which is herein incorporated by reference). In situ hybridization may be used to measure the steady-state level of RNA accumulation. It is a sensitive technique and RNA sequences present in as few as 5-10 copies per cell can be detected (Hardin et al., J. Mol. Biol. 202:417-431 (1989), the entirety of which is herein incorporated by reference). A number of protocols have been devised for in situ hybridization, each with tissue preparation, hybridization and washing conditions (Meyerowitz, Plant Mol. Biol. Rep. 5:242-250 (1987), the entirety of which is herein incorporated by reference; Cox and Goldberg, In:

*Plant Molecular Biology: A Practical Approach*, Shaw (ed.), pp 1-35, IRL Press, Oxford (1988), the entirety of which is herein incorporated by reference; Raikhel et al., *In situ RNA hybridization in plant tissues*, In: *Plant Molecular Biology Manual*, vol. B9:1-32, Kluwer Academic Publisher, Dordrecht, Belgium (1989), the entirety of which is herein incorporated by reference).

In situ hybridization also allows for the localization of proteins within a tissue or cell (Wilkinson, *In Situ Hybridization*, Oxford University Press, Oxford (1992), the entirety of which is herein incorporated by reference; Langdale, *In Situ Hybridization* In: *The Maize Handbook*, Freeling and Walbot (eds.), pp 165-179, Springer-Verlag, New York (1994), the entirety of which is herein incorporated by reference). It is understood that one or more of the molecules of the present invention, preferably one or more of the EST nucleic acid molecules or fragments thereof of the present invention or one or more of the antibodies of the present invention may be utilized to detect the level or pattern of a carbon assimilation pathway enzyme or mRNA thereof by in situ hybridization.

Fluorescent in situ hybridization allows the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17:101-109 (1991), the entirety of which is herein incorporated by reference; Gustafson et al., *Proc. Natl. Acad. Sci. (U.S.A.)* 87:1899-1902 (1990), herein incorporated by reference; Mukai and Gill, *Genome* 34:448-452 (1991), the entirety of which is herein incorporated by reference; Schwarzacher and Heslop-Harrison, *Genome* 34:317-323 (1991); Wang et al., *Jpn. J. Genet.* 66:313-316 (1991), the entirety of which is herein incorporated by reference; Parra and Windle, *Nature Genetics* 5:17-21 (1993), the entirety of which is herein incorporated by reference). It is understood that the nucleic acid molecules of the present invention may be used as probes or markers to localize sequences along a chromosome.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of a tissue is pressed gently onto nitrocellulose paper, nylon membrane or polyvinylidene difluoride membrane. Such membranes are commercially available (e.g. Millipore, Bedford, Mass. U.S.A.). The contents of the cut cell transfer onto the membrane and the contents and are immobilized to the membrane. The immobilized contents form a latent print that can be visualized with appropriate probes. When a plant tissue print is made on nitrocellulose paper, the cell walls leave a physical print that makes the anatomy visible without further treatment (Varner and Taylor, *Plant Physiol.* 91:31-33 (1989), the entirety of which is herein incorporated by reference).

Tissue printing on substrate films is described by Daoust, *Exp. Cell Res.* 12:203-211 (1957), the entirety of which is herein incorporated by reference, who detected amylase, protease, ribonuclease and deoxyribonuclease in animal tissues using starch, gelatin and agar films. These techniques can be applied to plant tissues (Yomo and Taylor, *Planta* 112:35-43 (1973); the entirety of which is herein incorporated by reference; Harris and Chrispeels, *Plant Physiol.* 56:292-299 (1975), the entirety of which is herein incorporated by reference). Advances in membrane technology have increased the range of applications of Daoust's tissue-printing techniques allowing (Cassab and Varner, *J. Cell. Biol.* 105:2581-2588 (1987), the entirety of which is herein incorporated by reference) the histochemical localization of various plant enzymes and deoxyribonuclease on nitrocellulose paper and nylon (Spruce et al., *Phytochemistry* 26:2901-2903 (1987), the entirety of which is herein incorporated by reference; Barres et al., *Neuron* 5:527-544 (1990), the entirety of which is herein incorporated by reference; Reid and Pont-Lezica, *Tissue Printing: Tools for the Study of Anatomy, Histochemistry and Gene Expression*, Academic Press, New York, N.Y. (1992), the entirety of which is herein incorporated by reference; Reid et al., *Plant Physiol.* 93:160-165 (1990), the entirety of which is herein incorporated by reference; Ye et al., *Plant J.* 1:175-183 (1991), the entirety of which is herein incorporated by reference).

It is understood that one or more of the molecules of the present invention, preferably one or more of the EST nucleic acid molecules or fragments thereof of the present invention or one or more of the antibodies of the present invention may be utilized to detect the presence or quantity of a carbon assimilation pathway enzyme by tissue printing.

Further it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) of a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270:467-470 (1995), the entirety of which is herein incorporated by reference; Shalon, Ph.D. Thesis, Stanford University (1996), the entirety of which is herein incorporated by reference). Every nucleotide in a large sequence can be queried at the same time. Hybridization can be used to efficiently analyze nucleotide sequences.

Several microarray methods have been described. One method compares the sequences to be analyzed by hybridization to a set of oligonucleotides representing all possible subsequences (Bains and Smith, *J. Theor. Biol.* 135:303-307 (1989), the entirety of which is herein incorporated by reference). A second method hybridizes the sample to an array of oligonucleotide or cDNA molecules. An array consisting of oligonucleotides complementary to subsequences of a target sequence can be used to determine the identity of a target sequence, measure its amount and detect differences between the target and a reference sequence. Nucleic acid molecules microarrays may also be screened with protein molecules or fragments thereof to determine nucleic acid molecules that specifically bind protein molecules or fragments thereof.

The microarray approach may be used with polypeptide targets (U.S. Pat. No. 5,445,934; U.S. Pat. No. 5,143,854; U.S. Pat. No. 5,079,600; U.S. Pat. No. 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. (Fodor et al., *Science* 251:767-773

(1991), the entirety of which is herein incorporated by reference). It is understood that one or more of the nucleic acid molecules or protein or fragments thereof of the present invention may be utilized in a microarray based method.

In a preferred embodiment of the present invention microarrays may be prepared that comprise nucleic acid molecules where such nucleic acid molecules encode at least one, preferably at least two, more preferably at least three carbon assimilation pathway enzymes, more preferably at least four carbon assimilation pathway enzymes, more preferably at least five carbon assimilation pathway enzymes, more preferably at least six carbon assimilation pathway enzymes, more preferably at least seven carbon assimilation pathway enzymes, more preferably at least eight carbon assimilation pathway enzymes, more preferably at least nine carbon assimilation pathway enzymes, more preferably at least ten carbon assimilation pathway enzymes, more preferably at least eleven carbon assimilation pathway enzymes, more preferably at least twelve carbon assimilation pathway enzymes, more preferably at least thirteen carbon assimilation pathway enzymes, more preferably at least fourteen carbon assimilation pathway enzymes, more preferably at least fifteen carbon assimilation pathway enzymes, more preferably at least sixteen carbon assimilation pathway enzymes, more preferably at least seventeen carbon assimilation pathway enzymes, more preferably at least eighteen carbon assimilation pathway enzymes, more preferably at least nineteen carbon assimilation pathway enzymes, more preferably at least twenty carbon assimilation pathway enzymes, more preferably at least twenty one carbon assimilation pathway enzymes, more preferably at least twenty two carbon assimilation pathway enzymes, more preferably at least twenty three carbon assimilation pathway enzymes, more preferably at least twenty four carbon assimilation pathway enzymes and even more preferably at least twenty five carbon assimilation pathway enzymes. In a preferred embodiment the nucleic acid molecules are selected from the group consisting of a nucleic acid molecule that encodes a maize or soybean ribulose-bisphosphate carboxylase enzyme or fragment thereof, a nucleic acid molecule that encodes a maize or soybean phosphoglycerate kinase enzyme or fragment thereof, a nucleic acid molecule that encodes a maize or soybean glyceraldehyde 3-phosphate dehydrogenase enzyme or fragment thereof, a nucleic acid molecule that encodes a putative maize glyceraldehyde 3-phosphate dehydrogenase enzyme or fragment thereof, a nucleic acid molecule that encodes a maize or soybean triose phosphate isomerase enzyme or fragment thereof, a nucleic acid molecule that encodes a maize or soybean aldolase enzyme or fragment thereof, a nucleic acid molecule that encodes a maize or soybean fructose-1,6-bisphosphatase enzyme or fragment thereof, a nucleic acid molecule that encodes a maize or soybean transketolase enzyme or fragment thereof, a nucleic acid molecule that encodes a putative maize or soybean transketolase enzyme or fragment thereof, a nucleic acid molecule that encodes a maize or soybean sedoheptulose-1,7-bisphosphatase enzyme or fragment thereof, a nucleic acid molecule that encodes a maize or soybean D-ribulose-5-phosphate-3-epimerase enzyme or fragment thereof, a nucleic acid molecule that encodes a maize or soybean ribose-5-phosphate isomerase enzyme or fragment thereof, a nucleic acid molecule that encodes a putative maize or soybean ribose-5-phosphate isomerase enzyme or fragment thereof, a nucleic acid molecule that encodes a maize or soybean ribose-5-phosphate kinase enzyme or fragment thereof, a nucleic acid molecule that encodes a maize or soybean phosphoenolpyruvate carboxylase enzyme or fragment thereof, a nucleic acid molecule that encodes a maize or soybean NADP-dependent malate dehydrogenase enzyme or fragment thereof, a nucleic acid molecule that encodes a maize or soybean aspartate aminotransferase enzyme or fragment thereof, a nucleic acid molecule that encodes a putative maize or soybean aspartate aminotransferase enzyme or fragment thereof, a nucleic acid molecule that encodes a maize or soybean alanine aminotransferase enzyme or fragment thereof, a nucleic acid molecule that encodes a maize or soybean NADP-dependent malic enzyme or fragment thereof, a nucleic acid molecule that encodes a maize or soybean NAD-dependent malic enzyme or fragment thereof, a nucleic acid molecule that encodes a maize or soybean PEP carboxykinase enzyme or fragment thereof, a nucleic acid molecule that encodes a putative soybean PEP carboxykinase enzyme or fragment thereof, a nucleic acid molecule that encodes a maize or soybean pyruvate, phosphate dikinase enzyme or fragment thereof and a nucleic acid molecule that encodes a maize or soybean pyrophatase enzyme or fragment thereof.

Site directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site directed mutagenesis are often employed. These are cassette mutagenesis (Wells et al., *Gene* 34:315-323 (1985), the entirety of which is herein incorporated by reference), primer extension (Gilliam et al., *Gene* 12:129-137 (1980), the entirety of which is herein incorporated by reference; Zoller and Smith, *Methods Enzymol.* 100:468-500 (1983), the entirety of which is herein incorporated by reference; Dalbadie-McFarland et al., *Proc. Natl. Acad. Sci.* (*U.S.A.*) 79:6409-6413 (1982), the entirety of which is herein incorporated by reference) and methods based upon PCR (Scharf et al., *Science* 233:1076-1078 (1986), the entirety of which is herein incorporated by reference; Higuchi et al., *Nucleic Acids Res.* 16:7351-7367 (1988), the entirety of which is herein incorporated by reference). Site directed mutagenesis approaches are also described in European Patent 0 385 962, the entirety of which is herein incorporated by reference; European Patent 0 359 472, the entirety of which is herein incorporated by reference; and PCT Patent Application WO 93/07278, the entirety of which is herein incorporated by reference.

Site directed mutagenesis strategies have been applied to plants for both in vitro as well as in vivo site directed mutagenesis (Lanz et al., *J. Biol. Chem.* 266:9971-9976 (1991), the entirety of which is herein incorporated by reference; Kovgan and Zhdanov, *Biotekhnologiya* 5:148-154; No. 207160n, Chemical Abstracts 110:225 (1989), the entirety of which is herein incorporated by reference; Ge et al., *Proc. Natl. Acad. Sci.* (*U.S.A.*) 86:4037-4041 (1989), the entirety of which is herein incorporated by reference; Zhu et al., *J. Biol. Chem.* 271:18494-18498 (1996), the entirety of which is herein incorporated by reference; Chu et al., *Biochemistry* 33:6150-6157 (1994), the entirety of which is herein incorporated by reference; Small et al., *EMBO J.* 11:1291-1296 (1992), the entirety of which is herein incorporated by reference; Cho et al., *Mol. Biotechnol.* 8:13-16 (1997), the entirety of which is herein incorporated by reference; Kita et al., *J. Biol. Chem.* 271:26529-26535 (1996), the entirety of which is herein incorporated by reference, Jin et al., *Mol. Microbiol.* 7:555-562 (1993), the entirety of which is herein incorporated by reference; Hatfield and Vierstra, *J. Biol. Chem.* 267:14799-14803 (1992), the entirety of which is herein incorporated by reference; Zhao et al., *Biochemistry* 31:5093-5099 (1992), the entirety of which is herein incorporated by reference).

Any of the nucleic acid molecules of the present invention may either be modified by site directed mutagenesis or used as, for example, nucleic acid molecules that are used to target other nucleic acid molecules for modification. It is understood that mutants with more than one altered nucleotide can be constructed using techniques that practitioners are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), the entirety of which is herein incorporated by reference) and molecular biochemical approaches, including the screening of recombinant cDNA libraries with antibodies (Landschulz et al., *Genes Dev.* 2:786-800 (1988), the entirety of which is herein incorporated by reference) or DNA probes (Bodner et al., *Cell* 55:505-518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4:839-849 (1992), the entirety of which is herein incorporated by reference; Schindler et al., *EMBO J.* 11:1261-1273 (1992), the entirety of which is herein incorporated by reference). An in situ screening protocol does not require the purification of the protein of interest (Vinson et al., *Genes Dev.* 2:801-806 (1988), the entirety of which is herein incorporated by reference; Singh et al., *Cell* 52:415-423 (1988), the entirety of which is herein incorporated by reference).

Two steps may be employed to characterize DNA-protein interactions. The first is to identify promoter fragments that interact with DNA-binding proteins, to titrate binding activity, to determine the specificity of binding and to determine whether a given DNA-binding activity can interact with related DNA sequences (Sambrook et al., *Molecular Cloning: A Laboratory Manual*, $2^{nd}$ edition, Cold Spring Harbor Laboratory Press, Cold Spring Harbor, N.Y. (1989)). Electrophoretic mobility-shift assay is a widely used assay. The assay provides a rapid and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9:6505-6525 (1981), the entirety of which is herein incorporated by reference). When one or more specific binding activities have been identified, the exact sequence of the DNA bound by the protein may be determined. Several procedures for characterizing protein/DNA-binding sites are used, including methylation and ethylation interference assays (Maxam and Gilbert, *Methods Enzymol.* 65:499-560 (1980), the entirety of which is herein incorporated by reference; Wissman and Hillen, *Methods Enzymol.* 208:365-379 (1991), the entirety of which is herein incorporated by reference), footprinting techniques employing DNase I (Galas and Schmitz, *Nucleic Acids Res.* 5:3157-3170 (1978), the entirety of which is herein incorporated by reference), 1,10-phenanthroline-copper ion methods (Sigman et al., *Methods Enzymol.* 208:414-433 (1991), the entirety of which is herein incorporated by reference) and hydroxyl radicals methods (Dixon et al., *Methods Enzymol.* 208:414-433 (1991), the entirety of which is herein incorporated by reference). It is understood that one or more of the nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

A two-hybrid system is based on the fact that many cellular functions are carried out by proteins, such as transcription factors, that interact (physically) with one another. Two-hybrid systems have been used to probe the function of new proteins (Chien et al., *Proc. Natl. Acad. Sci.* (*U.S.A.*) 88:9578-9582 (1991) the entirety of which is herein incorporated by reference; Durfee et al., *Genes Dev.* 7:555-569 (1993) the entirety of which is herein incorporated by reference; Choi et al., *Cell* 78:499-512 (1994), the entirety of which is herein incorporated by reference; Kranz et al., *Genes Dev.* 8:313-327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci.* (*U.S.A.*) 91:12098-12984 (1994), the entirety of which is herein incorporated by reference), larger sets of hundreds of proteins (Bendixen et al., *Nucl. Acids Res.* 22:1778-1779 (1994), the entirety of which is herein incorporated by reference) and to comprehensively map proteins encoded by a small genome (Bartel et al., *Nature Genetics* 12:72-77 (1996), the entirety of which is herein incorporated by reference). This technique utilizes proteins fused to the DNA-binding domain and proteins fused to the activation domain. They are expressed in two different haploid yeast strains of opposite mating type and the strains are mated to determine if the two proteins interact. Mating occurs when haploid yeast stains come into contact and result in the fusion of the two haploids into a diploid yeast strain. An interaction can be determined by the activation of a two-hybrid reporter gene in the diploid strain. An advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

(a) Plant Constructs and Plant Transformants

One or more of the nucleic acid molecules of the present invention may be used in plant transformation or transfection. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including, but not limited to maize (pp 63-69), soybean (pp 50-60), *Arabidopsis* (p 45), *phaseolus* (pp 47-49), peanut (pp 49-50), alfalfa (p 60), wheat (pp 69-71), rice (pp 72-79), oat (pp 80-81), sorghum (p 83), rye (p 84), tritordeum (p 84), millet (p 85), fescue (p 85), perennial ryegrass (p 86), sugarcane (p 87), cranberry (p 101), papaya (pp 101-102), banana (p 103), banana (p 103), muskmelon (p 104), apple (p 104), cucumber (p 105), dendrobium (p 109), gladiolus (p 110), chrysanthemum (p 110), liliacea (p 111), cotton (pp 113-114), eucalyptus (p 115), sunflower (p 118), canola (p 118), turfgrass (p 121), sugarbeet (p 122), coffee (p 122) and dioscorea (p 122), (Christou, In: *Particle Bombardment for Genetic Engineering of Plants*, Biotechnology Intelligence Unit. Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Particularly, any of the carbon assimilation pathway enzymes or fragments thereof may be overexpressed in a transformed cell or transgenic plant. Such overexpression may be the result of transient or stable transfer of the exogenous genetic material.

Exogenous genetic material may be transferred into a plant cell and the plant cell by the use of a DNA vector or construct designed for such a purpose. Design of such a vector is generally within the skill of the art (See, *Plant Molecular Biology: A Laboratory Manual*, Clark (ed.), Springier, N.Y. (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad. Sci. (U.S.A.)* 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987), the entirety of which is herein incorporated by reference) and the CAMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci. (U.S.A.)* 84:6624-6628 (1987), the entirety of which is herein incorporated by reference), the sucrose synthase promoter (Yang et al., *Proc. Natl. Acad. Sci. (U.S.A.)* 87:4144-4148 (1990), the entirety of which is herein incorporated by reference), the R gene complex promoter (Chandler et al., *The Plant Cell* 1:1175-1183 (1989), the entirety of which is herein incorporated by reference) and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of the carbon assimilation pathway enzyme to cause the desired phenotype. In addition to promoters that are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci. (U.S.A.)* 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS 1 promoter from potato (Stockhaus et al., *EMBO J.* 8:2445-2451 (1989), herein incorporated by reference in its entirety), the serine/threonine kinase (PAL) promoter and the glucoamylase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant Mol. Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cablR gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci. (U.S.A.)* 90: 9586-9590 (1993), herein incorporated by reference in its entirety), the promoter for the tobacco Lhcb1*2 gene (Cerdan et al., *Plant Mol. Biol.* 33:245-255 (1997), herein incorporated by reference in its entirety), the *Arabidopsis thaliana* SUC2 sucrose-H+ symporter promoter (Truernit et al., *Planta.* 196:564-570 (1995), herein incorporated by reference in its entirety) and the promoter for the thylakoid membrane proteins from spinach (psaD, psaF, psaE, PC, FNR, atpC, atpD, cab, rbcS). Other promoters for the chlorophyll a/b-binding proteins may also be utilized in the present invention, such as the promoters for LhcB gene and PsbP gene from white mustard (*Sinapis alba*; Kretsch et al., *Plant Mol. Biol.* 28:219-229 (1995), the entirety of which is herein incorporated by reference).

For the purpose of expression in sink tissues of the plant, such as the tuber of the potato plant, the fruit of tomato, or the seed of maize, wheat, rice and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8:1899-1906 (1986); Jefferson et al., *Plant Mol. Biol.* 14:995-1006 (1990), both of which are herein incorporated by reference in its entirety), the promoter for the potato tuber ADPGPP genes, both the large and small subunits, the sucrose synthase promoter (Salanoubat and Belliard, *Gene.* 60:47-56 (1987), Salanoubat and Belliard, *Gene.* 84:181-185 (1989), both of which are incorporated by reference in their entirety), the promoter for the major tuber proteins including the 22 kd protein complexes and proteinase inhibitors (Hannapel, *Plant Physiol.* 101:703-704 (1993), herein incorporated by reference in its entirety), the promoter for the granule bound starch synthase gene (GBSS) (Visser et al., *Plant Mol. Biol.* 17:691-699 (1991), herein incorporated by reference in its entirety) and other class I and II patatins promoters (Koster-Topfer et al., *Mol. Gen Genet.* 219:390-396 (1989); Mignery et al., *Gene.* 62:27-44 (1988), both of which are herein incorporated by reference in their entirety).

Other promoters can also be used to express a carbon assimilation pathway enzyme or fragment thereof in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29:1015-1026 (1982), herein incorporated by reference in its entirety) and the promoters from these clones, including the 15 kD, 16 kD, 19 kD, 22 kD, 27 kD and genes, could also be used. Other promoters known to function, for example, in maize include the promoters for the following genes: waxy, Brittle, Shrunken 2, Branching enzymes I and II, starch synthases, debranching enzymes, oleosins, glutelins and sucrose synthases. A particularly preferred promoter for maize endosperm expression is the promoter for the glutelin gene from rice, more particularly the Osgt-1 promoter (Zheng et al., *Mol. Cell Biol.* 13:5829-5842 (1993), herein incorporated by reference in its entirety). Examples of promoters suitable for expression in wheat include those promoters for the ADPglucose pyrosynthase (ADPGPP) subunits, the granule bound and other starch synthase, the branching and debranching enzymes, the embryogenesis-abundant proteins, the gliadins and the glutenins. Examples of such promoters in rice include those promoters for the ADPGPP subunits, the granule bound and other starch synthase, the branching enzymes, the debranching enzymes, sucrose synthases and the glutelins. A particularly preferred promoter is the promoter for rice glutelin, Osgt-1. Examples of such promoters for barley include those for the ADPGPP subunits, the granule bound and other starch synthase, the branching enzymes, the debranching enzymes, sucrose synthases, the hordeins, the embryo globulins and the aleurone specific proteins.

Root specific promoters may also be used. An example of such a promoter is the promoter for the acid chitinase gene (Samac et al., *Plant Mol. Biol.* 25:587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci. (U.S.A.)* 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435; and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include with the coding region of interest a nucleic acid sequence that acts, in whole or in part, to terminate transcription of that region. For example, such sequences have been isolated including the Tr7 3' sequence and the NOS 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., *Plant Physiol.* 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al., *Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405 (1987), the entirety of which is herein incorporated by reference; Jefferson et al., *EMBO J.* 6:3901-3907 (1987), the entirety of which is herein incorporated by reference); an R-locus gene, which encodes a product that regulates the production of anthocyanin pigments (red color) in plant tissues (Dellaporta et al., Stadler Symposium 11:263-282 (1988), the entirety of which is herein incorporated by reference); a β-lactamase gene (Sutcliffe et al., *Proc. Natl. Acad. Sci. (U.S.A.)* 75:3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234:856-859 (1986), the entirety of which is herein incorporated by reference); a xylE gene (Zukowsky et al., *Proc. Natl. Acad. Sci. (U.S.A.)* 80:1101-1105 (1983), the entirety of which is herein incorporated by reference) which encodes a catechol diozygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

There are many methods for introducing transforming nucleic acid molecules into plant cells. Suitable methods are believed to include virtually any method by which nucleic acid molecules may be introduced into a cell, such as by Agrobacterium infection or direct delivery of nucleic acid molecules such as, for example, by PEG-mediated transformation, by electroporation or by acceleration of DNA coated particles, etc (Potrykus, *Ann. Rev. Plant Physiol. Plant Mol. Biol.* 42:205-225 (1991), the entirety of which is herein incorporated by reference; Vasil, *Plant Mol. Biol.* 25:925-937 (1994), the entirety of which is herein incorporated by reference). For example, electroporation has been used to transform maize protoplasts (Fromm et al., *Nature* 312:791-793 (1986), the entirety of which is herein incorporated by reference).

Other vector systems suitable for introducing transforming DNA into a host plant cell include but are not limited to binary artificial chromosome (BIBAC) vectors (Hamilton et al., *Gene* 200:107-116 (1997), the entirety of which is herein incorporated by reference); and transfection with RNA viral vectors (Della-Cioppa et al., *Ann. N.Y. Acad. Sci.* (1996), 792 (Engineering Plants for Commercial Products and Applications), 57-61, the entirety of which is herein incorporated by reference). Additional vector systems also include plant selectable YAC vectors such as those described in Mullen et al., *Molecular Breeding* 4:449-457 (1988), the entireity of which is herein incorporated by reference).

Technology for introduction of DNA into cells is well known to those of skill in the art. Four general methods for delivering a gene into cells have been described: (1) chemical methods (Graham and van der Eb, *Virology* 54:536-539 (1973), the entirety of which is herein incorporated by reference); (2) physical methods such as microinjection (Capecchi, *Cell* 22:479-488 (1980), the entirety of which is herein incorporated by reference), electroporation (Wong and Neumann, *Biochem. Biophys. Res. Commun.* 107:584-587 (1982); Fromm et al., *Proc. Natl. Acad. Sci. (U.S.A.)* 82:5824-5828 (1985); U.S. Pat. No. 5,384,253, all of which are herein incorporated in their entirety); and the gene gun (Johnston and Tang, *Methods Cell Biol.* 43:353-365 (1994), the entirety of which is herein incorporated by reference); (3) viral vectors (Clapp, *Clin. Perinatol.* 20:155-168 (1993); Lu et al., *J. Exp. Med.* 178:2089-2096 (1993); Eglitis and Anderson, *Biotechniques* 6:608-614 (1988), all of which are herein incorporated in their entirety); and (4) receptor-mediated mechanisms (Curiel et al., *Hum. Gen. Ther.* 3:147-154 (1992), Wagner et al., *Proc. Natl. Acad. Sci. (U.S.A.)* 89:6099-6103 (1992), both of which are incorporated by reference in their entirety).

Acceleration methods that may be used include, for example, microprojectile bombardment and the like. One example of a method for delivering transforming nucleic acid molecules to plant cells is microprojectile bombardment. This method has been reviewed by Yang and Christou (eds.), *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum and the like.

A particular advantage of microprojectile bombardment, in addition to it being an effective means of reproducibly transforming monocots, is that neither the isolation of protoplasts (Cristou et al., *Plant Physiol.* 87:671-674 (1988), the entirety of which is herein incorporated by reference) nor the susceptibility of *Agrobacterium* infection are required. An illustrative embodiment of a method for delivering DNA into maize cells by acceleration is a biolistics α-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2:603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun is available from Bio-Rad Laboratories (Bio-Rad, Hercules, Calif.)(Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment and also the nature of the transforming DNA, such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (*U.S.A.*) 87:8526-8530 (1990); Svab and Maliga, *Proc. Natl. Acad. Sci.* (*U.S.A.*) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described by Fraley et al., *Bio/Technology* 3:629-635 (1985) and Rogers et al., *Methods Enzymol.* 153:253-277 (1987), both of which are herein incorporated by reference in their entirety. Further, the integration of the Ti-DNA is a relatively precise process resulting in few rearrangements. The region of DNA to be transferred is defined by the border sequences and intervening DNA is usually inserted into the plant genome as described (Spielmann et al., *Mol. Gen. Genet.* 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., In: *Plant DNA Infectious Agents*, Hohn and Schell (eds.), Springer-Verlag, New York, pp. 179-203 (1985), the entirety of which is herein incorporated by reference. Moreover, technological advances in vectors for *Agrobacterium*-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Methods Enzymol.* 153:253-277 (1987)). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and out-crossing with a non-transgenic plant are also contemplated, as is vegetative propagation.

Transformation of plant protoplasts can be achieved using methods based on calcium phosphate precipitation, polyethylene glycol treatment, electroporation and combinations of these treatments (See, for example, Potrykus et al., *Mol. Gen. Genet.* 205:193-200 (1986); Lorz et al., *Mol. Gen. Genet.* 199:178 (1985); Fromm et al., *Nature* 319:791 (1986); Uchimiya et al., *Mol. Gen. Genet.* 204:204 (1986); Marcotte et al., *Nature* 335:454-457 (1988), all of which are herein incorporated by reference in their entirety).

Application of these systems to different plant strains depends upon the ability to regenerate that particular plant strain from protoplasts. Illustrative methods for the regeneration of cereals from protoplasts are described (Fujimura et al., *Plant Tissue Culture Letters* 2:74 (1985); Toriyama et al., *Theor Appl. Genet.* 205:34 (1986); Yamada et al., *Plant Cell Rep.* 4:85 (1986); Abdullah et al., *Biotechnolog* 4:1087 (1986), all of which are herein incorporated by reference in their entirety).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology* 6:397 (1988), the entirety of which is herein incorporated by reference). In addition, "particle gun" or high-velocity microprojectile technology can be utilized (Vasil et al., *Bio/Technology* 10:667 (1992), the entirety of which is herein incorporated by reference).

Using the latter technology, DNA is carried through the cell wall and into the cytoplasm on the surface of small metal particles as described (Klein et al., *Nature* 328:70 (1987); Klein et al., *Proc. Natl. Acad. Sci.* (*U.S.A.*) 85:8502-8505 (1988); McCabe et al., *Bio/Technology* 6:923 (1988), all of which are herein incorporated by reference in their entirety). The metal particles penetrate through several layers of cells and thus allow the transformation of cells within tissue explants.

Other methods of cell transformation can also be used and include but are not limited to introduction of DNA into plants by direct DNA transfer into pollen (Zhou et al., *Methods Enzymol.* 101:433 (1983); Hess et al., *Intern Rev. Cytol.* 107:367 (1987); Luo et al., *Plant Mol. Biol. Reporter* 6:165 (1988), all of which are herein incorporated by reference in their entirety), by direct injection of DNA into reproductive organs of a plant (Pena et al., *Nature* 325:274 (1987), the entirety of which is herein incorporated by reference), or by direct injection of DNA into the cells of immature embryos followed by the rehydration of desiccated embryos (Neuhaus et al., *Theor. Appl. Genet.* 75:30 (1987), the entirety of which is herein incorporated by reference).

The regeneration, development and cultivation of plants from single plant protoplast transformants or from various transformed explants is well known in the art (Weissbach and Weissbach, In: *Methods for Plant Molecular Biology*, Academic Press, San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A trarsgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens* and obtaining transgenic plants have been published for cotton (U.S. Pat. No. 5,004,863; U.S. Pat. No. 5,159,135; U.S. Pat. No. 5,518,908, all of which are herein incorporated by reference in their entirety); soybean (U.S. Pat. No. 5,569,834; U.S. Pat. No. 5,416,011; McCabe et. al., *Biotechnology* 6:923 (1988); Christou et al., *Plant Physiol.* 87:671-674 (1988); all of which are herein incorporated by reference in their entirety); Brassica (U.S. Pat. No. 5,463,174, the entirety of which is herein incorporated by reference); peanut (Cheng et al., *Plant Cell Rep.* 15:653-657 (1996), McKently et al., *Plant Cell Rep.* 14:699-703 (1995), all of which are herein incorporated by reference in their entirety); papaya; and pea (Grant et al., *Plant Cell Rep.* 15:254-258 (1995), the entirety of which is herein incorporated by reference).

Transformation of monocotyledons using electroporation, particle bombardment and *Agrobacterium* have also been reported. Transformation and plant regeneration have been achieved in asparagus (Bytebier et al., *Proc. Natl. Acad. Sci. (USA)* 84:5354 (1987), the entirety of which is herein incorporated by reference); barley (Wan and Lemaux, *Plant Physiol* 104:37 (1994), the entirety of which is herein incorporated by reference); maize (Rhodes et al., *Science* 240:204 (1988); Gordon-Kamm et al., *Plant Cell* 2:603-618 (1990); Fromm et al., *Bio/Technology* 8:833 (1990); Koziel et al., *Bio/Technology* 11:194 (1993); Armstrong et al., *Crop Science* 35:550-557 (1995); all of which are herein incorporated by reference in their entirety); oat (Somers et al., *Bio/Technology* 10:1589 (1992), the entirety of which is herein incorporated by reference); orchard grass (Horn et al., *Plant Cell Rep.* 7:469 (1988), the entirety of which is herein incorporated by reference); rice (Toriyama et al., *Theor Appl. Genet.* 205:34 (1986); Part et al., *Plant Mol. Biol.* 32:1135-1148 (1996); Abedinia et al., *Aust. J. Plant Physiol.* 24:133-141 (1997); Zhang and Wu, *Theor. Appl. Genet.* 76:835 (1988); Zhang et al., *Plant Cell Rep.* 7:379 (1988); Battraw and Hall, *Plant Sci.* 86:191-202 (1992); Christou et al., *Bio/Technology* 9:957 (1991), all of which are herein incorporated by reference in their entirety); rye (De la Pena et al., *Nature* 325:274 (1987), the entirety of which is herein incorporated by reference); sugarcane (Bower and Birch, *Plant J.* 2:409 (1992), the entirety of which is herein incorporated by reference); tall fescue (Wang et al., *Bio/Technology* 10:691 (1992), the entirety of which is herein incorporated by reference) and wheat (Vasil et al., *Bio/Technology* 10:667 (1992), the entirety of which is herein incorporated by reference; U.S. Pat. No. 5,631,152, the entirety of which is herein incorporated by reference.)

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988), the entirety of which is herein incorporated by reference; Marcotte et al., *Plant Cell* 1:523-532 (1989), the entirety of which is herein incorporated by reference; McCarty et al., *Cell* 66:895-905 (1991), the entirety of which is herein incorporated by reference; Hattori et al., *Genes Dev.* 6:609-618 (1992), the entirety of which is herein incorporated by reference; Goff et al., *EMBO J.* 9:2517-2522 (1990), the entirety of which is herein incorporated by reference). Transient expression systems may be used to functionally dissect gene constructs (see generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters, enhancers etc. Further, any of the nucleic acid molecules of the present invention may be introduced into a plant cell in a manner that allows for overexpression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2:279-289 (1990), the entirety of which is herein incorporated by reference; van der Krol et al., *Plant Cell* 2:291-299 (1990), the entirety of which is herein incorporated by reference). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244:325-330 (1994), the entirety of which is herein incorporated by reference). Genes, even though different, linked to homologous promoters may result in the cosuppression of the linked genes (Vaucheret, *C.R. Acad. Sci. III* 316:1471-1483 (1993), the entirety of which is herein incorporated by reference).

This technique has, for example, been applied to generate white flowers from red petunia and tomatoes that do not ripen on the vine. Up to 50% of petunia transformants that contained a sense copy of the glucoamylase (CHS) gene produced white flowers or floral sectors; this was as a result of the post-transcriptional loss of mRNA encoding CHS (Flavell, *Proc. Natl. Acad. Sci. (U.S.A.)* 91:3490-3496 (1994), the entirety of which is herein incorporated by reference); van Blokland et al., *Plant J.* 6:861-877 (1994), the entirety of which is herein incorporated by reference). Cosuppression may require the coordinate transcription of the transgene and the endogenous gene and can be reset by a developmental control mechanism (Jorgensen, *Trends Biotechnol.* 8:340-344 (1990), the entirety of which is herein incorporated by reference; Meins and Kunz, In: *Gene Inactivation and Homologous Recombination in Plants*, Paszkowski (ed.), pp.

335-348, Kluwer Academic, Netherlands (1994), the entirety of which is herein incorporated by reference).

It is understood that one or more of the nucleic acids of the present invention may be introduced into a plant cell and transcribed using an appropriate promoter with such transcription resulting in the cosuppression of an endogenous carbon assimilation pathway enzyme.

Antisense approaches are a way of preventing or reducing gene function by targeting the genetic material (Mol et al., *FEBS Lett.* 268:427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., In: *Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55:569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25:155-184 (1990), the entirety of which is herein incorporated by reference). An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

It is understood that the activity of a carbon assimilation pathway enzyme in a plant cell may be reduced or depressed by growing a transformed plant cell containing a nucleic acid molecule whose non-transcribed strand encodes a carbon assimilation pathway enzyme or fragment thereof.

Antibodies have been expressed in plants (Hiatt et al., *Nature* 342:76-78 (1989), the entirety of which is herein incorporated by reference; Conrad and Fielder, *Plant Mol. Biol.* 26:1023-1030 (1994), the entirety of which is herein incorporated by reference). Cytoplamsic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489-4496 (1997), the entirety of which is herein incorporated by reference; Marion-Poll, *Trends in Plant Science* 2:447-448 (1997), the entirety of which is herein incorporated by reference). For example, expressed anti-abscisic antibodies have been reported to result in a general perturbation of seed development (Philips et al., *EMBO J.* 16: 44894496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997), the entirety of which is herein incorporated by reference; Baca et al., *Ann. Rev. Biophys. Biomol. Struct.* 26:461-493 (1997), the entirety of which is herein incorporated by reference). The catalytic abilities of abzymes may be enhanced by site directed mutagenesis. Examples of abzymes are, for example, set forth in U.S. Pat. No. 5,658,753; U.S. Pat. No. 5,632,990; U.S. Pat. No. 5,631,137; U.S. Pat. No. 5,602,015; U.S. Pat. No. 5,559,538; U.S. Pat. No. 5,576,174; U.S. Pat. No. 5,500,358; U.S. Pat. No. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

(b) Fungal Constructs and Fungal Transformants

The present invention also relates to a fungal recombinant vector comprising exogenous genetic material. The present invention also relates to a fungal cell comprising a fungal recombinant vector. The present invention also relates to methods for obtaining a recombinant fungal host cell comprising introducing into a fungal host cell exogenous genetic material.

Exogenous genetic material may be transferred into a fungal cell. In a preferred embodiment the exogenous genetic material includes a nucleic acid molecule of the present invention having a sequence selected from the group consisting of SEQ ID NO: 1 through SEQ ID NO: 7341 or complements thereof or fragments of either or other nucleic acid molecule of the present invention. The fungal recombinant vector may be any vector which can be conveniently subjected to recombinant DNA procedures. The choice of a vector will typically depend on the compatibility of the vector with the fungal host cell into which the vector is to be introduced. The vector may be a linear or a closed circular plasmid. The vector system may be a single vector or plasmid or two or more vectors or plasmids which together contain the total DNA to be introduced into the genome of the fungal host.

The fungal vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the fungal cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the fungal host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the fungal host cell and, furthermore, may be non-encoding or encoding sequences.

For autonomous replication, the vector may further comprise an origin of replication enabling the vector to replicate autonomously in the host cell in question. Examples of origin of replications for use in a yeast host cell are the 2 micron origin of replication and the combination of CEN3 and ARS 1. Any origin of replication may be used which is compatible with the fungal host cell of choice.

The fungal vectors of the present invention preferably contain one or more selectable markers which permit easy selection of transformed cells. A selectable marker is a gene the product of which provides, for example biocide or viral resistance, resistance to heavy metals, prototrophy to auxotrophs and the like. The selectable marker may be selected from the group including, but not limited to, amdS (acetamidase), argB (ornithine carbamoyltransferase), bar (phosphinothricin acetyltransferase), hygb (hygromycin phosphotransferase), niaD (nitrate reductase), pyrG (orotidine-5'-phosphate decarboxylase) and sC (sulfate adenyltransferase) and trpC (anthranilate synthase). Preferred for use in an *Aspergillus* cell are the amdS and pyrG markers of *Aspergillus nidulans* or *Aspergillus oryzae* and the bar marker of *Streptomyces hygroscopicus*. Furthermore, selection may be accomplished by co-transformation, e.g., as described in WO 91/17243, the entirety of which is herein incorporated by reference. A nucleic acid sequence of the present invention may be operably linked to a suitable promoter sequence. The promoter sequence is a nucleic acid sequence which is recognized by the fungal host cell for expression of the nucleic acid sequence. The promoter sequence contains transcription and translation control sequences which mediate the expression of the protein or fragment thereof.

A promoter may be any nucleic acid sequence which shows transcriptional activity in the fungal host cell of choice and may be obtained from genes encoding polypeptides either homologous or heterologous to the host cell. Examples of suitable promoters for directing the transcription of a nucleic acid construct of the invention in a filamentous fungal host are promoters obtained from the genes encoding *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase and hybrids thereof. In a yeast host, a useful promoter is the *Saccharomyces cerevisiae* enolase (eno-1) promoter. Particularly preferred promoters are the TAKA amylase, NA2-tpi (a hybrid of the promoters from the genes encoding *Aspergillus niger* neutral alpha-amylase and *Aspergillus oryzae* triose phosphate isomerase) and glaA promoters.

A protein or fragment thereof encoding nucleic acid molecule of the present invention may also be operably linked to a terminator sequence at its 3' terminus. The terminator sequence may be native to the nucleic acid sequence encoding the protein or fragment thereof or may be obtained from foreign sources. Any terminator which is functional in the fungal host cell of choice may be used in the present invention, but particularly preferred terminators are obtained from the genes encoding *Aspergillus oryzae* TAKA amylase, *Aspergillus niger* glucoamylase, *Aspergillus nidulans* anthranilate synthase, *Aspergillus niger* alpha-glucosidase and *Saccharomyces cerevisiae* enolase.

A protein or fragment thereof encoding nucleic acid molecule of the present invention may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the fungal host cell of choice may be used in the present invention, but particularly preferred leaders are obtained from the genes encoding *Aspergillus oryzae* TAKA amylase and *Aspergillus oryzae* triose phosphate isomerase.

A polyadenylation sequence may also be operably linked to the 3' terminus of the nucleic acid sequence of the present invention. The polyadenylation sequence is a sequence which when transcribed is recognized by the fungal host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention, but particularly preferred polyadenylation sequences are obtained from the genes encoding *Aspergillus oryzae* TAKA amylase, *Aspergillus niger* glucoamylase, *Aspergillus nidulans* anthranilate synthase and *Aspergillus niger* alpha-glucosidase.

To avoid the necessity of disrupting the cell to obtain the protein or fragment thereof and to minimize the amount of possible degradation of the expressed protein or fragment thereof within the cell, it is preferred that expression of the protein or fragment thereof gives rise to a product secreted outside the cell. To this end, a protein or fragment thereof of the present invention may be linked to a signal peptide linked to the amino terminus of the protein or fragment thereof. A signal peptide is an amino acid sequence which permits the secretion of the protein or fragment thereof from the fungal host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof. Alternatively, the 5' end of the coding sequence may contain a signal peptide coding region which is foreign to that portion of the coding sequence which encodes the secreted protein or fragment thereof. The foreign signal peptide may be required where the coding sequence does not normally contain a signal peptide coding region. Alternatively, the foreign signal peptide may simply replace the natural signal peptide to obtain enhanced secretion of the desired protein or fragment thereof. The foreign signal peptide coding region may be obtained from a glucoamylase or an amylase gene from an *Aspergillus* species, a lipase or proteinase gene from *Rhizomucor miehei*, the gene for the alpha-factor from *Saccharomyces cerevisiae*, or the calf preprochymosin gene. An effective signal peptide for fungal host cells is the *Aspergillus oryzae* TAKA amylase signal, *Aspergillus niger* neutral amylase signal, the *Rhizomucor miehei* aspartic proteinase signal, the *Humicola lanuginosus* cellulase signal, or the *Rhizomucor miehei* lipase signal. However, any signal peptide capable of permitting secretion of the protein or fragment thereof in a fungal host of choice may be used in the present invention.

A protein or fragment thereof encoding nucleic acid molecule of the present invention may also be linked to a propeptide coding region. A propeptide is an amino acid sequence found at the amino terminus of aproprotein or proenzyme. Cleavage of the propeptide from the proprotein yields a mature biochemically active protein. The resulting polypeptide is known as a propolypeptide or proenzyme (or a zymogen in some cases). Propolypeptides are generally inactive and can be converted to mature active polypeptides by catalytic or autocatalytic cleavage of the propeptide from the propolypeptide or proenzyme. The propeptide coding region may be native to the protein or fragment thereof or may be obtained from foreign sources. The foreign propeptide coding region may be obtained from the *Saccharomyces cerevisiae* alpha-factor gene or *Myceliophthora thermophila* laccase gene (WO 95/33836, the entirety of which is herein incorporated by reference).

The procedures used to ligate the elements described above to construct the recombinant expression vector of the present invention are well known to one skilled in the art (see, for example, Sambrook et al., *Molecular Cloning, A Laboratory Manual,* 2nd ed., Cold Spring Harbor, N.Y., (1989)).

The present invention also relates to recombinant fungal host cells produced by the methods of the present invention which are advantageously used with the recombinant vector of the present invention. The cell is preferably transformed with a vector comprising a nucleic acid sequence of the invention followed by integration of the vector into the host chromosome. The choice of fungal host cells will to a large extent depend upon the gene encoding the protein or fragment thereof and its source. The fungal host cell may, for example, be a yeast cell or a filamentous fungal cell.

"Yeast" as used herein includes Ascosporogenous yeast (Endomycetales), Basidiosporogenous yeast and yeast belonging to the *Fungi Imperfecti* (Blastomycetes). The Ascosporogenous yeasts are divided into the families Spermophthoraceae and Saccharomycetaceae. The latter is comprised of four subfamilies, Schizosaccharomycoideae (for example, genus *Schizosaccharomyces*), Nadsonioideae, Lipomycoideae and Saccharomycoideae (for example, genera *Pichia, Kluyveromyces* and *Saccharomyces*). The Basidiosporogenous yeasts include the genera *Leucosporidim, Rhodosporidium, Sporidiobolus, Filobasidium* and *Filobasidiella*. Yeast belonging to the *Fungi Imperfecti* are divided into two families, Sporobolomycetaceae (for example, genera *Sorobolomyces* and *Bullera*) and Cryptococcaceae (for example, genus *Candida*). Since the classification of yeast may change in the future, for the purposes of this invention, yeast shall be defined as described in Biology and Activities of Yeast (Skinner et al., *Soc. App. Bacteriol. Symposium Series No.* 9, (1980), the entirety of which is herein incorporated by reference). The biology of yeast and manipulation of yeast genetics are well known in the art (see, for example, *Biochemistry and Genetics of Yeast,* Bacil et al. (ed.), 2nd edition, 1987; The Yeasts, Rose and Harrison (eds.), 2nd ed., (1987); and *The Molecular Biology of the Yeast Saccharomyces,* Strathern et al. (eds.), (1981), all of which are herein incorporated by reference in their entirety).

"Fungi" as used herein includes the phyla Ascomycota, Basidiomycota, Chytridiomycota and Zygomycota (as defined by Hawksworth et al., In: Ainsworth and Bisby's *Dictionary of The Fungi,* 8th edition, 1995, CAB International, University Press, Cambridge, UK; the entirety of which is herein incorporated by reference) as well as the Oomycota (as cited in Hawksworth et al., In: Ainsworth and Bisby's *Dictionary of The Fungi,* 8th edition, 1995, CAB International, University Press, Cambridge, UK) and all mitosporic fungi (Hawksworth et al., In: Ainsworth and Bisby's *Dictionary of The Fungi,* 8th edition, 1995, CAB International, University Press, Cambridge, UK). Representative groups of Ascomycota include, for example, *Neurospora, Eupenicillium* (=*Penicillium*), *Emericella* (=*Aspergillus*), *Eurotiun* (=*Aspergillus*) and the true yeasts listed above. Examples of Basidiomycota include mushrooms, rusts and smuts. Representative groups of Chytridiomycota include, for example, *Allomyces, Blastocladiella, Coelomomyces* and aquatic fungi. Representative groups of Oomycota include, for example, *Saprolegniomycetous* aquatic fungi (water molds) such as *Achlya*. Examples of mitosporic fungi include *Aspergillus, Penicillium, Candida* and *Alternaria*. Representative groups of Zygomycota include, for example, *Rhizopus* and *Mucor.*

"Filamentous fungi" include all filamentous forms of the subdivision Eumycota and Oomycota (as defined by Hawksworth et al., In: Ainsworth and Bisby's *Dictionary of The Fungi,* 8th edition, 1995, CAB International, University Press, Cambridge, UK). The filamentous fungi are characterized by a vegetative mycelium composed of chitin, cellulose, glucan, chitosan, mannan and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

In one embodiment, the fungal host cell is a yeast cell. In a preferred embodiment, the yeast host cell is a cell of the species of *Candida, Kluyveromyces, Saccharomyces, Schizosaccharomyces, Pichia* and *Yarrowia*. In a preferred embodiment, the yeast host cell is a *Saccharomyces cerevisiae* cell, a *Saccharomyces carlsbergensis, Saccharomyces diastaticus* cell, a *Saccharomyces douglasii* cell, a *Saccharomyces kluyveri* cell, a *Saccharomyces norbensis* cell, or a *Saccharomyces oviformis* cell. In another preferred embodiment, the yeast host cell is a *Kluyveromyces lactis* cell. In another preferred embodiment, the yeast host cell is a *Yarrowia lipolytica* cell.

In another embodiment, the fungal host cell is a filamentous fungal cell. In a preferred embodiment, the filamentous fungal host cell is a cell of the species of, but not limited to, *Acremonium, Aspergillus, Fusarium, Humicola, Myceliophthora, Mucor, Neurospora, Penicillium, Thielavia, Tolypocladium* and *Trichoderma*. In a preferred embodiment, the filamentous fungal host cell is an *Aspergillus* cell. In another preferred embodiment, the filamentous fungal host cell is an *Acremonium* cell. In another preferred embodiment, the filamentous fungal host cell is a *Fusarium* cell. In another preferred embodiment, the filamentous fungal host cell is a *Humicola* cell. In another preferred embodiment, the filamentous fungal host cell is a *Myceliophthora* cell. In another even preferred embodiment, the filamentous fungal host cell is a *Mucor* cell. In another preferred embodiment, the filamentous fungal host cell is a *Neurospora* cell. In another preferred embodiment, the filamentous fungal host cell is a *Penicillium* cell. In another preferred embodiment, the filamentous fungal host cell is a *Thielavia* cell. In another preferred embodiment, the filamentous fungal host cell is a *Tolypocladiun* cell. In another preferred embodiment, the filamentous fungal host cell is a *Trichoderma* cell. In a preferred embodiment, the filamentous fungal host cell is an *Aspergillus oryzae* cell, an *Aspergillus niger* cell, an *Aspergillus foetidus* cell, or an *Aspergillus japonicus* cell. In another preferred embodiment, the filamentous fungal host cell is a *Fusarium oxysporum* cell or a *Fusarium graminearum* cell. In another preferred embodiment, the filamentous fungal host cell is a *Humicola insolens* cell or a *Humicola lanuginosus* cell. In another preferred embodiment, the filamentous fungal host cell is a *Myceliophthora thermophila* cell. In a most preferred embodiment, the filamentous fungal host cell is a *Mucor miehei* cell. In a most preferred embodiment, the filamentous fungal host cell is a *Neurospora crassa* cell. In a most preferred embodiment, the filamentous fungal host cell is a *Penicillium purpurogenum* cell. In another most preferred embodiment, the filamentous fungal host cell is a *Thielavia terrestris* cell. In another most preferred embodiment, the *Trichoderma* cell is a *Trichoderma reesei* cell, a *Trichoderma viride* cell, a *Trichodenma longibrachiatum* cell, a *Trichoderma harzianum* cell, or a *Trichoderma koningii* cell. In a preferred embodiment, the fungal host cell is selected from an *A. nidulans* cell, an *A. niger* cell, an *A. oryzae* cell and an *A. sojae* cell. In a further preferred embodiment, the fungal host cell is an *A. nidulans* cell.

The recombinant fungal host cells of the present invention may further comprise one or more sequences which encode one or more factors that are advantageous in the expression of the protein or fragment thereof, for example, an activator (e.g., a trans-acting factor), a chaperone and a processing protease. The nucleic acids encoding one or more of these factors are preferably not operably linked to the nucleic acid encoding the protein or fragment thereof. An activator is a protein which activates transcription of a nucleic acid sequence encoding a polypeptide (Kudla et al., *EMBO* 9:1355-1364(1990); Jarai and Buxton, *Current Genetics* 26:2238-244(1994); Verdier, *Yeast* 6:271-297(1990), all of which are herein incorporated by reference in their entirety). The nucleic acid sequence encoding an activator may be obtained from the genes encoding *Saccharomyces cerevisiae* heme activator protein 1 (hap 1), *Saccharomyces cerevisiae* galactose metabolizing protein 4 (gal4) and *Aspergillus nidulans* ammonia regulation protein (areA). For further examples, see Verdier, *Yeast* 6:271-297 (1990); MacKenzie et al., *Journal of Gen. Microbiol.* 139:2295-2307 (1993), both of which are herein incorporated by reference in their entirety). A chaperone is a protein which assists another protein in folding properly (Hartl et al, *TIBS* 19:20-25 (1994); Bergeron et al, *TIBS* 19:124-128 (1994); Demolder et al., *J. Biotechnology* 32:179-189 (1994); Craig, *Science* 260:1902-1903(1993); Gething and Sambrook, *Nature* 355:33-45 (1992); Puig and Gilbert, *J. Biol. Chem.* 269:7764-7771 (1994); Wang and Tsou, *FASEB Journal* 7:1515-11157 (1993); Robinson et al., *Bio/Technology* 1:381-384 (1994), all of which are herein incorporated by reference in their entirety). The nucleic acid sequence encoding a chaperone may be obtained from the genes encoding *Aspergillus oryzae* protein disulphide isomerase, *Saccharomyces cerevisiae* calnexin, *Saccharomyces cerevisiae* BiP/GRP78 and *Saccharomyces cerevisiae* Hsp70. For further examples, see Gething and Sambrook, *Nature* 355:33-45 (1992); Hartl et al, *TIBS* 19:20-25 (1994). A processing protease is a protease that cleaves a propeptide to generate a mature biochemically active polypeptide (Enderlin and Ogrydziak, *Yeast* 10:67-79 (1994); Fuller et al., *Proc. Natl. Acad. Sci.* (*U.S.A.*) 86:1434-1438 (1989); Julius et al., *Cell* 37:1075-1089 (1984); Julius et al, *Cell* 32:839-852 (1983), all of which are incorporated by reference in their entirety). The nucleic acid sequence encoding a processing protease may be obtained from the genes encoding *Aspergillus niger* Kex2, *Saccharomyces cerevisiae* dipeptidylaminopeptidase, *Saccharomyces cerevisiae* Kex2 and *Yarrowia lipolytica* dibasic processing endoprotease (xpr6). Any factor that is functional in the fungal host cell of choice may be used in the present invention.

Fungal cells may be transformed by a process involving protoplast formation, transformation of the protoplasts and regeneration of the cell wall in a manner known per se. Suitable procedures for transformation of *Aspergillus* host cells are described in EP 238 023 and Yelton et al., *Proc. Natl. Acad. Sci.* (*U.S.A.*) 81:1470-1474 (1984), both of which are herein incorporated by reference in their entirety. A suitable method of transforming *Fusarium* species is described by Malardier et al, *Gene* 78:147-156 (1989), the entirety of which is herein incorporated by reference. Yeast may be transformed using the procedures described by Becker and Guarente, In: Abelson and Simon, (eds.), *Guide to Yeast Genetics and Molecular Biology, Methods Enzymol.* Volume 194, pp 182-187, Academic Press, Inc., New York; Ito et al., *J. Bacteriology* 153:163 (1983); Hinnen et al., *Proc. Natl. Acad. Sci.* (*U.S.A.*) 75:1920 (1978), all of which are herein incorporated by reference in their entirety.

The present invention also relates to methods of producing the protein or fragment thereof comprising culturing the recombinant fungal host cells under conditions conducive for expression of the protein or fragment thereof. The fungal cells of the present invention are cultivated in a nutrient medium suitable for production of the protein or fragment thereof using methods known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the protein or fragment thereof to be expressed and/or isolated. The cultivation takes place in a suitable nutrient medium comprising carbon and nitrogen sources and inorganic salts, using procedures known in the art (see, e.g., Bennett and LaSure (eds.), *More Gene Manipulations in Fungi*, Academic Press, CA, (1991), the entirety of which is herein incorporated by reference). Suitable media are available from commercial suppliers or may be prepared according to published compositions (e.g., in catalogues of the American Type Culture Collection, Manassas, Va.). If the protein or fragment thereof is secreted into the nutrient medium, a protein or fragment thereof can be recovered directly from the medium. If the protein or fragment thereof is not secreted, it is recovered from cell lysates.

The expressed protein or fragment thereof may be detected using methods known in the art that are specific for the particular protein or fragment. These detection methods may include the use of specific antibodies, formation of an enzyme product, or disappearance of an enzyme substrate. For example, if the protein or fragment thereof has enzymatic activity, an enzyme assay may be used. Alternatively, if polyclonal or monoclonal antibodies specific to the protein or fragment thereof are available, immunoassays may be employed using the antibodies to the protein or fragment thereof. The techniques of enzyme assay and immunoassay are well known to those skilled in the art.

The resulting protein or fragment thereof may be recovered by methods known in the arts. For example, the protein or fragment thereof may be recovered from the nutrient medium by conventional procedures including, but not limited to, centrifugation, filtration, extraction, spray-drying, evaporation, or precipitation. The recovered protein or fragment thereof may then be further purified by a variety of chromatographic procedures, e.g., ion exchange chromatography, gel filtration chromatography, affinity chromatography, or the like.

(c) Mammalian Constructs and Transformed Mammalian Cells

The present invention also relates to methods for obtaining a recombinant mammalian host cell, comprising introducing into a mammalian host cell exogenous genetic material. The present invention also relates to a mammalian cell comprising a mammalian recombinant vector. The present invention also relates to methods for obtaining a recombinant mammalian host cell, comprising introducing into a mammalian cell exogenous genetic material. In a preferred embodiment the exogenous genetic material includes a nucleic acid molecule of the present invention having a sequence selected from the group consisting of SEQ ID NO: 1 through SEQ ID NO: 7341 or complements thereof or fragments of either or other nucleic acid molecule of the present invention.

Mammalian cell lines available as hosts for expression are known in the art and include many immortalized cell lines available from the American Type Culture Collection (ATCC, Manassas, Va.), such as HeLa cells, Chinese hamster ovary (CHO) cells, baby hamster kidney (BHK) cells and a number of other cell lines. Suitable promoters for mammalian cells are also known in the art and include viral promoters such as that from Simian Virus 40 (SV40) (Fiers et al., *Nature* 273: 113 (1978), the entirety of which is herein incorporated by reference), Rous sarcoma virus (RSV), adenovirus (ADV) and bovine papilloma virus (BPV). Mammalian cells may also require terminator sequences and poly-A addition sequences. Enhancer sequences which increase expression may also be included and sequences which promote amplification of the gene may also be desirable (for example methotrexate resistance genes).

Vectors suitable for replication in mammalian cells may include viral replicons, or sequences which insure integration of the appropriate sequences encoding HCV epitopes into the host genome. For example, another vector used to express foreign DNA is vaccinia virus. In this case, for example, a nucleic acid molecule encoding a protein or fragment thereof is inserted into the vaccinia genome. Techniques for the insertion of foreign DNA into the vaccinia virus genome are known in the art and may utilize, for example, homologous recombination. Such heterologous DNA is generally inserted into a gene which is non-essential to the virus, for example, the thymidine kinase gene (tk), which also provides a selectable marker. Plasmid vectors that greatly facilitate the construction of recombinant viruses have been described (see, for example, Mackett et al, *J. Virol.* 49:857 (1984); Chakrabarti et al., *Mol. Cell. Biol.* 5:3403 (1985); Moss, In: *Gene Transfer Vectors For Mammalian Cells* (Miller and Calos, eds., Cold Spring Harbor Laboratory, N.Y., p. 10, (1987); all of which are herein incorporated by reference in their entirety). Expression of the HCV polypeptide then occurs in cells or animals which are infected with the live recombinant vaccinia virus.

The sequence to be integrated into the mammalian sequence may be introduced into the primary host by any convenient means, which includes calcium precipitated DNA, spheroplast fusion, transformation, electroporation, biolistics, lipofection, microinjection, or other convenient means. Where an amplifiable gene is being employed, the amplifiable gene may serve as the selection marker for selecting hosts into which the amplifiable gene has been introduced. Alternatively, one may include with the amplifiable gene another marker, such as a drug resistance marker, e.g. neomycin resistance (G418 in mammalian cells), hygromycin resistance etc., or an auxotrophy marker (HIS3, TRP1, LEU2, URA3, ADE2, LYS2, etc.) for use in yeast cells.

Depending upon the nature of the modification and associated targeting construct, various techniques may be employed for identifying targeted integration. Conveniently, the DNA may be digested with one or more restriction enzymes and the fragments probed with an appropriate DNA fragment which will identify the properly sized restriction fragment associated with integration.

One may use different promoter sequences, enhancer sequences, or other sequence which will allow for enhanced levels of expression in the expression host. Thus, one may combine an enhancer from one source, a promoter region from another source, a 5'-noncoding region upstream from the initiation methionine from the same or different source as the other sequences and the like. One may provide for an intron in the non-coding region with appropriate splice sites or for an alternative 3'-untranslated sequence or polyadenylation site. Depending upon the particular purpose of the modification, any of these sequences may be introduced, as desired.

Where selection is intended, the sequence to be integrated will have with it a marker gene, which allows for selection. The marker gene may conveniently be downstream from the target gene and may include resistance to a cytotoxic agent, e.g. antibiotics, heavy metals, or the like, resistance or susceptibility to HAT, gancyclovir, etc., complementation to an auxotrophic host, particularly by using an auxotrophic yeast as the host for the subject manipulations, or the like. The marker gene may also be on a separate DNA molecule, particularly with primary mammalian cells. Alternatively, one may screen the various transformants, due to the high efficiency of recombination in yeast, by using hybridization analysis, PCR, sequencing, or the like.

For homologous recombination, constructs can be prepared where the amplifiable gene will be flanked, normally on both sides with DNA homologous with the DNA of the target region. Depending upon the nature of the integrating DNA and the purpose of the integration, the homologous DNA will generally be within 100 kb, usually 50 kb, preferably about 25 kb, of the transcribed region of the target gene, more preferably within 2 kb of the target gene. Where modeling of the gene is intended, homology will usually be present proximal to the site of the mutation. The homologous DNA may include the 5'-upstream region outside of the transcriptional regulatory region or comprising any enhancer sequences, transcriptional initiation sequences, adjacent sequences, or the like. The homologous region may include a portion of the coding region, where the coding region may be comprised only of an open reading frame or combination of exons and introns. The homologous region may comprise all or a portion of an intron, where all or a portion of one or more exons may also be present. Alternatively, the homologous region may comprise the 3'-region, so as to comprise all or a portion of the transcriptional termination region, or the region 3' of this region. The homologous regions may extend over all or a portion of the target gene or be outside the target gene comprising all or a portion of the transcriptional regulatory regions and/or the structural gene.

The integrating constructs may be prepared in accordance with conventional ways, where sequences may be synthesized, isolated from natural sources, manipulated, cloned, ligated, subjected to in vitro mutagenesis, primer repair, or the like. At various stages, the joined sequences may be cloned and analyzed by restriction analysis, sequencing, or the like. Usually during the preparation of a construct where various fragments are joined, the fragments, intermediate constructs and constructs will be carried on a cloning vector comprising a replication system functional in a prokaryotic host, e.g., *E.*

*coli* and a marker for selection, e.g., biocide resistance, complementation to an auxotrophic host, etc. Other functional sequences may also be present, such as polylinkers, for ease of introduction and excision of the construct or portions thereof, or the like. A large number of cloning vectors are available such as pBR322, the pUC series, etc. These constructs may then be used for integration into the primary mammalian host.

In the case of the primary mammalian host, a replicating vector may be used. Usually, such vector will have a viral replication system, such as SV40, bovine papilloma virus, adenovirus, or the like. The linear DNA sequence vector may also have a selectable marker for identifying transfected cells. Selectable markers include the neo gene, allowing for selection with G418, the herpes tk gene for selection with HAT medium, the gpt gene with mycophenolic acid, complementation of an auxotrophic host, etc.

The vector may or may not be capable of stable maintenance in the host. Where the vector is capable of stable maintenance, the cells will be screened for homologous integration of the vector into the genome of the host, where various techniques for curing the cells may be employed. Where the vector is not capable of stable maintenance, for example, where a temperature sensitive replication system is employed, one may change the temperature from the permissive temperature to the non-permissive temperature, so that the cells may be cured of the vector. In this case, only those cells having integration of the construct comprising the amplifiable gene and, when present, the selectable marker, will be able to survive selection.

Where a selectable marker is present, one may select for the presence of the targeting construct by means of the selectable marker. Where the selectable marker is not present, one may select for the presence of the construct by the amplifiable gene. For the neo gene or the herpes tk gene, one could employ a medium for growth of the transformants of about 0.1-1 mg/ml of G418 or may use HAT medium, respectively. Where DHFR is the amplifiable gene, the selective medium may include from about 0.01-0.5 M of methotrexate or be deficient in glycine-hypoxanthine-thymidine and have dialysed serum (GHT media).

The DNA can be introduced into the expression host by a variety of techniques that include calcium phosphate/DNA co-precipitates, microinjection of DNA into the nucleus, electroporation, yeast protoplast fusion with intact cells, transfection, polycations, e.g., polybrene, polyornithine, etc., or the like. The DNA may be single or double stranded DNA, linear or circular. The various techniques for transforming mammalian cells are well known (see Keown et al., *Methods Enzymol.* (1989); Keown et al., *Methods Enzymol.* 185:527-537 (1990); Mansour et al., *Nature* 336:348-352, (1988); all of which are herein incorporated by reference in their entirety).

(d) Insect Constructs and Transformed Insect Cells

The present invention also relates to an insect recombinant vectors comprising exogenous genetic material. The present invention also relates to an insect cell comprising an insect recombinant vector. The present invention also relates to methods for obtaining a recombinant insect host cell, comprising introducing into an insect cell exogenous genetic material. In a preferred embodiment the exogenous genetic material includes a nucleic acid molecule of the present invention having a sequence selected from the group consisting of SEQ ID NO: 1 through SEQ ID NO: 7341 or complements thereof or fragments of either or other nucleic acid molecule of the present invention.

The insect recombinant vector may be any vector which can be conveniently subjected to recombinant DNA procedures and can bring about the expression of the nucleic acid sequence. The choice of a vector will typically depend on the compatibility of the vector with the insect host cell into which the vector is to be introduced. The vector may be a linear or a closed circular plasmid. The vector system may be a single vector or plasmid or two or more vectors or plasmids which together contain the total DNA to be introduced into the genome of the insect host. In addition, the insect vector may be an expression vector. Nucleic acid molecules can be suitably inserted into a replication vector for expression in the insect cell under a suitable promoter for insect cells. Many vectors are available for this purpose and selection of the appropriate vector will depend mainly on the size of the nucleic acid molecule to be inserted into the vector and the particular host cell to be transformed with the vector. Each vector contains various components depending on its function (amplification of DNA or expression of DNA) and the particular host cell with which it is compatible. The vector components for insect cell transformation generally include, but are not limited to, one or more of the following: a signal sequence, origin of replication, one or more marker genes and an inducible promoter.

The insect vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the insect cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the insect host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the insect host cell and, furthermore, may be non-encoding or encoding sequences.

Baculovirus expression vectors (BEVs) have become important tools for the expression of foreign genes, both for basic research and for the production of proteins with direct clinical applications in human and veterinary medicine (Doerfler, *Curr. Top. Microbiol. Immunol.* 131:51-68 (1968); Luckow and Summers, *Bio/Technology* 6:47-55 (1988a); Miller, *Annual Review of Microbiol.* 42:177-199 (1988); Summers, *Curr. Comm. Molecular Biology*, Cold Spring Harbor Press, Cold Spring Harbor, N.Y. (1988); all of which are herein incorporated by reference in their entirety). BEVs are recombinant insect viruses in which the coding sequence for a chosen foreign gene has been inserted behind a baculovirus promoter in place of the viral gene, e.g., polyhedrin (Smith and Summers, U.S. Pat. No. 4,745,051, the entirety of which is incorporated herein by reference).

The use of baculovirus vectors relies upon the host cells being derived from Lepidopteran insects such as *Spodoptera frugiperda* or *Trichoplusia ni*. The preferred *Spodoptera frugiperda* cell line is the cell line Sf9. The *Spodoptera frugiperda* Sf9 cell line was obtained from American Type Culture Collection (Manassas, Va.) and is assigned accession number ATCC CRL 1711 (Summers and Smith, *A Manual of Methods for Baculovirus Vectors and Insect Cell Culture Procedures*, Texas Ag. Exper. Station Bulletin No. 1555 (1988), the entirety of which is herein incorporated by reference). Other insect cell systems, such as the silkworm *B. mori* may also be used.

The proteins expressed by the BEVs are, therefore, synthesized, modified and transported in host cells derived from Lepidopteran insects. Most of the genes that have been inserted and produced in the baculovirus expression vector system have been derived from vertebrate species. Other baculovirus genes in addition to the polyhedrin promoter may be employed to advantage in a baculovirus expression system. These include immediate-early (alpha), delayed-early ( ), late ( ), or very late (delta), according to the phase of the viral infection during which they are expressed. The expression of these genes occurs sequentially, probably as the result of a "cascade" mechanism of transcriptional regulation. (Guarino and Summers, *J. Virol.* 57:563-571 (1986); Guarino and Summers, *J. Virol.* 61:2091-2099 (1987); Guarino and Summers, *Virol.* 162:444-451 (1988); all of which are herein incorporated by reference in their entirety).

Insect recombinant vectors are useful as intermediates for the infection or transformation of insect cell systems. For example, an insect recombinant vector containing a nucleic acid molecule encoding a baculovirus transcriptional promoter followed downstream by an insect signal DNA sequence is capable of directing the secretion of the desired biologically active protein from the insect cell. The vector may utilize a baculovirus transcriptional promoter region derived from any of the over 500 baculoviruses generally infecting insects, such as for example the Orders Lepidoptera, Diptera, Orthoptera, Coleoptera and Hymenoptera, including for example but not limited to the viral DNAs of *Autographa californica* MNPV, *Bombyx mori* NPV, *Trichoplusia ni* MWPV, *Rachiplusia ou* MNPV or *Galleria mellonella* MNPV, wherein said baculovirus transcriptional promoter is a baculovirus immediate-early gene IEI or IEN promoter; an immediate-early gene in combination with a baculovirus delayed-early gene promoter region selected from the group consisting of 39K and a HindIII-k fragment delayed-early gene; or a baculovirus late gene promoter. The immediate-early or delayed-early promoters can be enhanced with transcriptional enhancer elements. The insect signal DNA sequence may code for a signal peptide of a Lepidopteran adipokinetic hormone precursor or a signal peptide of the *Manduca sexta* adipokinetic hormone precursor (Summers, U.S. Pat. No. 5,155,037; the entirety of which is herein incorporated by reference). Other insect signal DNA sequences include a signal peptide of the Orthoptera Schistocerca gregaria locust adipokinetic hormone precurser and the *Drosophila melanogaster* cuticle genes CP 1, CP2, CP3 or CP4 or for an insect signal peptide having substantially a similar chemical composition and function (Summers, U.S. Pat. No. 5,155,037).

Insect cells are distinctly different from animal cells. Insects have a unique life cycle and have distinct cellular properties such as the lack of intracellular plasminogen activators in which are present in vertebrate cells. Another difference is the high expression levels of protein products ranging from 1 to greater than 500 mg/liter and the ease at which cDNA can be cloned into cells (Frasier, *In Vitro Cell. Dev. Biol.* 25:225 (1989); Summers and Smith, In: *A Manual of Methods for Baculovirus Vectors and Insect Cell Culture Procedures*, Texas Ag. Exper. Station Bulletin No. 1555 (1988), both of which are incorporated by reference in their entirety).

Recombinant protein expression in insect cells is achieved by viral infection or stable transformation. For viral infection, the desired gene is cloned into baculovirus at the site of the wild-type polyhedron gene (Webb and Summers, *Technique* 2:173 (1990); Bishop and Posse, *Adv. Gene TechNet.* 1:55 (1990); both of which are incorporated by reference in their entirety). The polyhedon gene is a component of a protein coat in occlusions which encapsulate virus particles. Deletion or insertion in the polyhedron gene results the failure to form occlusion bodies. Occlusion negative viruses are morphologically different from occlusion positive viruses and enable one skilled in the art to identify and purify recombinant viruses.

The vectors of present invention preferably contain one or more selectable markers which permit easy selection of transformed cells. A selectable marker is a gene the product of which provides, for example biocide or viral resistance, resistance to heavy metals, prototrophy to auxotrophs and the like. Selection may be accomplished by co-transformation, e.g., as described in WO 91/17243, a nucleic acid sequence of the present invention may be operably linked to a suitable promoter sequence. The promoter sequence is a nucleic acid sequence which is recognized by the insect host cell for expression of the nucleic acid sequence. The promoter sequence contains transcription and translation control sequences which mediate the expression of the protein or fragment thereof. The promoter may be any nucleic acid sequence which shows transcriptional activity in the insect host cell of choice and may be obtained from genes encoding polypeptides either homologous or heterologous to the host cell.

For example, a nucleic acid molecule encoding a protein or fragment thereof may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the insect host cell of choice may be used in the present invention.

A polyadenylation sequence may also be operably linked to the 3' terminus of the nucleic acid sequence of the present invention. The polyadenylation sequence is a sequence which when transcribed is recognized by the insect host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention.

To avoid the necessity of disrupting the cell to obtain the protein or fragment thereof and to minimize the amount of possible degradation of the expressed polypeptide within the cell, it is preferred that expression of the polypeptide gene gives rise to a product secreted outside the cell. To this end, the protein or fragment thereof of the present invention may be linked to a signal peptide linked to the amino terminus of the protein or fragment thereof. A signal peptide is an amino acid sequence which permits the secretion of the protein or fragment thereof from the insect host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof.

At present, a mode of achieving secretion of a foreign gene product in insect cells is by way of the foreign gene's native signal peptide. Because the foreign genes are usually from non-insect organisms, their signal sequences may be poorly recognized by insect cells and hence, levels of expression may be suboptimal. However, the efficiency of expression of foreign gene products seems to depend primarily on the characteristics of the foreign protein. On average, nuclear localized or non-structural proteins are most highly expressed, secreted proteins are intermediate and integral membrane proteins are the least expressed. One factor generally affecting the efficiency of the production of foreign gene products in a heterologous host system is the presence of native signal sequences (also termed presequences, targeting signals, or leader sequences) associated with the foreign gene. The signal sequence is generally coded by a DNA sequence immediately following (5' to 3') the translation start site of the desired foreign gene.

The expression dependence on the type of signal sequence associated with a gene product can be represented by the following example: If a foreign gene is inserted at a site downstream from the translational start site of the baculovirus polyhedrin gene so as to produce a fusion protein (containing the N-terminus of the polyhedrin structural gene), the fused gene is highly expressed. But less expression is achieved when a foreign gene is inserted in a baculovirus expression vector immediately following the transcriptional start site and totally replacing the polyhedrin structural gene.

Insertions into the region −50 to −1 significantly alter (reduce) steady state transcription which, in turn, reduces translation of the foreign gene product. Use of the pVL941 vector optimizes transcription of foreign genes to the level of the polyhedrin gene transcription. Even though the transcription of a foreign gene may be optimal, optimal translation may vary because of several factors involving processing: signal peptide recognition, mRNA and ribosome binding, glycosylation, disulfide bond formation, sugar processing, oligomerization, for example.

The properties of the insect signal peptide are expected to be more optimal for the efficiency of the translation process in insect cells than those from vertebrate proteins. This phenomenon can generally be explained by the fact that proteins secreted from cells are synthesized as precursor molecules containing hydrophobic N-terminal signal peptides. The signal peptides direct transport of the select protein to its target membrane and are then cleaved by a peptidase on the membrane, such as the endoplasmic reticulum, when the protein passes through it.

Another exemplary insect signal sequence is the sequence encoding for *Drosophila* cuticle proteins such as CP1, CP2, CP3 or CP4 (Summers, U.S. Pat. No. 5,278,050; the entirety of which is herein incorporated by reference). Most of a 9 kb region of the *Drosophila* genome containing genes for the cuticle proteins has been sequenced. Four of the five cuticle genes contains a signal peptide coding sequence interrupted by a short intervening sequence (about 60 base pairs) at a conserved site. Conserved sequences occur in the 5' mRNA untranslated region, in the adjacent 35 base pairs of upstream flanking sequence and at −200 base pairs from the mRNA start position in each of the cuticle genes.

Standard methods of insect cell culture, cotransfection and preparation of plasmids are set forth in Summers and Smith (Summers and Smith, *A Manual of Methods for Baculovirus Vectors and Insect Cell Culture Procedures*, Texas Agricultural Experiment Station Bulletin No. 1555, Texas A&M University (1987)). Procedures for the cultivation of viruses and cells are described in Volkman and Summers, *J. Virol* 19:820-832 (1975) and Volkman et al., *J. Virol* 19:820-832 (1976); both of which are herein incorporated by reference in their entirety.

(e) Bacterial Constructs and Transformed Bacterial Cells

The present invention also relates to a bacterial recombinant vector comprising exogenous genetic material. The present invention also relates to a bacteria cell comprising a bacterial recombinant vector. The present invention also relates to methods for obtaining a recombinant bacteria host cell, comprising introducing into a bacterial host cell exogenous genetic material. In a preferred embodiment the exogenous genetic material includes a nucleic acid molecule of the present invention having a sequence selected from the group consisting of SEQ ID NO: 1 through SEQ ID NO: 7341 or complements thereof or fragments of either or other nucleic acid molecule of the present invention.

The bacterial recombinant vector may be any vector which can be conveniently subjected to recombinant DNA procedures. The choice of a vector will typically depend on the compatibility of the vector with the bacterial host cell into which the vector is to be introduced. The vector may be a linear or a closed circular plasmid. The vector system may be a single vector or plasmid or two or more vectors or plasmids which together contain the total DNA to be introduced into the genome of the bacterial host. In addition, the bacterial vector may be an expression vector. Nucleic acid molecules encoding protein homologues or fragments thereof can, for example, be suitably inserted into a replicable vector for expression in the bacterium under the control of a suitable promoter for bacteria. Many vectors are available for this purpose and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more marker genes and an inducible promoter.

In general, plasmid vectors containing replicon and control sequences that are derived from species compatible with the host cell are used in connection with bacterial hosts. The vector ordinarily carries a replication site, as well as marring sequences that are capable of providing phenotypic selection in transformed cells. For example, *E. coli* is typically transformed using pBR322, a plasmid derived from an *E. coli* species (see, e.g., Bolivar et al., *Gene* 2:95 (1977); the entirety of which is herein incorporated by reference). pBR322 contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes.

Nucleic acid molecules encoding protein or fragments thereof may be expressed not only directly, but also as a fusion with another polypeptide, preferably a signal sequence or other polypeptide having a specific cleavage site at the N-terminus of the mature polypeptide. In general, the signal sequence may be a component of the vector, or it may be a part of the polypeptide DNA that is inserted into the vector. The heterologous signal sequence selected should be one that is recognized and processed (i.e., cleaved by a signal peptidase) by the host cell. For bacterial host cells that do not recognize and process the native polypeptide signal sequence, the signal sequence is substituted by a bacterial signal sequence-selected, for example, from the group consisting of the alkaline phosphatase, penicillinase, 1 pp, or heat-stable enterotoxin II leaders.

Both expression and cloning vectors contain a nucleic acid sequence that enables the vector to replicate in one or more selected host cells. Generally, in cloning vectors this sequence is one that enables the vector to replicate independently of the host chromosomal DNA and includes origins of replication or autonomously replicating sequences. Such sequences are well known for a variety of bacteria. The origin of replication from the plasmid pBR322 is suitable for most Gram-negative bacteria.

Expression and cloning vectors also generally contain a selection gene, also termed a selectable marker. This gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. One example of a selection scheme utilizes a drug to arrest growth of a host cell. Those cells that are successfully transformed with a heterologous protein homologue or fragment thereof produce a protein conferring drug resistance and thus survive the selection regimen.

The expression vector for producing a protein or fragment thereof can also contains an inducible promoter that is recognized by the host bacterial organism and is operably linked to the nucleic acid encoding, for example, the nucleic acid molecule encoding the protein homologue or fragment thereof of interest. Inducible promoters suitable for use with bacterial hosts include the -lactamase and lactose promoter systems (Chang et al., *Nature* 275:615 (1978); Goeddel et al., *Nature* 281:544 (1979); both of which are herein incorporated by reference in their entirety), the arabinose promoter system (Guzman et al., *J. Bacteriol.* 174:7716-7728 (1992); the entirety of which is herein incorporated by reference), alkaline phosphatase, a tryptophan (trp) promoter system (Goeddel, *Nucleic Acids Res.* 8:4057 (1980); EP 36,776; both of which are herein incorporated by reference in their entirety) and hybrid promoters such as the tac promoter (deBoer et al., *Proc. Natl. Acad. Sci.* (*USA*) 80:21-25 (1983); the entirety of which is herein incorporated by reference). However, other known bacterial inducible promoters are suitable (Siebenlist et al., *Cell* 20:269 (1980); the entirety of which is herein incorporated by reference).

Promoters for use in bacterial systems also generally contain a Shine-Dalgarno (S.D.) sequence operably linked to the DNA encoding the polypeptide of interest. The promoter can be removed from the bacterial source DNA by restriction enzyme digestion and inserted into the vector containing the desired DNA.

Construction of suitable vectors containing one or more of the above-listed components employs standard ligation techniques. Isolated plasmids or DNA fragments are cleaved, tailored and re-ligated in the form desired to generate the plasmids required. Examples of available bacterial expression vectors include, but are not limited to, the multifunctional *E. coli* cloning and expression vectors such as Bluescript™0 (Stratagene, La Jolla, Calif.), in which, for example, encoding an *A. nidulans* protein homologue or fragment thereof homologue, may be ligated into the vector in frame with sequences for the amino-terminal Met and the subsequent 7 residues of -galactosidase so that a hybrid protein is produced; pIN vectors (Van Heeke and Schuster, *J. Biol. Chem.* 264:5503-5509 (1989), the entirety of which is herein incorporated by reference); and the like. pGEX vectors (Promega, Madison Wis. U.S.A.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin or factor XA protease cleavage sites so that the cloned polypeptide of interest can be released from the GST moiety at will.

Suitable host bacteria for a bacterial vector include archaebacteria and eubacteria, especially eubacteria and most preferably Enterobacteriaceae. Examples of useful bacteria include *Escherichia, Enterobacter, Azotobacter, Erwinia, Bacillu, Pseudomonas, Klebsiella, Proteus, Salmonella, Serratia, Shigella, Rhizobia, Vitreoscilla* and *Paracoccus*. Suitable *E. coli* hosts include *E. coli* W3110 (American Type Culture Collection (ATCC) 27,325, Manassas, Va. U.S.A.), *E. coli* 294 (ATCC 31,446), *E. coli* B and *E. coli* X1776 (ATCC 31,537). These examples are illustrative rather than limiting. Mutant cells of any of the above-mentioned bacteria may also be employed. It is, of course, necessary to select the appropriate bacteria taking into consideration replicability of the replicon in the cells of a bacterium. For example, *E. coli, Serratia*, or *Salmonella* species can be suitably used as the host when well known plasmids such as pBR322, pBR325, pACYC177, or pKN410 are used to supply the replicon. *E. coli* strain W3110 is a preferred host or parent host because it is a common host strain for recombinant DNA product fermentations. Preferably, the host cell should secrete minimal amounts of proteolytic enzymes.

Host cells are transfected and preferably transformed with the above-described vectors and cultured in conventional nutrient media modified as appropriate for inducing promoters, selecting transformants, or amplifying the genes encoding the desired sequences.

Numerous methods of transfection are known to the ordinarily skilled artisan, for example, calcium phosphate and electroporation. Depending on the host cell used, transformation is done using standard techniques appropriate to such cells. The calcium treatment employing calcium chloride, as described in section 1.82 of Sambrook et al., *Molecular Cloning: A Laboratory Manual*, New York: Cold Spring Harbor Laboratory Press, (1989), is generally used for bacterial cells that contain substantial cell-wall barriers. Another method for transformation employs polyethylene glycol/DMSO, as described in Chung and Miller (Chung and Miller, *Nucleic Acids Res.* 16:3580 (1988); the entirety of which is herein incorporated by reference). Yet another method is the use of the technique termed electroporation.

Bacterial cells used to produce the polypeptide of interest for purposes of this invention are cultured in suitable media in which the promoters for the nucleic acid encoding the heterologous polypeptide can be artificially induced as described generally, e.g., in Sambrook et al., *Molecular Cloning: A Laboratory Manual*, New York: Cold Spring Harbor Laboratory Press, (1989). Examples of suitable media are given in U.S. Pat. Nos. 5,304,472 and 5,342,763; both of which are incorporated by reference in their entirety.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis: Analyzing DNA*, 1, Cold Spring Harbor, N.Y., the entirety of which is herein incorporated by reference).

(f) Computer Readable Media

The nucleotide sequence provided in SEQ ID NO: 1 through SEQ ID NO: 7341 or fragment thereof, or complement thereof, or a nucleotide sequence at least 90% identical, preferably 95%, identical even more preferably 99% or 100% identical to the sequence provided in SEQ ID NO: 1 through SEQ ID NO: 7341 or fragment thereof, or complement thereof, can be "provided" in a variety of mediums to facilitate use. Such a medium can also provide a subset thereof in a form that allows a skilled artisan to examine the sequences.

A preferred subset of nucleotide sequences are those nucleic acid sequences that encode a maize or soybean ribulose-bisphosphate carboxylase enzyme or complement thereof or fragment of either, a nucleic acid molecule that encodes a maize or soybean phosphoglycerate kinase enzyme or complement thereof or fragment of either, a nucleic acid molecule that encodes a maize or soybean glyceraldehyde 3-phosphate dehydrogenase enzyme or complement thereof or fragment of either, a nucleic acid molecule that encodes a putative maize glyceraldehyde 3-phosphate dehydrogenase enzyme or complement thereof or fragment of either, a nucleic acid molecule that encodes a maize or soybean triose phosphate isomerase enzyme or complement thereof or fragment of either, a nucleic acid molecule that encodes a maize or soybean aldolase enzyme or complement thereof or fragment of either, a nucleic acid molecule that encodes a maize or soybean fructose-1,6-bisphosphatase enzyme or complement thereof or fragment of either, a nucleic acid molecule that encodes a maize or soybean transketolase enzyme or complement thereof or fragment of either, a nucleic acid molecule that encodes a putative maize or soybean transketolase enzyme or complement thereof or fragment of either, a nucleic acid molecule that encode a maize or soybean sedoheptulose-1,7-bisphosphatase enzyme or complement thereof or fragment of either, a nucleic acid molecule that encodes a maize or soybean D-ribulose-5-phosphate-3-epimerase enzyme or complement thereof or fragment of either, a nucleic acid molecule that encodes a maize or soybean ribose-5-phosphate isomerase enzyme or complement thereof or fragment of either, a nucleic acid molecule that encodes a putative maize or soybean ribose-5-phosphate isomerase enzyme or complement thereof or fragment of either, a nucleic acid molecule that encodes a maize or soybean ribose-5-phosphate kinase enzyme or complement thereof or fragment of either, a nucleic acid molecule that encodes a maize or soybean phosphoenolpyruvate carboxylase enzyme or complement thereof or fragment of either, a nucleic acid molecule that encodes a maize or soybean NADP-dependent malate dehydrogenase enzyme or complement thereof or fragment of either, a nucleic acid molecule that encodes a maize or soybean aspartate aminotransferase enzyme or complement thereof or fragment of either, a nucleic acid molecule that encodes a putative maize or soybean aspartate aminotransferase enzyme or complement thereof or fragment of either, nucleic acid sequences that encode a maize or soybean alanine aminotransferse enzyme or complement thereof or fragment of either, a nucleic acid molecule that encodes a maize or soybean NADP-dependent malic enzyme or complement thereof or fragment of either, a nucleic acid molecule that encodes a maize or soybean NAD-dependent malic enzyme or complement thereof or fragment of either, a nucleic acid molecule that encodes a maize or soybean PEP carboxykinase enzyme or complement thereof or fragment of either, a nucleic acid molecule that encodes a putative soybean PEP carboxykinase enzyme or complement thereof or fragment of either, a nucleic acid molecule that encodes a maize or soybean pyruvate, phosphate dikinase enzyme or complement thereof or fragment of either and a nucleic acid molecule that encodes a maize or soybean pyrophosphatase enzyme or complement thereof or fragment of either.

A further preferred subset of nucleic acid sequences is where the subset of sequences which encode two proteins or fragments thereof, more preferably three proteins or fragments thereof, more preferable four proteins or fragments thereof, more preferably five proteins or fragments thereof, more preferable six proteins or fragments thereof, more preferably seven proteins or fragments thereof, more preferably eight proteins or fragments thereof, more preferable nine proteins or fragments thereof, more preferably ten proteins or fragments thereof, more preferably eleven proteins or fragments thereof, more preferable twelve proteins or fragments thereof, more preferably thirteen proteins or fragments thereof, more preferably fourteen proteins or fragments thereof, more preferable fifteen proteins or fragments thereof, more preferably sixteen proteins or fragments thereof, more preferably seventeen proteins or fragments thereof, more preferable eighteen proteins or fragments thereof, more preferably nineteen proteins or fragments thereof, more preferably twenty proteins or fragments thereof, more preferably twenty one proteins or fragments thereof, more preferable twenty two proteins or fragments thereof, more preferably twenty three proteins or fragments thereof, more preferably twenty four proteins or fragments thereof, and even more preferably twenty five proteins or fragments thereof. These nucleic acid sequences are selected from the group that encodes a maize or soybean ribulose-bisphosphate carboxylase enzyme or complement thereof or fragment of either, a nucleic acid molecule that encodes a maize or soybean phosphoglycerate kinase enzyme or complement thereof or fragment of either, a nucleic acid molecule that encodes a maize or soybean glyceraldehyde 3-phosphate dehydrogenase enzyme or complement thereof or fragment of either, a nucleic acid molecule that encodes a putative maize glyceraldehyde 3-phosphate dehydrogenase enzyme or complement thereof or fragment of either, a nucleic acid molecule that encodes a maize or soybean triose phosphate isomerase enzyme or complement thereof or fragment of either, a nucleic acid molecule that encodes a maize or soybean aldolase enzyme or complement thereof or fragment of either, a nucleic acid molecule that encodes a maize or soybean fructose-1,6-bisphosphatase enzyme or complement thereof or fragment of either, a nucleic acid molecule that encodes a maize or soybean transketolase enzyme or complement thereof or fragment of either, a nucleic acid molecule that encodes a putative maize or soybean transketolase enzyme or complement thereof or fragment of either, a nucleic acid molecule that encode a maize or soybean sedoheptulose-1,7- bisphosphatase enzyme or complement thereof or fragment of either, a nucleic acid molecule that encodes a maize or soybean D-ribulose-5-phosphate-3-epimerase enzyme or complement thereof or fragment of either, a nucleic acid molecule that encodes a maize or soybean ribose-5-phosphate isomerase enzyme or complement thereof or fragment of either, a nucleic acid molecule that encodes a putative maize or soybean ribose-5-phosphate isomerase enzyme or complement thereof or fragment of either, a nucleic acid molecule that encodes a maize or soybean ribose-5-phosphate kinase enzyme or complement thereof or fragment of either, a nucleic acid molecule that encodes a maize or soybean phosphoenolpyruvate carboxylase enzyme or complement thereof or fragment of either, a nucleic acid molecule that encodes a maize or soybean NADP-dependent malate dehydrogenase enzyme or complement thereof or fragment of either, a nucleic acid molecule that encodes a maize or soybean aspartate aminotransferase enzyme or complement thereof or fragment of either, a nucleic acid molecule that encodes a putative maize or soybean aspartate aminotransferase enzyme or complement thereof or fragment of either, nucleic acid sequences that encode a maize or soybean alanine aminotransferse enzyme or complement thereof or fragment of either, a nucleic acid molecule that encodes a maize or soybean NADP-dependent malic enzyme or complement thereof or fragment of either, a nucleic acid molecule that encodes a maize or soybean NAD-dependent malic enzyme or complement thereof or fragment of either, a nucleic acid molecule that encodes a maize or soybean PEP carboxykinase enzyme or complement thereof or fragment of either, a nucleic acid molecule that encodes a putative soybean PEP carboxykinase enzyme or complement thereof or fragment either, a nucleic acid molecule that encodes a maize or soybean pyruvate, phosphate dikinase enzyme or complement thereof or fragment of either and a nucleic acid molecule that encodes a maize or soybean pyrophosphatase enzyme or complement thereof or fragment of either.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990), the entirety of which is herein incorporated by reference) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification and DNA replication, restriction, modification, recombination and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means and data storage means used to analyze the nucleotide sequence information of the present invention. The minimum hardware means of the computer-based systems of the present invention comprises a central processing unit (CPU), input means, output means and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences the sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention.

Having now generally described the invention, the same will be more readily understood through reference to the following examples which are provided by way of illustration and are not intended to be limiting of the present invention, unless specified.

EXAMPLE 1

The MONN01 cDNA library is a normalized library generated from maize (DK604, Dekalb Genetics, Dekalb, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. The RNA is purified from the stored tissue and the cDNA library is constructed as described in Example 2.

The SATMON001 cDNA library is generated from maize (B73, Illinois Foundation Seeds, Champaign, Ill. U.S.A.) immature tassels at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation. The RNA is purified from the stored tissue and the cDNA library is constructed as described in Example 2.

The SATMON003 library is generated from maize (B173xMo17, Illinois Foundation Seeds, Champaign, Ill. U.S.A.) roots at the V6 developmental stage. Seeds are planted at a depth of approximately 3 cm in coil into 2-3 inch peat pots containing Metro 200 growing medium. After 2-3 weeks growth, the seedlings are transplanted into 10 inch pots containing the Metro 200 growing medium. Plants are watered daily before transplantation and approximately 3 times a week after transplantation. Peters 15-16-17 fertilizer is applied approximately three times per week after transplanting at a concentration of 150 ppm N. Two to three times during the life time of the plant from transplanting to flowering a total of approximately 900 mg Fe is added to each pot. Maize plants are grown in the green house in approximately 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6 leaf development stage. The root system is cut from maize plant and washed with water to free it from the soil. The tissue is then immediately frozen in liquid nitrogen. The harvested tissue is then stored at −80° C. until RNA preparation. The RNA is purified from the stored tissue and the cDNA library is constructed as described in Example 2.

The SATMON004 cDNA library is generated from maize (B73xMo17, Illinois Foundation Seeds, Champaign, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N.

Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. The RNA is purified from the stored tissue and the cDNA library is constructed as described in Example 2.

The SATMON005 cDNA library is generated from maize (B73xMo17, Illinois Foundation Seeds, Champaign Ill., U.S.A.) root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation. The RNA is purified from the stored tissue and the cDNA library is constructed as described in Example 2.

The SATMON006 cDNA library is generated from maize (B73xMo17, Illinois Foundation Seeds, Champaign Ill., U.S.A.) total leaf tissue at the V6 plant development stage. Seeds are planted at a depth of approximately 3 cm into 2-3 inch peat pots containing Metro 200 growing medium. ARer 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. The RNA is purified from the stored tissue and the cDNA library is constructed as described in Example 2.

The SATMON007 cDNA library is generated from the primary root tissue of 5 day old maize (DK604, Dekalb Genetics, Dekalb, Ill. U.S.A.) seedlings. Seeds are planted on a moist filter paper on a covered tray that is kept in the dark until germination (one day). After germination, the trays, along with the moist paper, are moved to a greenhouse where the maize plants are grown in the greenhouse in 15 hr day/9 hr night cycles for approximately 5 days. The daytime temperature is approximately 80° F. and the nighttime temperature is approximately 70° F. Supplemental lighting is provided by 1000 W sodium vapor lamps. The primary root tissue is collected when the seedlings are 5 days old. At this stage, the primary root (radicle) is pushed through the coleorhiza which itself is pushed through the seed coat. The primary root, which is about 2-3 cm long, is cut and immediately frozen in liquid nitrogen and then stored at −80° C. until RNA preparation. The RNA is purified from the stored tissue and the cDNA library is constructed as described in Example 2.

The SATMON008 cDNA library is generated from the primary shoot (coleoptile 2-3 cm) of maize (DK604, Dekalb Genetics, Dekalb, Ill. U.S.A.) seedlings which are approximately 5 days old. Seeds are planted on a moist filter paper on a covered tray that is kept in the dark until germination (one day). Then the trays containing the seeds are moved to a greenhouse at 15 hr daytime/9 hr nighttime cycles and grown until they are 5 days post germination. The daytime temperature is approximately 80° F. and the nighttime temperature is approximately 70° F. Tissue is collected when the seedlings are 5 days old. At this stage, the primary shoot (coleoptile) is pushed through the seed coat and is about 2-3 cm long. The coleoptile is dissected away from the rest of the seedling, immediately frozen in liquid nitrogen and then stored at −80° C. until RNA preparation. The RNA is purified from the stored tissue and the cDNA library is constructed as described in Example 2.

The SATMON009 cDNA library is generated from maize (DK604, Dekalb Genetics, Dekalb, Ill. U.S.A.) leaves at the 8 leaf stage (V8 plant development stage). Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the 8-leaf development stage. The older more juvenile leaves, which are in a basal position, as well as the younger more adult leaves, which are more apical, are cut at the base of the leaves. The leaves are then pooled and then immediately transferred to liquid nitrogen containers in which the pooled leaves are crushed. The harvested tissue is then stored at −80° C. until RNA preparation. The RNA is purified from the stored tissue and the cDNA library is constructed as described in Example 2.

The SATMON010 cDNA library is generated from maize (DK604, Dekalb Genetics, Dekalb, Ill. U.S.A.) root tissue at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the V8 development stage. The root system is cut from this mature maize plant and washed with water to free it from the soil. The tissue is immediately frozen in liquid nitrogen. The harvested tissue is then stored at −80° C. until RNA preparation. The RNA is purified from the stored tissue and the cDNA library is constructed as described in Example 2.

The SATMON011 cDNA library is generated from undeveloped maize (DK604, Dekalb Genetics, Dekalb, Ill. U.S.A.) leaf at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The second youngest leaf which is at the base of the apical leaf of V6 stage maize plant is cut at the base and immediately transferred to liquid nitrogen containers in which the leaf is crushed. The harvested tissue is then stored at −80° C. until RNA preparation. The RNA is purified from the stored tissue and the cDNA library is constructed as described in Example 2.

The SATMON012 cDNA library is generated from 2 day post germination maize (DK604, Dekalb Genetics, Dekalb, Ill. U.S.A.) seedlings. Seeds are planted on a moist filter paper on a covered tray that is kept in the dark until germination (one day). Then the trays containing the seeds are moved to the greenhouse and grown at 15 hr daytime/9 hr nighttime cycles until 2 days post germination. The daytime temperature is approximately 80° F. and the nighttime temperature is approximately 70° F. Tissue is collected when the seedlings are 2 days old. At the two day stage, the coleorhiza is pushed through the seed coat and the primary root (the radicle) is pierced the coleorhiza but is barely visible. Also, at this two day stage, the coleoptile is just emerging from the seed coat. The 2 days post germination seedlings are then immersed in liquid nitrogen and crushed. The harvested tissue is stored at −80° C. until preparation of total RNA. The RNA is purified from the stored tissue and the cDNA library is constructed as described in Example 2.

The SATMON013 cDNA library is generated from apical maize (DK604, Dekalb Genetics, Dekalb, Ill. U.S.A.) meristem founder at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W-sodium vapor lamps. Prior to tissue collection, the plant is at the 4 leaf stage. The lead at the apex of the V4 stage maize plant is referred to as the meristem founder. This apical meristem founder is cut, immediately frozen in liquid nitrogen and crushed. The harvested tissue is then stored at −80° C. until RNA preparation. The RNA is purified from the stored tissue and the cDNA library is constructed as described in Example 2.

The SATMON014 cDNA library is generated from maize (DK604, Dekalb Genetics, Dekalb, Ill. U.S.A.) endosperm fourteen days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the maize plant ear shoots are ready for fertilization. At this stage, the ear shoots are enclosed in a paper bag before silk emergence to withhold the pollen. The ear shoots are pollinated and 14 days after pollination, the ears are pulled out and then the kernels are plucked out of the ears. Each kernel is then dissected into the embryo and the endosperm and the aleurone layer is removed. After dissection, the endosperms are immediately frozen in liquid nitrogen and then stored at −80° C. until RNA preparation. The RNA is purified from the stored tissue and the cDNA library is constructed as described in Example 2.

The SATMON016 library is a maize (DK604, Dekalb Genetics, Dekalb, Ill. U.S.A.) sheath library collected at the V8 developmental stage. Seeds are planted in a depth of approximately 3 cm in solid into 2-3 inch pots containing Metro growing medium. After 2-3 weeks growth, they are transplanted into 10" pots containing the same. Plants are watered daily before transplantation and approximately the times a week after transplantation. Peters 15-16-17 fertilizer is applied approximately three times per week after transplanting, at a strength of 150 ppm N. Two to three times during the life time of the plant from transplanting to flowering, a total of approximately 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. When the maize plants are at the V8 stage the 51 and 6' leaves from the bottom exhibit fully developed leaf blades. At the base of these leaves, the ligule is differentiated and the leaf blade is joined to the sheath. The sheath is dissected away from the base of the leaf then the sheath is frozen in liquid nitrogen and crushed. The tissue is then stored at −80° C. until RNA preparation. The RNA is purified from the stored tissue and the cDNA library is constructed as described in Example 2.

The SATMON017 cDNA library is generated from maize (DK604, Dekalb Genetics, Dekalb, Ill. U.S.A.) embryo seventeen days after pollination. Seeds are planted at a depth of approximately 3 cm into 2-3 inch peat pots containing Metro 200 growing medium. After 2-3 weeks growth the seeds are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of maize plant, which are ready for fertilization, are enclosed in a paper bag before silk emergence to withhold the pollen. The ear shoots are fertilized and 21 days after pollination, the ears are pulled out and the kernels are plucked out of the ears. Each kernel is then dissected into the embryo and the endosperm and the aleurone layer is removed. After dissection, the embryos are immediately frozen in liquid nitrogen and then stored at −80° C. until RNA preparation. The RNA is purified from the stored tissue and the cDNA library is constructed as described in Example 2.

The SATMON019 (Lib3054) cDNA library is generated from maize (DK604, Dekalb Genetics, Dekalb, Ill. U.S.A.) culm (stem) at the V8 developmental stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. When the maize plant is at the V8 stage, the 5th and 6th leaves from the bottom have fully developed leaf blades. The region between the nodes of the 5th and the sixth leaves from the bottom is the region of the stem that is collected. The leaves are pulled out and the sheath is also torn away from the stem. This stem tissue is completely free of any leaf and sheath tissue. The stem tissue is then frozen in liquid nitrogen and stored at −80° C. until RNA preparation. The RNA is purified from the stored tissue and the cDNA library is constructed as described in Example 2.

The SATMON020 cDNA library is from a maize (DK604, Dekalb Genetics, Dekalb, Ill. U.S.A.) Hill Type II-Initiated Callus. Petri plates containing approximately 25 ml of Type II initiation media are prepared. This medium contains N6 salts and vitamins, 3% sucrose, 2.3 g/liter proline 0.1 g/liter enzymatic casein hydrolysate, 2 mg/liter 2,4-dichloro phenoxyacetic acid (2,4, D), 15.3 mg/liter AgNO$_3$ and 0.8% bacto agar and is adjusted to pH 6.0 before autoclaving. At 9-11 days after pollination, an ear with immature embryos measuring approximately 1-2 mm in length is chosen. The husks and silks are removed and then the ear is broken into halves and placed in an autoclaved solution of Clorox/TWEEN 20 sterilizing solution. Then the ear is rinsed with deionized water. Then each embryo is extracted from the kernel. Intact embryos are placed in contact with the medium, scutellar side up). Multiple embryos are plated on each plate and the plates are incubated in the dark at 25° C. Type II calluses are friable, can be subcultured with a spatula, frequently regenerate via somatic embryogenesis and are relatively undifferentiated. As seen in the microscope, the Tape II calluses show color ranging from translucent to light yellow and heterogeneity on with respect to embryoid structure as well as stage of embryoid development. Once Type II callus are formed, the calluses is transferred to type II callus maintenance medium without AgN0$_3$. Every 7-10 days, the callus is subcultured. About 4 weeks after embryo isolation the callus is removed from the plates and then frozen in liquid nitrogen. The harvested tissue is stored at −80° C. until RNA preparation. The RNA is purified from the stored tissue and the cDNA library is constructed as described in Example 2.

The SATMON021 cDNA library is generated from the immature maize (DK604, Dekalb Genetics, Dekalb Ill., U.S.A.) tassel at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. As the maize plant enters the V8 stage, tassels which are 15-20 cm in length are collected and frozen in liquid nitrogen. The harvested tissue is stored at −80° C. until RNA preparation. The RNA is purified from the stored tissue and the cDNA library is constructed as described in Example 2.

The SATMON022 cDNA library is generated from maize (DK604, Dekalb Genetics, Dekalb, Ill. U.S.A.) ear (growing silks) at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the plant is in the V8 stage. At this stage, some immature ear shoots are visible. The immature ear shoots (approximately 1 cm in length) are pulled out, frozen in liquid nitrogen and then stored at −80° C. until RNA preparation. The RNA is purified from the stored tissue and the cDNA library is constructed as described in Example 2.

The SATMON23 cDNA library is generated from maize (DK604, Dekalb Genetics, Dekalb, Ill. U.S.A.) ear (growing silk) at the V8 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. When the tissue is harvested at the V8 stage, the length of the ear that is harvested is about 10-15 cm and the silks are just exposed (approximately 1 inch). The ear along with the silks is frozen in liquid nitrogen and then the tissue is stored at −80° C. until RNA preparation. The RNA is purified from the stored tissue and the cDNA library is constructed as described in Example 2.

The SATMON024 cDNA library is generated from the immature maize (DK604, Dekalb Genetics, Dekalb, Ill. U.S.A.) tassel at the V9 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. As a maize plant enters the V9 stage, the tassel is rapidly developing and a 37 cm tassel along with the glume, anthers and pollen is collected and frozen in liquid nitrogen. The harvested tissue is stored at −80° C. until RNA preparation. The RNA is purified from the stored tissue and the cDNA library is constructed as described in Example 2.

The SATMON025 cDNA library is from maize (DK604, Dekalb Genetics, Dekalb, Ill. U.S.A.) Hill Type II-Regenerated Callus. Type II callus is grown in initiation media as described for SATMON020 and then the embryoids on the surface of the Type II callus are allowed to mature and germinate. The 1-2 gm fresh weight of the soft friable type callus containing numerous embryoids are transferred to 100×15 mm petri plates containing 25 ml of regeneration media. Regeneration media consists of Murashige and Skoog (MS) basal salts, modified White's vitamins (0.2 g/liter glycine and 0.5 g/liter myo-inositoland 0.8% bacto agar (6SMS0D)). The plates are then placed in the dark after covering with parafilm. After 1 week, the plates are moved to a lighted growth chamber with 16 hr light and 8 hr dark photoperiod. Three weeks after plating the Type II callus to 6SMS0D, the callus exhibit shoot formation. The callus and the shoots are transferred to fresh 6SMS0D plates for another 2 weeks. The callus and the shoots are then transferred to petri plates with reduced sucrose (3SMSOD). Upon distinct formation of a root and shoot, the newly developed green plants are then removed out with a spatula and frozen in liquid nitrogen containers. The harvested tissue is then stored at −80° C. until RNA preparation. The RNA is purified from the stored tissue and the cDNA library is constructed as described in Example 2.

The SATMON026 cDNA library is generated from maize (DK604, Dekalb Genetics, Dekalb, Ill. U.S.A.) juvenile/adult shift leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plants are at the 8-leaf development stage. Leaves are founded sequentially around the meristem over weeks of time and the older, more juvenile leaves arise earlier and in a more basal position than the younger, more adult leaves, which are in a more apical position. In a V8 plant, some leaves which are in the middle portion of the plant exhibit characteristics of both juvenile as well as adult leaves. They exhibit a yellowing color but also exhibit, in part, a green color. These leaves are termed juvenile/adult shift leaves. The juvenile/adult shift leaves (the 4th, 5th leaves from the bottom) are cut at the base, pooled and transferred to liquid nitrogen in which they are then crushed. The harvested tissue is then stored at −80° C. until RNA preparation. The RNA is purified from the stored tissue and the cDNA library is constructed as described in Example 2.

The SATMON027 cDNA library is generated from 6 day maize (DK604, Dekalb Genetics, Dekalb, Ill. U.S.A.) leaves. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The older, more juvenile leaves, which are in a basal position, as well as the younger, more adult leaves, which are more apical, are all cut at the base of the leaves. All the leaves exhibit significant wilting. The leaves are then pooled and immediately transferred to liquid nitrogen containers in which the pooled leaves are then crushed. The harvested tissue is then stored at −80° C. until RNA preparation. The RNA is purified from the stored tissue and the cDNA library is constructed as described in Example 2.

The SATMON028 cDNA library is generated from maize (DK604, Dekalb Genetics, Dekalb, Ill. U.S.A.) roots at the V8 developmental stage that are subject to six days water stress. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The root system is cut, shaken and washed to remove soil. Root tissue is then pooled and immediately transferred to liquid nitrogen containers in which the pooled leaves are then crushed. The harvested tissue is then stored at −80° C. until RNA preparation. The RNA is purified from the stored tissue and the cDNA library is constructed as described in Example 2.

The SATMON029 cDNA library is generated from maize (DK604, Dekalb Genetics, Dekalb, Ill. U.S.A.) seedlings at the etiolated stage. Seeds are planted on a moist filter paper on a covered tray that is kept in the dark for 4 days at approximately 70° F. Tissue is collected when the seedlings are 4 days old. By 4 days, the primary root has penetrated the coleorhiza and is about 4-5 cm and the secondary lateral roots have also made their appearance. The coleoptile has also pushed through the seed coat and is about 4-5 cm long. The seedlings are frozen in liquid nitrogen and crushed. The RNA is purified from the stored tissue and the cDNA library is constructed as described in Example 2.

The SATMON030 cDNA library is generated from maize (DK604, Dekalb Genetics, Dekalb, Ill. U.S.A.) root tissue at the V4 plant development stage. Seeds are planted at a depth of approximately 3 cm into 2-3 inch peat pots containing Metro 200 growing medium. After 2-3 weeks growth, they are transplanted into 10 inch pots containing the same. Plants are watered daily before transplantation and approximately 3 times a week after transplantation. Peters 15-16-17 fertilizer is applied approximately three times per week after transplanting, at a strength of 150 ppm N. Two to three times during the life time of the plant, from transplanting to flowering, a total of approximately 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 sodium vapor lamps. Tissue is collected when the maize plant is at the 4 leaf development stage. The root system is cut from the mature maize plant and washed with water to free it from the soil. The tissue is then immediately frozen in liquid nitrogen. The harvested tissue is then stored at −80° C. until RNA preparation. The RNA is purified from the stored tissue and the cDNA library is constructed as described in Example 2.

The SATMON031 cDNA library is generated from the maize (DK604, Dekalb Genetics, Dekalb, Ill. U.S.A.) leaf tissue at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the 4-leaf development stage. The third leaf from the bottom is cut at the base and immediately frozen in liquid nitrogen and crushed. The tissue is immediately frozen in liquid nitrogen. The harvested tissue is then stored at −80° C. until RNA preparation. The RNA is purified from the stored tissue and the cDNA library is constructed as described in Example 2.

The SATMON033 cDNA library is generated from maize (DK604, Dekalb Genetics, Dekalb, Ill. U.S.A.) embryo tissue 13 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 13 days after pollination, the ears are pulled out and then the kernels are plucked cut of the ears. Each kernel is then dissected into the embryo and the endosperm and the aleurone layer is removed. After dissection, the embryos are immediately frozen in liquid nitrogen and then stored at −80° C. until RNA preparation. The RNA is purified from the stored tissue and the cDNA library is constructed as described in Example 2.

The SATMON034 cDNA library is generated from cold stressed maize (DK604, Dekalb Genetics, Dekalb, Ill. U.S.A.) seedlings. Seeds are planted on a moist filter paper on a covered tray that is kept on at 10° C. for 7 days. After 7 days, the temperature is shifted to 15° C. for one day until germination of the seed. Tissue is collected once the seedlings are 1 day old. At this point, the coleorhiza has just pushed out of the seed coat and the primary root is just making its appearance. The coleoptile has not yet pushed completely through the seed coat and is also just making its appearance. These 1 day old cold stressed seedlings are frozen in liquid nitrogen and crushed. The harvested tissue is then stored at −80° C. until RNA preparation. The RNA is purified from the stored tissue and the cDNA library is constructed as described in Example 2.

The SATMON~001 (Lib36, Lib83, Lib84) cDNA library is generated from maize leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V8 stage. The older more juvenile leaves in a basal position was well as the younger more adult leaves which are more apical are all cut at the base, pooled and frozen in liquid nitrogen. The harvested tissue is then stored at −80° C. until RNA preparation. The RNA is purified from the stored tissue and the cDNA library is constructed as described in Example 2.

The SATMONN01 cDNA library is generated from maize (B73, Illinois Foundation Seeds, Champaign, Ill. U.S.A.) normalized immature tassels at the V6 plant development stage normalized tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation. The RNA is purified from the stored tissue and the normalized cDNA library is constructed as described in Example 2.

The SATMONN04 cDNA library is generated from maize (B73xMo17, Illinois Foundation Seeds, Champaign, Ill. U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. The RNA is purified from the stored tissue and the normalized cDNA library is constructed as described in Example 2.

The SATMONN05 cDNA library is generated from maize (B73xMo17, Illinois Foundation Seeds, Champaign Ill., U.S.A.) normalized root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation. The RNA is purified from the stored tissue and the normalized cDNA library is constructed as described in Example 2.

The SATMONN06 cDNA library is generated from maize (B73xMo17, Illinois Foundation Seeds, Champaign Ill., U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. The RNA is purified from the stored tissue and the normalized cDNA library is constructed as described in Example 2.

The CMZ029 (SATMON036) cDNA library is generated from maize (DK604, Dekalb Genetics, Dekalb, Ill. U.S.A.) endosperm 22 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 22 days after pollination, the ears are pulled out and then the kernels are plucked out of the ears. Each kernel is then dissected into the embryo and the endosperm and the alurone layer is removed. After dissection, the endosperms are immediately frozen in liquid nitrogen and then stored at −80° C. until RNA preparation. The RNA is purified from the stored tissue and the cDNA library is constructed as described in Example 2.

The CMz030 (Lib143) cDNA library is generated from maize seedling tissue two days post germination. Seeds are planted on a moist filter paper on a covered try that is keep in the dark until germination. The trays are then moved to the bench top at 15 hr daytime/9 hr nighttime cycles for 2 days post-germination. The day time temperature is 80° F. and the nighttime temperature is 70° F. Tissue is collected when the seedlings are 2 days old. At this stage, the colehrhiza has pushed through the seed coat and the primary root (the radicle) is just piercing the colehrhiza and is barely visible. The seedlings are placed at 42° C. for 1 hour. Following the heat shock treatment, the seedlings are immersed in liquid nitrogen and crushed. The harvested tissue is stored at −80° until RNA preparation. The RNA is purified from the stored tissue and the cDNA library is constructed as described in Example 2.

The CMz031 (Lib148) cDNA library is generated from maize pollen tissue at the V 10+plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag to withhold pollen. Twenty-one days after pollination, prior to removing the ears, the paper bag is shaken to collect the mature pollen. The mature pollen is immediately frozen in liquid nitrogen containers and the pollen is crushed. The harvested tissue is then stored at −80° C. until RNA preparation. The RNA is purified from the stored tissue and the cDNA library is constructed as described in Example 2.

The CMz033 (Lib189) cDNA library is generated from maize pooled leaf tissue. Samples are harvested from open pollinated plants. Tissue is collected from maize leaves at the anthesis stage. The leaves are collect from from 10-12 plants and frozen in liquid nitrogen. The harvested tissue is then stored at −80° C. until RNA preparation. The RNA is purified from the stored tissue and the cDNA library is constructed as described in Example 2.

The CMz034 (Lib3060) cDNA library is generated from maize mature tissue at 40 days post pollination plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from leaves located two leaves below the ear leaf. This sample represents those genes expressed during onset and early stages of leaf senescence. The leaves are pooled and immediately transferred to liquid nitrogen. The harvested tissue is then stored at −80° C. until RNA preparation. The RNA is purified from the stored tissue and the cDNA library is constructed as described in Example 2.

The CMz035 (Lib3061) cDNA library is generated from maize endosperm tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag prior to silk emergence to withhold pollen. Thirty-two days after pollination, the ears are pulled out and the kernels are removed from the cob. Each kernel is dissected into the embryo and the endosperm and the aleurone layer is removed. After dissection, the endosperms are immediately transferred to liquid nitrogen. The harvested tissue is then stored at 80° C. until RNA preparation. The RNA is purified from the stored tissue and the cDNA library is constructed as described in Example 2.

The CMz036 (Lib3062) cDNA library is generated from maize husk tissue at the 8 week old plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from 8 week old plants. The husk is separated from the ear and immediately transferred to liquid nitrogen containers. The harvested tissue is then stored at −80° C. until RNA preparation. The RNA is purified from the stored tissue and the cDNA library is constructed as described in Example 2.

The CMz037 (Lib3059) cDNA library is generated from maize pooled kernal at 12-15 days after pollienation plant development stage. Sample were collected from field grown material. Whole kernals from hand pollinated (control pollination) are harvested as whole ears and immediately frozen on dry ice. Kernels from 10-12 ears were pooled and ground together in liquid nitrogen. The harvested tissue is then stored at −80° C. until RNA preparation. The RNA is purified from the stored tissue and the cDNA library is constructed as described in Example 2.

The CMz039 (Lib3066) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately frozen in liquid nitrogen. The harvested tissue is then stored at −80° C. until RNA preparation. The RNA is purified from the stored tissue and the cDNA library is constructed as described in Example 2.

The CMz040 (Lib3067) cDNA library is generated from maize kernel tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag before silk emergence to withhold pollen. Five to eight days after controlled pollination. The ears are pulled and the kernels removed. The kernels are immediately frozen in liquid nitrogen. This sample represents genes expressed in early kernel development, during periods of cell division, amyloplast biogenesis and early carbon flow across the material to filial tissue. The harvested kernels tissue is then stored at −80° C. until RNA preparation. The RNA is purified from the stored tissue and the cDNA library is constructed as described in Example 2.

The CMz041 (Lib3068) cDNA library is generated from maize pollen germinating silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants when the ear shoots are ready for fertilization at the silk emergence stage. The emerging silks are pollinated with an excess of pollen under controlled pollination conditions in the green house. Eighteen hours after pollination the silks are removed from the ears and immediately frozen in liquid nitrogen. This sample represents genes expressed in both pollen and silk tissue early in pollination. The harvested tissue is then stored at −80° C. until RNA preparation. The RNA is purified from the stored tissue and the cDNA library is constructed as described in Example 2.

The CMz042 (Lib3069) cDNA library is generated from maize ear tissue excessively pollinated at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000-W sodium vapor lamps. Tissue is collected from V10+ stage plants and the ear shoots which are ready for fertilization are at the silk emergence stage. The immature ears are pollinated with an excess of pollen under controlled pollination conditions. Eighteen hours post-pollination, the ears are removed and immediately transferred to liquid nitrogen containers. The harvested tissue is then stored at −80° C. until RNA preparation. The RNA is purified from the stored tissue and the cDNA library is constructed as described in Example 2.

The CMz044 (Lib3075) cDNA library is generated from maize microspore tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature anthers from 7 week old tassels. The immature anthers are first dissected from the 7 week old tassel with a scalpel on a glass slide covered with water. The microspores (immature pollen) are released into the water and are recovered by centrifugation. The microspore suspension is immediately frozen in liquid nitrogen. The harvested tissue is then stored at −80° C. until RNA preparation. The RNA is purified from the stored tissue and the cDNA library is constructed as described in Example 2.

The CMz045 (Lib3076) cDNA library is generated from maize immature ear megaspore tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature ear (megaspore) obtained from 7 week old plants. The immature ears are harvested from the 7 week old plants and are approximately 2.5 to 3 cm in length. The kernels are removed from the cob immediately frozen in liquid nitrogen. The harvested tissue is then stored at −80° C. until RNA preparation. The RNA is purified from the stored tissue and the cDNA library is constructed as described in Example 2.

The CMz047 (Lib3078) cDNA library is generated from maize $CO_2$ treated high-exposure shoot tissue at the V10+ plant development stage. RX601 maize seeds are sterilized for i minute with a 10% clorox solution. The seeds are rolled in germination paper, and germinated in 0.5 mM calcium sulfate solution for two days ate 30° C. The seedlings are planted at a depth of approximately 3 cm into 2-3 inch peat pots containing Metro 200 growing medium at a rate of 2-3 seedlings per pot. Twenty pots are placed into a high $CO_2$ environment (approximately 1000 ppm $CO_2$). Twenty plants were grown under ambient greenhouse $CO_2$ (approximately 450 ppm $CO_2$). Plants are watered daily before transplantation and three times a week after transplantation. Peters 20-20-20 fertilizer is also lightly applied. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. At ten days post planting, the shoots from both atmosphere are frozen in liquid nitrogen and lightly ground. The roots are washed in deionized water to remove the support media and the tissue is immediately transferred to liquid nitrogen containers. The harvested tissue is then stored at −80° C. until RNA preparation. The RNA is purified from the stored tissue and the cDNA library is constructed as described in Example 2.

The CMz048 (Lib3079) cDNA library is generated from maize basal endosperm transfer layer tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ maize plants. The ear shoots, which are ready for fertilization, are enclosed in a paper bag prior to silk emergence, to withhold the pollen. Kernels are harvested at 12 days post-pollination and placed on wet ice for dissection. The kernels are cross sectioned laterally, dissecting just above the pedicel region, including 1-2 mm of the lower endosperm and the basal endosperm transfer region. The pedicel and lower endosperm region containing the basal endosperm transfer layer is pooled and immediately frozen in liquid nitrogen. The harvested tissue is then stored at −80° C. until RNA preparation. The RNA is purified from the stored tissue and the cDNA library is constructed as described in Example 2.

The CMz049 (Lib3088) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately transferred to liquid nitrogen container. The harvested tissue is then stored at −80° C. until RNA preparation. The RNA is purified from the stored tissue and the cDNA library is constructed as described in Example 2.

The CMz050 (Lib3114) cDNA library is generated from maize silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is beyond the 10-leaf development stage and the ear shoots are approximately 15-20 cm in length. The ears are pulled and silks are separated from the ears and immediately transferred to liquid nitrogen containers. The harvested tissue is then stored at −80° C. until RNA preparation. The RNA is purified from the stored tissue and the cDNA library is constructed as described in Example 2.

The SOYMON001 cDNA library is generated from soybean cultivar Asgrow 3244 (Asgrow Seed Company, Des Moines, Iowa U.S.A.) total leaf tissue at the V4 plant development stage. Leaf tissue from 38, field grown V4 stage plants is harvested from the $4^{th}$ node. Leaf tissue is removed from the plants and immediately frozen in dry-ice. The harvested tissue is then stored at −80° C. until RNA preparation. The RNA is purified from the stored tissue and the cDNA library is constructed as described in Example 2.

The SOYMON002 cDNA library is generated from soybean cultivar Asgrow 3244 (Asgrow Seed Company, Des Moines, Iowa U.S.A.) root tissue at the V4 plant development stage. Root tissue from 76, field grown V4 stage plants is harvested. The root systems is cut from the soybean plant and washed with water to free it from the soil and immediately frozen in dry-ice. The harvested tissue is then stored at −80° C. until RNA preparation. The RNA is purified from the stored tissue and the cDNA library is constructed as described in Example 2.

The SOYMON003 cDNA library is generated from soybean cultivar Asgrow 3244 (Asgrow Seed Company, Des Moines, Iowa U.S.A.) seedling hypocotyl axis tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation. The RNA is purified from the stored tissue and the cDNA library is constructed as described in Example 2.

The SOYMON004 cDNA library is generated from soybean cultivar Asgrow 3244 (Asgrow Seed Company, Des Moines, Iowa U.S.A.) seedling cotyledon tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation. The RNA is purified from the stored tissue and the cDNA library is constructed as described in Example 2.

The SOYMON005 cDNA library is generated from soybean cultivar Asgrow 3244 (Asgrow Seed Company, Des Moines, Iowa U.S.A.) seedling hypocotyl axis tissue harvested 6 hour post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after the start of imbibition. The 6 hours after imbibition samples are separated into 3 collections after removal of any adhering seed coat. The 6 hours after imbibition sample is collected over the course of approximately 2 hours starting at 6 hours post imbibition. At the 6 hours after imbibition stage, not all cotyledons have become fully hydrated and germination, or radicle protrusion, has not occurred. The seedlings are washed in water to remove soil, hypocotyl axis harvested and immediately frozen in liquid nitrogen. The harvested tissue is then stored at −80° C. until RNA preparation. The RNA is purified from the stored tissue and the cDNA library is constructed as described in Example 2.

The SOYMON006 cDNA library is generated from soybean cultivar Asgrow 3244 (Asgrow Seed Company, Des Moines, Iowa U.S.A.) seedling cotyledons tissue harvest 6 hour post-imbibition. Seeds are planted at a depth of approximately 2 cm into 2-3 inch peat pots containing Metromix 350 medium. Trays are placed in an environmental chamber and grown at 12 hr daytime/12 hr nightime cycles. The daytime temperature is approximately 29° C. and the nighttime temperature approximately 24° C. Soil is checked and watered daily to maintain even moisture conditions. Tissue is collected 6 hours after imbibition. The 6 hours after imbibition samples are separated into 3 collections after removal of any adhering seed coat. The 6 hours after imbibition sample is collected over the course of approximately 2 hours starting at 6 hours post-imbibition. At the 6 hours after imbibition, not all cotyledons have become fully hydrated and germination or radicle protrusion, have not occurred. The seedlings are washed in water to remove soil, cotyledon harvested and immediately frozen in liquid nitrogen. The harvested tissue is then stored at −80° C. until RNA preparation. The RNA is purified from the stored tissue and the cDNA library is constructed as described in Example 2.

The SOYMON007 cDNA library is generated from soybean cultivar Asgrow 3244 (Asgrow Seed Company, Des Moines, Iowa U.S.A.) seed tissue harvested 25 and 35 days post-flowering. Seed pods from field grown plants are harvested 25 and 35 days after flowering and the seeds extracted from the pods. Approximately 4.4 g and 19.3 g of seeds are harvested from the respective seed pods and immediately frozen in dry ice. The harvested tissue is then stored at −80° C. until RNA preparation. The RNA is purified from the stored tissue and the cDNA library is constructed as described in Example 2.

The SOYMON008 cDNA library is generated from soybean cultivar Asgrow 3244 (Asgrow Seed Company, Des Moines, Iowa U.S.A.) leaf tissue harvested from 25 and 35 days post-flowering plants. Total leaf tissue is harvested from field grown plants. Approximately 19 g and 29 g of leaves are harvested from the fourth node of the plant 25 and 35 days post-flowering and immediately frozen in dry ice. The harvested tissue is then stored at −80° C. until RNA preparation. The RNA is purified from the stored tissue and the cDNA library is constructed as described in Example 2.

The SOYMON009 cDNA library is generated from soybean cutlivar C1944 (USDA Soybean Germplasm Collection, Urbana, Ill. U.S.A.) pod and seed tissue harvested 15 days post-flowering. Pods from field grown plants are harvested 15 days post-flowering. Approximately 3 g of pod tissue is harvested and immediately frozen in dry-ice. The harvested tissue is then stored at −80° C. until RNA preparation. The RNA is purified from the stored tissue and the cDNA library is constructed as described in Example 2.

The SOYMON010 cDNA library is generated from soybean cultivar C1944 (USDA Soybean Germplasm Collection, Urbana, Ill. U.S.A.) seed tissue harvested 40 days post-flowering. Pods from field grown plants are harvested 40 days post-flowering. Pods and seeds are separated, approximately 19 g of seed tissue is harvested and immediately frozen in dry-ice. The harvested tissue is then stored at −80° C. until RNA preparation. The RNA is purified from the stored tissue and the cDNA library is constructed as described in Example 2.

The SOYMON011 cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation. The RNA is purified from the stored tissue and the cDNA library is constructed as described in Example 2.

The SOYMON012 cDNA library is generated from soybean cultivar Asgrow 3244 (Asgrow Seed Company, Des Moines, Iowa U.S.A.) leaf tissue. Leaves from field grown plants are harvested from the fourth node 15 days post-flowering. Approximately 12 g of leaves are harvested and immediately frozen in dry ice. The harvested tissue is then stored at −80° C. until RNA preparation. The RNA is purified from the stored tissue and the cDNA library is constructed as described in Example 2.

The SOYMON013 cDNA library is generated from soybean cultivar Asgrow 3244 (Asgrow Seed Company, Des Moines, Iowa U.S.A.) root and nodule tissue. Approximately, 28 g of root tissue from field grown plants is harvested 15 days post-flowering. The root system is cut from the soybean plant, washed with water to free it from the soil and immediately frozen in dry-ice. The harvested tissue is then stored at −80° C. until RNA preparation. The RNA is purified from the stored tissue and the cDNA library is constructed as described in Example 2.

The SOYMON014 cDNA library is generated from soybean cultivar Asgrow 3244 (Asgrow Seed Company, Des Moines, Iowa U.S.A.) seed tissue harvested 25 and 35 days after flowering. Seed pods from field grown plants are harvested 15 days after flowering and the seeds extracted from the pods. Approximately 5 g of seeds are harvested from the respective seed pods and immediately frozen in dry ice. The harvested tissue is then stored at −80° C. until RNA preparation. The RNA is purified from the stored tissue and the cDNA library is constructed as described in Example 2.

The SOYMON015 cDNA is generated from soybean cultivar Asgrow 3244 (Asgrow Seed Company, Des Moines, Iowa U.S.A.) seed tissue harvested 45 and 55 days post-flowering. Seed pods from field grown plants are harvested 45 and 55 days after flowering and the seeds extracted from the pods. Approximately 19 g and 31 g of seeds are harvested from the respective seed pods and immediately frozen in dry ice. The harvested tissue is then stored at −80° C. until RNA preparation. The RNA is purified from the stored tissue and the cDNA library is constructed as described in Example 2.

The SOYMON016 cDNA library is generated from soybean cultivar Asgrow 3244 (Asgrow Seed Company, Des Moines, Iowa U.S.A.) root tissue. Approximately, 61 g and 38 g of root tissue from field grown plants is harvested 25 and 35 days post-flowering is harvested. The root system is cut from the soybean plant and washed with water to free it from the soil. The tissue is placed in 14 ml polystyrene tubes and immediately frozen in dry-ice. The harvested tissue is then stored at −80° C. until RNA preparation. The RNA is purified from the stored tissue and the cDNA library is constructed as described in Example 2.

The SOYMON017 cDNA library is generated from soybean cultivar Asgrow 3244 (Asgrow Seed Company, Des Moines, Iowa U.S.A.) root tissue. Approximately 28 g of root tissue from field grown plants is harvested 45 and 55 days post-flowering. The root system is cut from the soybean plant, washed with water to free it from the soil and immediately frozen in dry-ice. The harvested tissue is then stored at −80° C. until RNA preparation. The RNA is purified from the stored tissue and the cDNA library is constructed as described in Example 2.

The SOYMON018 cDNA is generated from soybean cultivar Asgrow 3244 (Asgrow Seed Company, Des Moines, Iowa U.S.A.) leaf tissue harvested 45 and 55 days post-flowering. Leaves from field grown plants are harvested 45 and 55 days after flowering from the fourth node. Approximately 27 g and 33 g of seeds are harvested from the respective seed pods and immediately frozen in dry ice. The harvested tissue is then stored at −80° C. until RNA preparation. The RNA is purified from the stored tissue and the cDNA library is constructed as described in Example 2.

The SOYMON019 cDNA library is generated from soybean cultivars Cristalina (USDA Soybean Germplasm Collection, Urbana, Ill. U.S.A.) and FT108 (Monsoy, Brazil) (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation. The RNA is purified from the stored tissue and the cDNA library is constructed as described in Example 2.

The SOYMON020 cDNA is generated from soybean cultivar Asgrow 3244 (Asgrow Seed Company, Des Moines, Iowa U.S.A.) seed tissue harvested 65 and 75 days post-flowering. Seed pods from field grown plants are harvested 45 and 55 days after flowering and the seeds extracted from the pods. Approximately 14 g and 31 g of seeds are harvested from the respective seed pods and immediately frozen in dry ice. The harvested tissue is then stored at −80° C. until RNA preparation. The RNA is purified from the stored tissue and the cDNA library is constructed as described in Example 2.

The SOYMON021 cDNA library is generated from Soybean Cyst Nematode-resistant soybean cultivar Hartwig (USDA Soybean Germplasm Collection, Urbana, Ill. U.S.A.) root tissue. Plants are grown in tissue culture at room temperature. At approximately 6 weeks post-germination, the plants are exposed to sterilized Soybean Cyst Nematode eggs. Infection is then allowed to progress for 10 days. After the 10 day infection process, the tissue is harvested. Agar from the culture medium and nematodes are removed and the root tissue is immediately frozen in dry ice. The harvested tissue is then stored at −80° C. until RNA preparation. The RNA is purified from the stored tissue and the cDNA library is constructed as described in Example 2.

The SOYMON022 (Lib3030) cDNA library is generated from soybean cultivar Asgrow 3244 (Asgrow Seed Company, Des Moines, Iowa U.S.A.) partially opened flower tissue. Partially to fully opened flower tissue is harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. A total of 3 g of flower tissue is harvested and immediately frozen in dry ice. The harvested tissue is then stored at −80° C. until RNA preparation. The RNA is purified from the stored tissue and the cDNA library is constructed as described in Example 2.

The SOYMON023 cDNA library is generated from soybean genotype BW211S Null (Tohoku University, Morioka, Japan) seed tissue harvested 15 and 40 days post-flowering. Seed pods from field grown plants are harvested 15 and 40 days post-flowering and the seeds extracted from the pods. Approximately 0.7 g and 14.2 g of seeds are harvested from the respective seed pods and immediately frozen in dry ice. The harvested tissue is then stored at −80° C. until RNA preparation. The RNA is purified from the stored tissue and the cDNA library is constructed as described in Example 2.

The SOYMON024 cDNA library is generated from soybean cultivar Asgrow 3244 (Asgrow Seed Company, Des Moines, Iowa U.S.A.) internode-2 tissue harvested 18 days post-imbibition. Seeds are planted at a depth of approximately 2 cm into 2-3 inch peat pots containing Metromix 350 medium. The plants are grown in a greenhouse for 18 days after the start of imbibition at ambient temperature. Soil is checked and watered daily to maintain even moisture conditions. Stem tissue is harvested 18 days after the start of imbibition. The samples are divided into hypocotyl and internodes 1 through 5. The fifth internode contains some leaf bud material. Approximately 3 g of each sample is harvested and immediately frozen in dry ice. The harvested tissue is then stored at −80° C. until RNA preparation. The RNA is purified from the stored tissue and the cDNA library is constructed as described in Example 2.

The SOYMON025 cDNA library is generated from soybean cultivar Asgrow 3244 (Asgrow Seed Company, Des Moines, Iowa U.S.A.) leaf tissue harvested 65 days post-flowering. Leaves are harvested from the fourth node of field grown plants 65 days post-flowering. Approximately 18.4 g of leaf tissue is harvested and immediately frozen in dry ice. The harvested tissue is then stored at −80° C. until RNA preparation. The RNA is purified from the stored tissue and the cDNA library is constructed as described in Example 2.

SOYMON026 cDNA library is generated from soybean cultivar Asgrow 3244 (Asgrow Seed Company, Des Moines, Iowa U.S.A.) root tissue harvested 65 and 75 days post-flowering. Approximately 27 g and 40 g of root tissue from field grown plants is harvested 65 and 75 days post-flowering. The root system is cut from the soybean plant, washed with water to free it from the soil and immediately frozen in dry-ice. The harvested tissue is then stored at −80° C. until RNA preparation. The RNA is purified from the stored tissue and the cDNA library is constructed as described in Example 2.

The SOYMON027 cDNA library is generated from soybean cultivar Asgrow 3244 (Asgrow Seed Company, Des Moines, Iowa U.S.A.) pod tissue, without seeds, harvested 25 days post-flowering. Seed pods from field grown plants are harvested 25 days post-flowering and the seeds extracted from the pods. Approximately 17 g of seed pod tissue is harvested and immediately frozen in dry-ice. The harvested tissue is then stored at −80° C. until RNA preparation. The RNA is purified from the stored tissue and the cDNA library is constructed as described in Example 2.

The SOYMON028 cDNA library is generated from soybean cultivar Asgrow 3244 (Asgrow Seed Company, Des Moines, Iowa U.S.A.) drought-stressed root tissue. The plants are grown in an environmental chamber under 12 hr daytime/12 hr nighttime cycles. The daytime temperature is approximately 29° C. and the nighttime temperature 24° C. Soil is checked and watered daily to maintain even moisture conditions. At the R3 stage of development, water is withheld from half of the plant collection (drought stressed population). After 3 days, half of the plants from the drought stressed condition and half of the plants from the control population are harvested. After another 3 days (6 days post drought induction) the remaining plants are harvested. A total of 27 g and 40 g of root tissue is harvested and immediately frozen in dry ice. The harvested tissue is then stored at −80° C. until RNA preparation. The RNA is purified from the stored tissue and the cDNA library is constructed as described in Example 2.

The SOYMON029 cDNA library is generated from Soybean Cyst Nematode-resistant soybean cultivar PI07354 (USDA Soybean Germplasm Collection, Urbana, Ill. U.S.A.) root tissue. Late fall to early winter greenhouse grown plants are exposed to Soybean Cyst Nematode eggs. At 10 days post-infection, the plants are uprooted, rinsed briefly and the roots frozen in liquid nitrogen. Approximately 20 grams of root tissue is harvested from the infected plants. The harvested tissue is then stored at −80° C. until RNA preparation. The RNA is purified from the stored tissue and the cDNA library is constructed as described in Example 2.

The SOYMON030 cDNA library is generated from soybean cultivar Asgrow 3244 (Asgrow Seed Company, Des Moines, Iowa U.S.A.) flower bud tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. A total of 100 mg of flower buds are harvested and immediately frozen in liquid nitrogen. The harvested tissue is then stored at −80° C. until RNA preparation. The RNA is purified from the stored tissue and the cDNA library is constructed as described in Example 2.

The SOYMON031 cDNA library is generated from soybean cultivar Asgrow 3244 (Asgrow Seed Company, Des Moines, Iowa U.S.A.) carpel and stamen tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. Flowers are dissected to separate petals, sepals and reproductive structures (carpels and stamens). A total of 300 mg of carpel and stamen tissue are harvested and immediately frozen in liquid nitrogen. The harvested tissue is then stored at −80° C. until RNA preparation. The RNA is purified from the stored tissue and the cDNA library is constructed as described in Example 2.

The SOYMON032 cDNA library is prepared from the Asgrow cultivar A4922 (Asgrow Seed Company, Des Moines, Iowa U.S.A.) rehydrated dry soybean seed meristem tissue. Surface sterilized seeds are germinated in liquid media for 24 hours. The seed axis is then excised from the barely germinating seed, placed on tissue culture media and incubated overnight at 20° C. in the dark. The supportive tissue is removed from the explant prior to harvest. Approximately 570 mg of tissue is harvested and frozen in liquid nitrogen. The harvested tissue is then stored at −80° C. until RNA preparation. The RNA is purified from the stored tissue and the cDNA library is constructed as described in Example 2.

The SOYMON033 cDNA library is generated from soybean cultivar Asgrow 3244 (Asgrow Seed Company, Des Moines, Iowa U.S.A.) heat-shocked seedling tissue without cotyledons. Seeds are imbibed and germinated in vermiculite for 2 days under constant illumination. After 48 hours, the seedlings are transferred to an incubator set at 40° C. under constant illumination. After 30, 60 and 180 minutes seedlings are harvested and dissected. A portion of the seedling consisting of the root, hypocotyl and apical hook is frozen in liquid nitrogen and stored at −80° C. The seedlings after 2 days of imbibition are beginning to emerge from the vermiculite surface. The apical hooks are dark green in appearance. Total RNA and poly A+ RNA is prepared from equal amounts of pooled tissue. The RNA is purified from the stored tissue and the cDNA library is constructed as described in Example 2.

The SOYMON034 cDNA library is generated from soybean cultivar Asgrow 3244 (Asgrow Seed Company, Des Moines, Iowa U.S.A.) cold-shocked seedling tissue without cotyledons. Seeds are imbibed and germinated in vermiculite for 2 days under constant illumination. After 48 hours, the seedlings are transferred to a cold room set at 5° C. under constant illumination. After 30, 60 and 180 minutes seedlings are harvested and dissected. The seedlings after 2 days of imbibition are beginning to emerge from the vermiculite surface. The apical hooks are dark green in appearance. A portion of the seedling consisting of the root, hypocotyl and apical hook is frozen in liquid nitrogen and stored at −80° C. The RNA is purified from the stored tissue and the cDNA library is constructed as described in Example 2.

The SOYMON035 cDNA library is generated from soybean cultivar Asgrow 3244 (Asgrow Seed Company, Des Moines, Iowa U.S.A.) seed coat tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are harvested from mid to nearly full maturation (seed coats are not yellowing). The entire embryo proper is removed from the seed coat sample and the seed coat tissue are harvested and immediately frozen in liquid nitrogen. The harvested tissue is then stored at −80° C. until RNA preparation. The RNA is purified from the stored tissue and the cDNA library is constructed as described in Example 2.

The SOYMON036 cDNA library is generated from soybean cultivars PI171451, PI227687 and PI229358 (USDA Soybean Germplasm Collection, Urbana, Ill. U.S.A.) insect challenged leaves. Plants from each of the three cultivars are grown in screenhouse conditions. The screenhouse is divided in half and one half of the screenhouse is infested with soybean looper and the other half infested with velvetbean caterpillar. A single leaf is taken from each of the representative plants at 3 different time points, 11 days after infestation, 2 weeks after infestation and 5 weeks after infestation and immediately frozen in liquid nitrogen. The harvested tissue is then stored at −80° C. until RNA preparation. Total RNA and poly A+ RNA is isolated from pooled tissue consisting of equal quantities of all 18 samples (3 genotypes×3 sample times×2 insect genotypes). The RNA is purified from the stored tissue and the cDNA library is constructed as described in Example 2.

The SOYMON037 cDNA library is generated from soybean cultivar A3244 (Asgrow Seed Company, Des Moines, Iowa U.S.A.) etiolated axis and radical tissue. Seeds are planted in moist vermiculite, wrapped and kept at room temperature in complete darkness until harvest. Etiolated axis and hypocotyl tissue is harvested at 2, 3 and 4 days postplanting. A total of 1 gram of each tissue type is harvested at 2, 3 and 4 days after planting and immediately frozen in liquid nitrogen. The harvested tissue is then stored at −80° C. until RNA preparation. The RNA is purified from the stored tissue and the cDNA library is constructed as described in Example 2.

The SOYMON038 cDNA library is generated from soybean variety Asgrow A3237 (Asgrow Seed Company, Des Moines, Iowa U.S.A.) rehydrated dry seeds. Explants are prepared for transformation after germination of surface-sterilized seeds on solid tissue media. After 6 days, at 28° C. and 18 hours of light per day, the germinated seeds are cold shocked at 4° C. for 24 hours. Meristemic tissue and part of the hypocotyl is remove and cotyledon excised. The prepared explant is then wounded for *Agrobacterium* infection. The 2 grams of harvested tissue is frozen in liquid nitrogen and stored at −80° C. until RNA preparation. The RNA is purified from the stored tissue and the cDNA library is constructed as described in Example 2.

The Soy5 (LIB3027) normalized seed pool cDNA library is prepared from equal amounts tissue harvested from SOYMON007, SOYMON015 and SOYMON020 prepared tissue. Single stranded and double stranded DNA representing approximately 1×10⁶ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The Soy52 (LIB3028) cDNA library is generated from normalized flower DNA. Single stranded DNA representing approximately 1×10⁶ colony forming units of SOYMON022 harvested tissue is used as the starting material for normalization. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are converted to double stranded form and represent the primary normalized library.

The Soy53 (LIB3039) cDNA library is generated from soybean cultivar Asgrow 3244 (Asgrow Seed Company, Des Moines, Iowa U.S.A.) seedling shoot apical meristem tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Apical tissue is harvested from seedling shoot meristem tissue, 7-8 days after the start of imbibition. The apex of each seedling is dissected to include the fifth node to the apical meristem. The fifth node corresponds to the third trifoliate leaf in the very early stages of development. Stipules completely envelop the leaf primordia at this time. A total of 200 mg of apical tissue is harvested and immediately frozen in liquid nitrogen. The harvested tissue is then stored at −80° C. until RNA preparation. The RNA is purified from the stored tissue and the cDNA library is constructed as described in Example 2.

The Soy54 (LIB3040) cDNA library is generated from soybean cultivar Asgrow 3244 (Asgrow Seed Company, Des Moines, Iowa U.S.A.) heart to torpedo stage embryo tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected and embryos removed from surrounding endosperm and maternal tissues. Embryos from globular to young torpedo stages (by corresponding analogy to *Arabidopsis*) are collected with a bias towards the middle of this spectrum. Embryos which are beginning to show asymmetric development of cotyledons are considered the upper developmental boundary for the collection and are excluded. A total of 12 mg embryo tissue is frozen in liquid nitrogen. The harvested tissue is stored at −80° C. until RNA preparation. The RNA is purified from the stored tissue and the cDNA library is constructed as described in Example 2.

Soy55 (LIB3049) cDNA library is generated from soybean cultivar Asgrow 3244 (Asgrow Seed Company, Des Moines, Iowa U.S.A.) young seed tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected from very young pods (5 to 15 days after flowering). A total of 100 mg of seeds are harvested and frozen in liquid nitrogen. The harvested tissue is stored at −80° C. until RNA preparation. The RNA is purified from the stored tissue and the cDNA library is constructed as described in Example 2.

Soy56 (LIB3029) non-normalized seed pool cDNA library is prepared from equal amounts tissue harvested from SOYMON007, SOYMON015 and SOYMON020 prepared tissue. Single stranded and double stranded DNA representing approximately $1\times10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single stranded molecules remaining after hybrid capture are not converted to double stranded form and represent a non-normalized seed pool for comparison to Soy51 cDNA libraries.

The Soy58 (LIB3050) cDNA library is generated from soybean cultivar Asgrow 3244 (Asgrow Seed Company, Des Moines, Iowa U.S.A.) drought stressed root tissue subtracted from control root tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. At the R3 stage of the plant drought is induced by withholding water. After 3 and 6 days root tissue from both drought stressed and control (watered regularly) plants are collected and frozen in dry-ice. The harvested tissue is stored at −80° C. until RNA preparation. The RNA is prepared from the stored tissue and the subtracted cDNA library is constructed as described in Example 2.

The Soy59 (LIB3051) cDNA library is generated from soybean cultivar Asgrow 3244 (Asgrow Seed Company, Des Moines, Iowa U.S.A.) endosperm tissue. Seeds are germinated on paper towels under laboratory ambient light conditions. At 8, 10 and 14 hours after imbibition, the seed coats are harvested. The endosperm consists of a very thin layer of tissue affixed to the inside of the seed coat. The seed coat and endosperm are frozen immediately after harvest in liquid nitrogen. The harvested tissue is stored at −80° C. until RNA preparation. The RNA is prepared from the stored tissue and the cDNA library is constructed as described in Example 2.

The Soy60 (LIB3072) cDNA library is generated from soybean cultivar Asgrow 3244 (Asgrow Seed Company, Des Moines, Iowa U.S.A.) drought stressed seed plus pod subtracted from control seed plus pod tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. The RNA is prepared from the stored tissue and the subtracted cDNA library is constructed as described in Example 2.

The Soy61 (LIB3073) cDNA library is generated from soybean cultivar Asgrow 3244 (Asgrow Seed Company, Des Moines, Iowa U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Loius, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA is prepared from the stored tissue and the subtracted cDNA library is constructed as described in Example 2. For this library's construction, the eighth fraction of the cDNA size fractionation step was used for ligation.

The Soy62 (LIB3074) cDNA library is generated from soybean cultivar Asgrow 3244 (Asgrow Seed Company, Des Moines, Iowa U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Loius, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA is prepared from the stored tissue and the subtracted cDNA library is constructed as described in Example 2. For this library's construction, the ninth fraction of the cDNA size fractionation step was used for ligation.

The Soy65 (LIB3107) 07cDNA library is generated from soybean cultivar Asgrow 3244 (Asgrow Seed Company, Des Moines, Iowa U.S.A.) drought-stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Plants are irrigated with 15-16-17 Peter's Mix. At the R3 stage of development, drought is imposed by withholding water. At 3, 4, 5 and 6 days, tissue is harvested and wilting is not obvious until the fourth day. Abscission layers from reproductive organs are harvested by cutting less than one millimeter proximal and distal to the layer and immediately frozen in liquid nitrogen. The harvested tissue is stored at −80° C. until RNA preparation. The RNA is prepared from the stored tissue and the cDNA library is constructed as described in Example 2.

The Soy66 (LIB3109) cDNA library is generated from soybean cultivar Asgrow 3244 (Asgrow Seed Company, Des Moines, Iowa U.S.A.) non-drought stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Plants are irrigated with 15-16-17 Peter's Mix. At 3, 4, 5 and 6 days, control abscission layer tissue is harvested. Abscission layers from reproductive organs are harvested by cutting less than one millimeter proximal and distal to the layer and immediately frozen in liquid nitrogen. The harvested tissue is stored at −80° C. until RNA preparation. The RNA is prepared from the stored tissue and the cDNA library is constructed as described in Example 2.

Soy67 (LIB3065) normalized seed pool cDNA library is prepared from equal amounts tissue harvested from SOY-MON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. Captured hybrids are eluted with water.

Soy68 (LIB3052) normalized seed pool cDNA library is prepared from equal amounts tissue harvested from SOY-MON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. Captured hybrids are eluted with water.

Soy69 (LIB3053) normalized cDNA library is generated from soybean cultivars Cristalina (USDA Soybean Germplasm Collection, Urbana, Ill. U.S.A.) and FT108 (Monsoy, Brazil) (tropical germ plasma) normalized leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the 4' node of each of the Cristalina and FT108 cultivars and immediately frozen in dry ice. The harvested tissue is then stored at −80° C. until RNA preparation. The RNA is prepared from the stored tissue and the normalized cDNA library is constructed as described in Example 2.

Soy70 (LIB3055) cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation. The RNA is prepared from the stored tissue and the cDNA library is constructed as described in Example 2.

Soy71 (LIB3056) cDNA library is generated from soybean cultivars Cristalina and FT108 (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation. The RNA is prepared from the stored tissue and the cDNA library is constructed as described in Example 2.

Soy73 (LIB3093) cDNA library is generated from soybean cultivar Asgrow 3244 (Asgrow Seed Company, Des Moines, Iowa U.S.A.) drought stressed leaf subtracted from control tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 26° C. and the nighttime temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. The RNA is prepared from the stored tissue and the subtraction cDNA library is constructed as described in Example 2.

The Soy76 (Lib3106) cDNA library is generated from soybean cultivar Asgrow 3244 (Asgrow Seed Company, Des Moines, Iowa U.S.A.) jasmonic acid and arachidonic treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Loius, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. Arachidonic treated seedlings are sprayed with 1 m/ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA from the arachidonic treated seedlings is isolated separately. The RNA is prepared from the stored tissue and the subtraction cDNA library is constructed as described in Example 2. For this subtraction library, fraction 10 of the size fractionated cDNA is ligated into the pSPORT vector (Invitrogen, Carlsbad Calif. U.S.A.) in order to capture some of the smaller transcripts characteristic of antifungal proteins.

Soy77 (L133108) cDNA library is generated from soybean cultivar Asgrow 3244 (Asgrow Seed Company, Des Moines, Iowa U.S.A.) jasmonic acid control tissue. Seeds are planted at a depth of approximately 2 cm into 2-3 inch peat pots containing Metromix 350 medium and the plants are grown in a greenhouse. The daytime temperature is approximately 29.4° C. and the nighttime temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Loius, Mo. U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. Arachidonic treated seedlings are sprayed with 1 m/ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample timepoints were combined and ground. The RNA from the arachidonic treated seedlings is isolated separately. The RNA is prepared from the stored tissue and the subtraction cDNA library is constructed as described in Example 2. For this subtraction cDNA library, fraction 10 of the size fractionated cDNA is ligated into the pSPORT vector in order to capture some of the smaller transcripts characteristic of antifungal proteins.

EXAMPLE 2

The stored RNA is purified using Trizol reagent from Life Technologies (Gibco BRL, Life Technologies, Gaithersburg, Md. U.S.A.), essentially as recommended by the manufacturer. Poly A+ RNA (mRNA) is purified using magnetic oligo dT beads essentially as recommended by the manufacturer (Dynabeads, Dynal Corporation, Lake Success, N.Y. U.S.A.).

Construction of plant cDNA libraries is well-known in the art and a number of cloning strategies exist. A number of cDNA library construction kits are commercially available. The Superscript™ Plasmid System for cDNA synthesis and Plasmid Cloning (Gibco BRL, Life Technologies, Gaithersburg, Md. U.S.A.) is used, following the conditions suggested by the manufacturer.

Normalized libraries are made using essentially the Soares procedure (Soares et al., *Proc. Natl. Acad. Sci.* (*U.S.A.*) 91:9228-9232 (1994), the entirety of which is herein incorporated by reference). This approach is designed to reduce the initial 10,000-fold variation in individual cDNA frequencies to achieve abundances within one order of magnitude while maintaining the overall sequence complexity of the library. In the normalization process, the prevalence of high-abundance cDNA clones decreases dramatically, clones with mid-level abundance are relatively unaffected and clones for rare transcripts are effectively increased in abundance.

Normalized libraries are prepared from single-stranded and double-stranded DNA. Single-stranded and double-stranded DNA representing approximately $1 \times 10^6$ colony forming units are isolated using standard protocols. RNA, complementary to the single-stranded DNA, is synthesized using the double stranded DNA as a template. Biotinylated dATP is incorporated into the RNA during the synthesis reaction. The single-stranded DNA is mixed with the biotinylated RNA in a 1:10 molar ratio) and allowed to hybridize. DNA-RNA hybrids are captured on Dynabeads M280 streptavidin (Dynabeads, Dynal Corporation, Lake Success, N.Y. U.S.A.). The dynabeads with captured hybrids are collected with a magnet. The non-hybridized single-stranded molecules remaining after hybrid capture are converted to double stranded form and represent the primary normalized library.

For subtraction, target cDNA is made from the drought stressed tissue total RNA using the SMART cDNA synthesis system from Clonetech (Clonetech Laboratories, Palo Alto, Calif. U.S.A.). Driver first strand cDNA is covalently linked to Dynabeads following a protocol similar to that described in the Dynal literature (Dynabeads, Dynal Corporation, Lake Success, N.Y. U.S.A.). The target cDNA is then heat denatured and the second strand trapped using Dynabeads oligo-dT. The target second strand cDNA is then hybridized to the driver cDNA in 4001 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with Dynabeads oligo-dT. The trapped cDNA is then amplified as in previous PCR based libraries and the resulting cDNA ligated into the pSPORT vector (Invitrogen, Carlsbad Calif. U.S.A.).

EXAMPLE 3

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

Template plasmid DNA clones are used for subsequent sequencing. For sequencing, the ABI PRISM dRhodamine Terminator Cycle Sequencing Ready Reaction Kit with AmpliTaq® DNA Polymerase, FS, is used (PE Applied Biosystems, Foster City, Calif. U.S.A.).

EXAMPLE 4

Nucleic acid sequences that encode for the following carbon assimilation pathway enzymes: ribulose-bisphosphate carboxylase, phosphoglycerate kinase, glyceraldehyde 3-phosphate dehydrogenase, putative glyceraldehyde 3-phosphate dehydrogenase, triose phosphate isomerase, aldolase, fructose-1,6-bisphosphatase, transketolase, putative transketolase, sedoheptulose-1,7-bisphosphatase, D-ribulose-5-phosphate-3-epimerase, ribose-5-phosphate isomerase, putative ribose-5-phosphate isomerase, ribose-5-phosphate kinase, phosphoenolpyruvate carboxylase, NADP-dependent malate dehydrogenase, aspartate aminotransferase, putative aspartate aminotransferase, alanine aminotransferase, NADP-dependent malic enzyme, NAD-dependent malic enzyeme, PEP carboxykinase, putative PEP carboxykinase, pyruvate, phosphate dikinase and pyrophosphatase are identified from the Monsanto EST PhytoSeq database using TBLASTN (default values)(TBLASTN compares a protein query against the six reading frames of a nucleic acid sequence). Matches found with BLAST P values equal or less than 0.001 (probability) or BLAST Score of equal or greater than 90 are classified as hits. If the program used to determine the hit is HMMSW then the score refers to HMMSW score.

In addition, the GenBank database is searched with BLASTN and BLASTX (default values) using ESTs as queries. EST that pass the hit probability threshold of $10e^{-8}$ for the following enzymes are combined with the hits generated by using TBLASTN (described above) and classified by enzyme (see Table A below). A cluster refers to a set of overlapping clones in the PhytoSeq database. Such an overlapping relationship among clones is designated as a "cluster" when BLAST scores from pairwise sequence comparisons of the member clones meets a predetermined minimum value or product score of 50 or more (Product Score=(BLAST SCORE×Percentage Identity)/(5×minimum [length (Seq1), length (Seq2)]))

Since clusters are formed on the basis of single-linkage relationships, it is possible for two non-overlapping clones to be members of the same cluster if, for instance, they both overlap a third clone with at least the predetermined minimum BLAST score (stringency). A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. Clones grouped in a cluster in most cases represent a contiguous sequence.

TABLE A*

| Seq No. | Cluster ID | CloneID | Library | NCBI gi | Method | Score | P-value | % Ident |
|---|---|---|---|---|---|---|---|---|
| MAIZE RIBULOSE-BISPHOSPHATE CARBOXYLASE | | | | | | | | |
| 1 | -700430856 | 700430856H1 | SATMONN01 | g22464 | BLASTN | 215 | 1e-9 | 100 |
| 2 | 21707 | 700433144H1 | SATMONN01 | g22464 | BLASTN | 626 | 1e-45 | 95 |
| 3 | 21707 | 700433148H1 | SATMONN01 | g22464 | BLASTN | 626 | 1e-45 | 95 |
| 4 | 3272 | 700098783H1 | SATMON009 | g217963 | BLASTN | 1535 | 1e-128 | 98 |
| 5 | 3272 | 700097213H1 | SATMON009 | g217963 | BLASTN | 1316 | 1e-121 | 99 |
| 6 | 3272 | 700097673H1 | SATMON009 | g217963 | BLASTN | 1540 | 1e-121 | 96 |
| 7 | 3272 | 700101767H1 | SATMON009 | g1673455 | BLASTN | 1095 | 1e-120 | 100 |
| 8 | 3272 | 700100001H1 | SATMON009 | g1673455 | BLASTN | 910 | 1e-119 | 99 |
| 9 | 3272 | 700097382H1 | SATMON009 | g217963 | BLASTN | 1517 | 1e-119 | 96 |
| 10 | 3272 | 700099925H1 | SATMON009 | g217963 | BLASTN | 1522 | 1e-119 | 97 |
| 11 | 3272 | 700098235H1 | SATMON009 | g217963 | BLASTN | 1512 | 1e-118 | 97 |
| 12 | 3272 | 700093043H1 | SATMON008 | g1673455 | BLASTN | 1070 | 1e-117 | 100 |
| 13 | 3272 | 700089802H1 | SATMON011 | g217963 | BLASTN | 996 | 1e-115 | 95 |
| 14 | 3272 | 700101196H1 | SATMON009 | g217963 | BLASTN | 1478 | 1e-115 | 99 |
| 15 | 3272 | 700097309H1 | SATMON009 | g217963 | BLASTN | 1482 | 1e-115 | 97 |
| 16 | 3272 | 700100270H1 | SATMON009 | g217963 | BLASTN | 1466 | 1e-114 | 96 |
| 17 | 3272 | 700208152H1 | SATMON016 | g1673455 | BLASTN | 1090 | 1e-113 | 99 |
| 18 | 3272 | 700215709H1 | SATMON016 | g1673455 | BLASTN | 1105 | 1e-113 | 98 |
| 19 | 3272 | 700100795H1 | SATMON009 | g217963 | BLASTN | 1452 | 1e-113 | 98 |
| 20 | 3272 | 700097496H1 | SATMON009 | g217963 | BLASTN | 1416 | 1e-110 | 99 |
| 21 | 3272 | 700099783H1 | SATMON009 | g217963 | BLASTN | 1427 | 1e-110 | 97 |
| 22 | 3272 | 700044355H1 | SATMON004 | g217963 | BLASTN | 1326 | 1e-109 | 96 |
| 23 | 3272 | 700099951H1 | SATMON009 | g217963 | BLASTN | 1409 | 1e-109 | 96 |
| 24 | 3272 | 700100228H1 | SATMON009 | g217963 | BLASTN | 999 | 1e-108 | 97 |
| 25 | 3272 | 700042150H1 | SATMON004 | g217963 | BLASTN | 1186 | 1e-108 | 99 |
| 26 | 3272 | 700045728H1 | SATMON004 | g217963 | BLASTN | 1313 | 1e-108 | 96 |
| 27 | 3272 | 700098561H1 | SATMON009 | g217963 | BLASTN | 1236 | 1e-107 | 96 |
| 28 | 3272 | 700100271H1 | SATMON009 | g217963 | BLASTN | 1392 | 1e-107 | 93 |
| 29 | 3272 | 700211770H1 | SATMON016 | g217963 | BLASTN | 1097 | 1e-105 | 97 |
| 30 | 3272 | 700095614H1 | SATMON008 | g217963 | BLASTN | 1366 | 1e-105 | 91 |
| 31 | 3272 | 700577012H1 | SATMON031 | g217963 | BLASTN | 1348 | 1e-104 | 97 |
| 32 | 3272 | 700100637H1 | SATMON009 | g217963 | BLASTN | 1357 | 1e-104 | 97 |
| 33 | 3272 | 700045636H1 | SATMON004 | g217963 | BLASTN | 1240 | 1e-103 | 100 |
| 34 | 3272 | 700210942H1 | SATMON016 | g217963 | BLASTN | 1183 | 1e-102 | 97 |
| 35 | 3272 | 700213737H1 | SATMON016 | g217963 | BLASTN | 1286 | 1e-102 | 96 |
| 36 | 3272 | 700097664H1 | SATMON009 | g1673455 | BLASTN | 1093 | 1e-101 | 99 |
| 37 | 3272 | 700212658H1 | SATMON016 | g217963 | BLASTN | 1312 | 1e-101 | 97 |
| 38 | 3272 | 700101672H1 | SATMON009 | g217963 | BLASTN | 1313 | 1e-101 | 97 |
| 39 | 3272 | 700053379H1 | SATMON009 | g217963 | BLASTN | 1315 | 1e-101 | 95 |
| 40 | 3272 | 700025653H1 | SATMON004 | g217963 | BLASTN | 1316 | 1e-101 | 99 |
| 41 | 3272 | 700333193H1 | SATMON019 | g217963 | BLASTN | 1318 | 1e-101 | 97 |
| 42 | 3272 | 700211830H1 | SATMON016 | g217963 | BLASTN | 1042 | 1e-100 | 94 |
| 43 | 3272 | 700097362H1 | SATMON009 | g217963 | BLASTN | 1300 | 1e-100 | 93 |
| 44 | 3272 | 700214096H1 | SATMON016 | g217963 | BLASTN | 1308 | 1e-100 | 97 |
| 45 | 3272 | 700042186H1 | SATMON004 | g217963 | BLASTN | 1287 | 1e-99 | 97 |
| 46 | 3272 | 700097564H1 | SATMON009 | g217963 | BLASTN | 1293 | 1e-99 | 92 |
| 47 | 3272 | 700097886H1 | SATMON009 | g217963 | BLASTN | 1232 | 1e-98 | 97 |
| 48 | 3272 | 700043286H1 | SATMON004 | g217963 | BLASTN | 1281 | 1e-98 | 99 |
| 49 | 3272 | 700356225H1 | SATMON024 | g217963 | BLASTN | 881 | 1e-97 | 95 |
| 50 | 3272 | 700046066H1 | SATMON004 | g1673455 | BLASTN | 930 | 1e-97 | 100 |
| 51 | 3272 | 700433801H1 | SATMONN01 | g22464 | BLASTN | 960 | 1e-97 | 99 |
| 52 | 3272 | 701185535H1 | SATMONN06 | g22464 | BLASTN | 1271 | 1e-97 | 99 |
| 53 | 3272 | 700044292H1 | SATMON004 | g217963 | BLASTN | 1257 | 1e-96 | 97 |
| 54 | 3272 | 700053495H1 | SATMON009 | g217963 | BLASTN | 1261 | 1e-96 | 96 |
| 55 | 3272 | 700053373H1 | SATMON009 | g217963 | BLASTN | 1058 | 1e-95 | 99 |

TABLE A*-continued

| Seq No. | Cluster ID | CloneID | Library | NCBI gi | Method | Score | P-value | % Ident |
|---|---|---|---|---|---|---|---|---|
| 56 | 3272 | 700224630H1 | SATMON011 | g217963 | BLASTN | 1243 | 1e−95 | 99 |
| 57 | 3272 | 700046049H1 | SATMON004 | g217963 | BLASTN | 702 | 1e−94 | 92 |
| 58 | 3272 | 700045078H1 | SATMON004 | g217963 | BLASTN | 880 | 1e−94 | 100 |
| 59 | 3272 | 700046107H1 | SATMON004 | g1673455 | BLASTN | 940 | 1e−94 | 100 |
| 60 | 3272 | 700045287H1 | SATMON004 | g217963 | BLASTN | 975 | 1e−94 | 100 |
| 61 | 3272 | 700210539H1 | SATMON016 | g217963 | BLASTN | 1230 | 1e−94 | 92 |
| 62 | 3272 | 700212887H1 | SATMON016 | g217963 | BLASTN | 896 | 1e−93 | 96 |
| 63 | 3272 | 700421770H1 | SATMONN01 | g217963 | BLASTN | 1226 | 1e−93 | 96 |
| 64 | 3272 | 700211658H1 | SATMON016 | g217963 | BLASTN | 800 | 1e−91 | 99 |
| 65 | 3272 | 701182334H1 | SATMONN06 | g1673455 | BLASTN | 926 | 1e−90 | 98 |
| 66 | 3272 | 700044245H1 | SATMON004 | g217963 | BLASTN | 1190 | 1e−90 | 100 |
| 67 | 3272 | 700045992H1 | SATMON004 | g1673455 | BLASTN | 931 | 1e−89 | 99 |
| 68 | 3272 | 700215027H1 | SATMON016 | g217963 | BLASTN | 937 | 1e−89 | 96 |
| 69 | 3272 | 700042688H1 | SATMON004 | g217963 | BLASTN | 1100 | 1e−89 | 97 |
| 70 | 3272 | 700044947H1 | SATMON004 | g217963 | BLASTN | 1175 | 1e−89 | 100 |
| 71 | 3272 | 700045847H1 | SATMON004 | g217963 | BLASTN | 1180 | 1e−89 | 96 |
| 72 | 3272 | 700215351H1 | SATMON016 | g1673455 | BLASTN | 940 | 1e−88 | 100 |
| 73 | 3272 | 700094920H1 | SATMON008 | g217963 | BLASTN | 957 | 1e−88 | 91 |
| 74 | 3272 | 700044201H1 | SATMON004 | g217963 | BLASTN | 596 | 1e−87 | 100 |
| 75 | 3272 | 700335684H1 | SATMON019 | g22464 | BLASTN | 925 | 1e−87 | 94 |
| 76 | 3272 | 700101503H1 | SATMON009 | g217963 | BLASTN | 1108 | 1e−87 | 92 |
| 77 | 3272 | 700099376H1 | SATMON009 | g1673455 | BLASTN | 940 | 1e−85 | 98 |
| 78 | 3272 | 700099542H1 | SATMON009 | g217963 | BLASTN | 1129 | 1e−85 | 91 |
| 79 | 3272 | 700046244H1 | SATMON004 | g217963 | BLASTN | 1112 | 1e−84 | 97 |
| 80 | 3272 | 700088638H1 | SATMON011 | g217963 | BLASTN | 1100 | 1e−83 | 92 |
| 81 | 3272 | 700044223H1 | SATMON004 | g1673455 | BLASTN | 839 | 1e−82 | 96 |
| 82 | 3272 | 700042573H1 | SATMON004 | g1673455 | BLASTN | 839 | 1e−82 | 96 |
| 83 | 3272 | 700214068H1 | SATMON016 | g1673455 | BLASTN | 940 | 1e−82 | 100 |
| 84 | 3272 | 700198026H1 | SATMON016 | g217963 | BLASTN | 1082 | 1e−81 | 96 |
| 85 | 3272 | 700045910H1 | SATMON004 | g217963 | BLASTN | 1085 | 1e−81 | 92 |
| 86 | 3272 | 700097189H1 | SATMON009 | g217963 | BLASTN | 1051 | 1e−79 | 91 |
| 87 | 3272 | 700042282H1 | SATMON004 | g217963 | BLASTN | 1055 | 1e−79 | 93 |
| 88 | 3272 | 700045136H1 | SATMON004 | g1673455 | BLASTN | 832 | 1e−78 | 96 |
| 89 | 3272 | 700097141H1 | SATMON009 | g217963 | BLASTN | 1045 | 1e−78 | 91 |
| 90 | 3272 | 700025538H1 | SATMON004 | g1673455 | BLASTN | 940 | 1e−76 | 99 |
| 91 | 3272 | 700042620H1 | SATMON004 | g217963 | BLASTN | 1001 | 1e−74 | 92 |
| 92 | 3272 | 700042070H1 | SATMON004 | g217963 | BLASTN | 890 | 1e−73 | 93 |
| 93 | 3272 | 700218243H1 | SATMON016 | g217963 | BLASTN | 896 | 1e−73 | 99 |
| 94 | 3272 | 700043362H1 | SATMON004 | g217963 | BLASTN | 970 | 1e−72 | 93 |
| 95 | 3272 | 700043484H1 | SATMON004 | g217963 | BLASTN | 945 | 1e−70 | 93 |
| 96 | 3272 | 700042923H1 | SATMON004 | g217963 | BLASTN | 445 | 1e−69 | 88 |
| 97 | 3272 | 700441659H1 | SATMON026 | g217963 | BLASTN | 703 | 1e−69 | 95 |
| 98 | 3272 | 700044543H1 | SATMON004 | g217963 | BLASTN | 940 | 1e−69 | 93 |
| 99 | 3272 | 700214747H1 | SATMON016 | g217963 | BLASTN | 925 | 1e−68 | 97 |
| 100 | 3272 | 700084502H1 | SATMON011 | g217963 | BLASTN | 721 | 1e−66 | 85 |
| 101 | 3272 | 700046322H1 | SATMON004 | g217963 | BLASTN | 893 | 1e−65 | 92 |
| 102 | 3272 | 700216096H1 | SATMON016 | g1673455 | BLASTN | 877 | 1e−64 | 95 |
| 103 | 3272 | 700043871H1 | SATMON004 | g217963 | BLASTN | 880 | 1e−64 | 92 |
| 104 | 3272 | 700429382H1 | SATMONN01 | g529673 | BLASTN | 440 | 1e−63 | 92 |
| 105 | 3272 | 700442416H1 | SATMON026 | g217963 | BLASTN | 603 | 1e−60 | 88 |
| 106 | 3272 | 700208826H1 | SATMON016 | g217963 | BLASTN | 379 | 1e−59 | 98 |
| 107 | 3272 | 700209462H1 | SATMON016 | g22464 | BLASTN | 796 | 1e−59 | 95 |
| 108 | 3272 | 700209449H1 | SATMON016 | g1673455 | BLASTN | 609 | 1e−53 | 94 |
| 109 | 3272 | 700354501H1 | SATMON024 | g217963 | BLASTN | 644 | 1e−52 | 94 |
| 110 | 3272 | 700099672H1 | SATMON009 | g22464 | BLASTN | 648 | 1e−45 | 95 |
| 111 | 3272 | 700216452H1 | SATMON016 | g529673 | BLASTN | 550 | 1e−37 | 84 |
| 112 | 3272 | 700097732H1 | SATMON009 | g1673455 | BLASTN | 453 | 1e−28 | 98 |
| 113 | 3272 | 700334324H1 | SATMON019 | g1673455 | BLASTN | 434 | 1e−27 | 97 |
| 114 | 8171 | 700098206H1 | SATMON009 | g1673455 | BLASTN | 711 | 1e−105 | 94 |
| 115 | 8171 | 700443785H1 | SATMON027 | g1673455 | BLASTN | 727 | 1e−97 | 97 |
| 116 | 8171 | 700444325H1 | SATMON027 | g1673455 | BLASTN | 1091 | 1e−82 | 98 |
| 117 | 8171 | 700096125H1 | SATMON008 | g1673455 | BLASTN | 749 | 1e−64 | 92 |
| 118 | 8171 | 700447385H1 | SATMON027 | g1673455 | BLASTN | 601 | 1e−54 | 88 |
| 119 | 8171 | 700101184H1 | SATMON009 | g1673455 | BLASTN | 613 | 1e−52 | 90 |
| 120 | 8171 | 700042451H1 | SATMON004 | g1673455 | BLASTN | 507 | 1e−43 | 94 |
| 121 | -L1892710 | LIB189-012-Q1-E1-F5 | LIB189 | g18035 | BLASTN | 745 | 1e−53 | 87 |
| 122 | -L1893905 | LIB189-022-Q1-E1-A5 | LIB189 | g1040912 | BLASTN | 1259 | 1e−96 | 84 |
| 123 | -L30601614 | LIB3060-004-Q1-K1-D4 | LIB3060 | g12394 | BLASTN | 497 | 1e−47 | 90 |
| 124 | -L30601698 | LIB3060-005-Q1-K1-A3 | LIB3060 | g12394 | BLASTN | 813 | 1e−82 | 90 |
| 125 | -L30604185 | LIB3060-040-Q1-K1-G6 | LIB3060 | g22464 | BLASTN | 508 | 1e−46 | 83 |
| 126 | -L30605233 | LIB3060-050-Q1-K1-E5 | LIB3060 | g18035 | BLASTN | 425 | 1e−43 | 84 |

TABLE A*-continued

| Seq No. | Cluster ID | CloneID | Library | NCBI gi | Method | Score | P-value | % Ident |
|---|---|---|---|---|---|---|---|---|
| 127 | -L30623478 | LIB3062-029-Q1-K1-F9 | LIB3062 | g22464 | BLASTN | 260 | 1e-27 | 81 |
| 128 | -L30624113 | LIB3062-015-Q1-K1-E9 | LIB3062 | g1673455 | BLASTN | 264 | 1e-39 | 83 |
| 129 | -L30626076 | LIB3062-057-Q1-K1-G7 | LIB3062 | g217963 | BLASTN | 332 | 1e-18 | 85 |
| 130 | -L30673250 | LIB3067-018-Q1-K1-F10 | LIB3067 | g18035 | BLASTN | 1123 | 1e-100 | 81 |
| 131 | -L30681922 | LIB3068-020-Q1-K1-A6 | LIB3068 | g1040894 | BLASTN | 1180 | 1e-106 | 86 |
| 132 | -L30686213 | LIB3068-050-Q1-K1-B9 | LIB3068 | g18035 | BLASTN | 1402 | 1e-108 | 96 |
| 133 | -L30686456 | LIB3068-016-Q1-K1-D3 | LIB3068 | g11750 | BLASTN | 337 | 1e-90 | 84 |
| 134 | -L30781756 | LIB3078-015-Q1-K1-A3 | LIB3078 | g1673455 | BLASTN | 296 | 1e-31 | 82 |
| 135 | -L30782307 | LIB3078-006-Q1-K1-A3 | LIB3078 | g217963 | BLASTN | 313 | 1e-17 | 84 |
| 136 | -L30782348 | LIB3078-006-Q1-K1-C8 | LIB3078 | g217964 | BLAST | 64 | 1e-26 | 44 |
| 137 | -L30783621 | LIB3078-053-Q1-K1-B1 | LIB3078 | g217963 | BLASTN | 461 | 1e-39 | 69 |
| 138 | -L30784234 | LIB3078-034-Q1-K1-C1 | LIB3078 | g217963 | BLASTN | 288 | 1e-30 | 84 |
| 139 | -L30784545 | LIB3078-039-Q1-K1-H12 | LIB3078 | g18035 | BLASTN | 944 | 1e-96 | 88 |
| 140 | -L361484 | LIB36-008-Q1-E1-E1 | LIB36 | g217963 | BLASTN | 683 | 1e-58 | 92 |
| 141 | -L361797 | LIB36-020-Q1-E1-H9 | LIB36 | g12394 | BLASTN | 290 | 1e-32 | 76 |
| 142 | -L362703 | LIB36-018-Q1-E1-D9 | LIB36 | g1040892 | BLASTN | 1253 | 1e-95 | 90 |
| 143 | -L84236 | LIB84-004-Q1-E1-A2 | LIB84 | g217963 | BLASTN | 322 | 1e-50 | 81 |
| 144 | -L84828 | LIB84-015-Q1-E1-B4 | LIB84 | g18035 | BLASTN | 473 | 1e-36 | 86 |
| 145 | 24099 | LIB36-014-Q1-E1-C4 | LIB36 | g18035 | BLASTN | 2297 | 1e-183 | 99 |
| 146 | 24099 | LIB36-014-Q1-E1-B6 | LIB36 | g18035 | BLASTN | 2294 | 1e-182 | 99 |
| 147 | 24099 | LIB3068-005-Q1-K1-B1 | LIB3068 | g18035 | BLASTN | 2188 | 1e-179 | 93 |
| 148 | 24099 | LIB3066-053-Q1-K1-H3 | LIB3066 | g18035 | BLASTN | 2252 | 1e-179 | 97 |
| 149 | 24099 | LIB36-016-Q2-E2-F11 | LIB36 | g18035 | BLASTN | 1369 | 1e-176 | 99 |
| 150 | 24099 | LIB3068-022-Q1-K1-C10 | LIB3068 | g18035 | BLASTN | 2209 | 1e-175 | 98 |
| 151 | 24099 | LIB3078-007-Q1-K1-B11 | LIB3078 | g18035 | BLASTN | 2004 | 1e-172 | 99 |
| 152 | 24099 | LIB3078-049-Q1-K1-A1 | LIB3078 | g18035 | BLASTN | 2154 | 1e-171 | 98 |
| 153 | 24099 | LIB3060-016-Q1-K1-C8 | LIB3060 | g18035 | BLASTN | 2151 | 1e-170 | 99 |
| 154 | 24099 | LIB189-012-Q1-E1-F10 | LIB189 | g18035 | BLASTN | 2132 | 1e-169 | 98 |
| 155 | 24099 | LIB3078-049-Q1-K1-G3 | LIB3078 | g18035 | BLASTN | 2136 | 1e-169 | 99 |
| 156 | 24099 | LIB3060-025-Q1-K1-H1 | LIB3060 | g18035 | BLASTN | 1587 | 1e-167 | 99 |
| 157 | 24099 | LIB3060-016-Q1-K1-D2 | LIB3060 | g18035 | BLASTN | 2112 | 1e-167 | 98 |
| 158 | 24099 | LIB189-029-Q1-E1-H11 | LIB189 | g18035 | BLASTN | 1942 | 1e-166 | 98 |
| 159 | 24099 | LIB36-021-Q1-E1-H9 | LIB36 | g18035 | BLASTN | 2096 | 1e-166 | 99 |
| 160 | 24099 | LIB84-008-Q1-E1-G8 | LIB84 | g18035 | BLASTN | 2090 | 1e-165 | 100 |
| 161 | 24099 | LIB36-021-Q1-E1-B7 | LIB36 | g18035 | BLASTN | 1923 | 1e-164 | 98 |
| 162 | 24099 | LIB189-016-Q1-E1-A3 | LIB189 | g18035 | BLASTN | 2070 | 1e-164 | 97 |
| 163 | 24099 | LIB3060-052-Q1-K1-B5 | LIB3060 | g18035 | BLASTN | 1634 | 1e-163 | 95 |
| 164 | 24099 | LIB3078-023-Q1-K1-F3 | LIB3078 | g18035 | BLASTN | 1659 | 1e-163 | 95 |

TABLE A*-continued

| Seq No. | Cluster ID | CloneID | Library | NCBI gi | Method | Score | P-value | % Ident |
|---|---|---|---|---|---|---|---|---|
| 165 | 24099 | LIB3066-005-Q1-K1-D11 | LIB3066 | g18035 | BLASTN | 1819 | 1e−163 | 97 |
| 166 | 24099 | LIB189-023-Q1-E1-H10 | LIB189 | g18035 | BLASTN | 1697 | 1e−161 | 96 |
| 167 | 24099 | LIB189-004-Q1-E1-B6 | LIB189 | g18035 | BLASTN | 1705 | 1e−161 | 92 |
| 168 | 24099 | LIB3078-018-Q1-K1-F2 | LIB3078 | g18035 | BLASTN | 1748 | 1e−161 | 98 |
| 169 | 24099 | LIB3066-003-Q1-K1-F3 | LIB3066 | g18035 | BLASTN | 2034 | 1e−160 | 96 |
| 170 | 24099 | LIB3062-053-Q1-K1-D2 | LIB3062 | g18035 | BLASTN | 1761 | 1e−159 | 96 |
| 171 | 24099 | LIB3069-017-Q1-K1-E6 | LIB3069 | g11750 | BLASTN | 1144 | 1e−157 | 95 |
| 172 | 24099 | LIB3078-054-Q1-K1-H4 | LIB3078 | g18035 | BLASTN | 1980 | 1e−156 | 95 |
| 173 | 24099 | LIB3060-036-Q1-K1-F5 | LIB3060 | g18035 | BLASTN | 1960 | 1e−154 | 96 |
| 174 | 24099 | LIB3078-014-Q1-K1-E11 | LIB3078 | g18035 | BLASTN | 1961 | 1e−154 | 99 |
| 175 | 24099 | LIB3066-015-Q1-K1-D8 | LIB3066 | g18035 | BLASTN | 1526 | 1e−152 | 96 |
| 176 | 24099 | LIB3068-016-Q1-K1-D2 | LIB3068 | g18035 | BLASTN | 1925 | 1e−151 | 91 |
| 177 | 24099 | LIB189-011-Q1-E1-F8 | LIB189 | g1040894 | BLASTN | 1675 | 1e−150 | 98 |
| 178 | 24099 | LIB3060-002-Q1-K2-B4 | LIB3060 | g1040894 | BLASTN | 1578 | 1e−149 | 97 |
| 179 | 24099 | LIB3078-004-Q1-K1-G9 | LIB3078 | g1040912 | BLASTN | 1609 | 1e−149 | 94 |
| 180 | 24099 | LIB189-031-Q1-E1-A5 | LIB189 | g18035 | BLASTN | 1775 | 1e−149 | 98 |
| 181 | 24099 | LIB36-019-Q1-E1-F7 | LIB36 | g18035 | BLASTN | 1718 | 1e−146 | 97 |
| 182 | 24099 | LIB84-030-Q1-E1-G10 | LIB84 | g1040894 | BLASTN | 1822 | 1e−146 | 98 |
| 183 | 24099 | LIB3062-031-Q1-K1-A10 | LIB3062 | g18035 | BLASTN | 791 | 1e−145 | 93 |
| 184 | 24099 | LIB3078-014-Q1-K1-E2 | LIB3078 | g18035 | BLASTN | 1817 | 1e−142 | 98 |
| 185 | 24099 | LIB189-020-Q1-E1-G2 | LIB189 | g1040892 | BLASTN | 1660 | 1e−140 | 96 |
| 186 | 24099 | LIB189-003-Q1-E1-G6 | LIB189 | g18035 | BLASTN | 1774 | 1e−139 | 97 |
| 187 | 24099 | LIB3060-009-Q1-K1-F8 | LIB3060 | g18035 | BLASTN | 1240 | 1e−138 | 96 |
| 188 | 24099 | LIB3078-011-Q1-K1-C10 | LIB3078 | g18035 | BLASTN | 1771 | 1e−138 | 91 |
| 189 | 24099 | LIB3066-027-Q1-K1-H12 | LIB3066 | g11750 | BLASTN | 1289 | 1e−133 | 94 |
| 190 | 24099 | LIB84-005-Q1-E1-B4 | LIB84 | g18035 | BLASTN | 1137 | 1e−132 | 96 |
| 191 | 24099 | LIB3078-027-Q1-K1-E11 | LIB3078 | g18035 | BLASTN | 1450 | 1e−131 | 99 |
| 192 | 24099 | LIB36-016-Q2-E2-G10 | LIB36 | g18035 | BLASTN | 1661 | 1e−129 | 99 |
| 193 | 24099 | LIB3060-020-Q1-K1-H7 | LIB3060 | g18035 | BLASTN | 1334 | 1e−126 | 96 |
| 194 | 24099 | LIB3068-045-Q1-K1-F6 | LIB3068 | g11750 | BLASTN | 1349 | 1e−126 | 91 |
| 195 | 24099 | LIB3060-048-Q1-K1-C5 | LIB3060 | g18035 | BLASTN | 1517 | 1e−126 | 90 |
| 196 | 24099 | LIB3078-028-Q1-K1-G7 | LIB3078 | g1040912 | BLASTN | 1094 | 1e−125 | 96 |
| 197 | 24099 | LIB3078-008-Q1-K1-F7 | LIB3078 | g18035 | BLASTN | 1282 | 1e−122 | 83 |
| 198 | 24099 | LIB3078-035-Q1-K1-H4 | LIB3078 | g1040892 | BLASTN | 1194 | 1e−118 | 81 |
| 199 | 24099 | LIB36-015-Q1-E1-E1 | LIB36 | g18035 | BLASTN | 1508 | 1e−116 | 98 |
| 200 | 24099 | LIB3060-029-Q1-K1-E10 | LIB3060 | g1040894 | BLASTN | 1400 | 1e−112 | 95 |
| 201 | 24099 | LIB3060-038-Q1-K1-B8 | LIB3060 | g18035 | BLASTN | 1356 | 1e−104 | 97 |
| 202 | 24099 | LIB189-026-Q1-E1-D9 | LIB189 | g18035 | BLASTN | 1319 | 1e−101 | 93 |

TABLE A*-continued

| Seq No. | Cluster ID | CloneID | Library | NCBI gi | Method | Score | P-value | % Ident |
|---|---|---|---|---|---|---|---|---|
| 203 | 24099 | LIB189-034-Q1-E1-D10 | LIB189 | g18035 | BLASTN | 748 | 1e−97 | 89 |
| 204 | 24099 | LIB189-023-Q1-E1-F3 | LIB189 | g18035 | BLASTN | 635 | 1e−86 | 93 |
| 205 | 24099 | LIB83-001-Q1-E1-E9 | LIB83 | g18035 | BLASTN | 540 | 1e−68 | 99 |
| 206 | 24099 | LIB189-021-Q1-E1-D6 | LIB189 | g18035 | BLASTN | 715 | 1e−50 | 100 |
| 207 | 24207 | LIB3060-026-Q1-K1-C3 | LIB3060 | g11797 | BLASTN | 694 | 1e−149 | 90 |
| 208 | 24207 | LIB189-018-Q1-E1-E9 | LIB189 | g11797 | BLASTN | 904 | 1e−143 | 96 |
| 209 | 24207 | LIB3060-020-Q1-K1-A10 | LIB3060 | g11797 | BLASTN | 694 | 1e−115 | 91 |
| 210 | 3272 | LIB3078-018-Q1-K1-H8 | LIB3078 | g217963 | BLASTN | 2129 | 1e−180 | 97 |
| 211 | 3272 | LIB36-009-Q1-E1-E12 | LIB36 | g217963 | BLASTN | 2057 | 1e−178 | 95 |
| 212 | 3272 | LIB3078-013-Q1-K1-H11 | LIB3078 | g217963 | BLASTN | 2154 | 1e−173 | 99 |
| 213 | 3272 | LIB83-007-Q1-E1-C9 | LIB83 | g217963 | BLASTN | 2008 | 1e−172 | 97 |
| 214 | 3272 | LIB36-014-Q1-E1-H9 | LIB36 | g217963 | BLASTN | 1905 | 1e−171 | 99 |
| 215 | 3272 | LIB3066-002-Q1-K1-B12 | LIB3066 | g217963 | BLASTN | 1962 | 1e−170 | 96 |
| 216 | 3272 | LIB3062-036-Q1-K1-F11 | LIB3062 | g217963 | BLASTN | 2115 | 1e−170 | 97 |
| 217 | 3272 | LIB36-007-Q1-E1-G2 | LIB36 | g217963 | BLASTN | 1985 | 1e−169 | 95 |
| 218 | 3272 | LIB3078-006-Q1-K1-C7 | LIB3078 | g217963 | BLASTN | 1876 | 1e−168 | 97 |
| 219 | 3272 | LIB3078-034-Q1-K1-B7 | LIB3078 | g217963 | BLASTN | 1786 | 1e−165 | 98 |
| 220 | 3272 | LIB36-009-Q1-E1-H2 | LIB36 | g217963 | BLASTN | 1921 | 1e−165 | 95 |
| 221 | 3272 | LIB36-020-Q1-E1-F10 | LIB36 | g217963 | BLASTN | 1717 | 1e−164 | 92 |
| 222 | 3272 | LIB3078-053-Q1-K1-D9 | LIB3078 | g217963 | BLASTN | 1874 | 1e−162 | 97 |
| 223 | 3272 | LIB83-015-Q1-E1-B8 | LIB83 | g217963 | BLASTN | 1876 | 1e−161 | 91 |
| 224 | 3272 | LIB36-004-Q1-E1-D2 | LIB36 | g217963 | BLASTN | 1429 | 1e−160 | 97 |
| 225 | 3272 | LIB83-011-Q1-E1-H7 | LIB83 | g217963 | BLASTN | 1557 | 1e−160 | 95 |
| 226 | 3272 | LIB3078-018-Q1-K1-H1 | LIB3078 | g217963 | BLASTN | 1844 | 1e−159 | 88 |
| 227 | 3272 | LIB189-030-Q1-E1-E9 | LIB189 | g217963 | BLASTN | 1436 | 1e−152 | 97 |
| 228 | 3272 | LIB189-006-Q1-E1-F9 | LIB189 | g217963 | BLASTN | 1825 | 1e−151 | 99 |
| 229 | 3272 | LIB36-022-Q1-E1-H3 | LIB36 | g217963 | BLASTN | 1635 | 1e−150 | 97 |
| 230 | 3272 | LIB83-011-Q1-E1-D3 | LIB83 | g217963 | BLASTN | 1414 | 1e−149 | 97 |
| 231 | 3272 | LIB3062-047-Q1-K1-B2 | LIB3062 | g217963 | BLASTN | 1691 | 1e−148 | 89 |
| 232 | 3272 | LIB36-016-Q2-E2-D9 | LIB36 | g217963 | BLASTN | 1719 | 1e−147 | 93 |
| 233 | 3272 | LIB36-021-Q1-E1-G3 | LIB36 | g217963 | BLASTN | 1512 | 1e−144 | 93 |
| 234 | 3272 | LIB3078-004-Q1-K1-B4 | LIB3078 | g217963 | BLASTN | 1787 | 1e−142 | 96 |
| 235 | 3272 | LIB3068-056-Q1-K1-C6 | LIB3068 | g217963 | BLASTN | 1145 | 1e−141 | 91 |
| 236 | 3272 | LIB3078-052-Q1-K1-F8 | LIB3078 | g217963 | BLASTN | 1340 | 1e−141 | 96 |
| 237 | 3272 | LIB36-021-Q1-E1-A6 | LIB36 | g217963 | BLASTN | 1436 | 1e−139 | 93 |
| 238 | 3272 | LIB189-028-Q1-E1-B12 | LIB189 | g217963 | BLASTN | 1617 | 1e−139 | 98 |
| 239 | 3272 | LIB83-005-Q1-E1-B3 | LIB83 | g217963 | BLASTN | 1495 | 1e−133 | 92 |
| 240 | 3272 | LIB3060-020-Q1-K1-G10 | LIB3060 | g217963 | BLASTN | 750 | 1e−132 | 88 |

TABLE A*-continued

| Seq No. | Cluster ID | CloneID | Library | NCBI gi | Method | Score | P-value | % Ident |
|---|---|---|---|---|---|---|---|---|
| 241 | 3272 | LIB36-013-Q1-E1-E6 | LIB36 | g217963 | BLASTN | 1367 | 1e-132 | 90 |
| 242 | 3272 | LIB84-015-Q1-E1-E1 | LIB84 | g217963 | BLASTN | 1545 | 1e-132 | 92 |
| 243 | 3272 | LIB36-006-Q1-E1-E10 | LIB36 | g217963 | BLASTN | 1640 | 1e-130 | 91 |
| 244 | 3272 | LIB84-027-Q1-E1-H12 | LIB84 | g217963 | BLASTN | 1333 | 1e-128 | 95 |
| 245 | 3272 | LIB3067-001-Q1-K1-B11 | LIB3067 | g217963 | BLASTN | 1364 | 1e-127 | 90 |
| 246 | 3272 | LIB3062-016-Q1-K1-D11 | LIB3062 | g217963 | BLASTN | 1369 | 1e-127 | 89 |
| 247 | 3272 | LIB3060-013-Q1-K1-D6 | LIB3060 | g217963 | BLASTN | 1607 | 1e-127 | 90 |
| 248 | 3272 | LIB3078-028-Q1-K1-F4 | LIB3078 | g217963 | BLASTN | 906 | 1e-126 | 93 |
| 249 | 3272 | LIB3067-027-Q1-K1-A8 | LIB3067 | g217963 | BLASTN | 1364 | 1e-125 | 92 |
| 250 | 3272 | LIB189-034-Q1-E1-B9 | LIB189 | g217963 | BLASTN | 1139 | 1e-117 | 91 |
| 251 | 3272 | LIB189-027-Q1-E1-C2 | LIB189 | g217963 | BLASTN | 1264 | 1e-116 | 85 |
| 252 | 3272 | LIB3060-034-Q1-K1-E7 | LIB3060 | g217963 | BLASTN | 1490 | 1e-116 | 86 |
| 253 | 3272 | LIB36-010-Q1-E1-A10 | LIB36 | g217963 | BLASTN | 1427 | 1e-115 | 88 |
| 254 | 3272 | LIB3078-040-Q1-K1-E5 | LIB3078 | g217963 | BLASTN | 1475 | 1e-115 | 84 |
| 255 | 3272 | LIB3078-052-Q1-K1-H4 | LIB3078 | g22464 | BLASTN | 1141 | 1e-113 | 92 |
| 256 | 3272 | LIB3078-001-Q1-K1-B1 | LIB3078 | g217963 | BLASTN | 1173 | 1e-113 | 93 |
| 257 | 3272 | LIB84-017-Q1-E1-D1 | LIB84 | g1673455 | BLASTN | 747 | 1e-112 | 91 |
| 258 | 3272 | LIB3060-034-Q1-K1-B7 | LIB3060 | g217963 | BLASTN | 1135 | 1e-112 | 87 |
| 259 | 3272 | LIB3060-028-Q1-K1-D3 | LIB3060 | g217963 | BLASTN | 1012 | 1e-111 | 88 |
| 260 | 3272 | LIB36-017-Q1-E1-B8 | LIB36 | g217963 | BLASTN | 1398 | 1e-108 | 87 |
| 261 | 3272 | LIB84-008-Q1-E1-G1 | LIB84 | g217963 | BLASTN | 964 | 1e-103 | 93 |
| 262 | 3272 | LIB3078-027-Q1-K1-D12 | LIB3078 | g217963 | BLASTN | 894 | 1e-100 | 91 |
| 263 | 3272 | LIB36-010-Q1-E1-E7 | LIB36 | g217963 | BLASTN | 1257 | 1e-100 | 92 |
| 264 | 3272 | LIB3068-029-Q1-K1-F6 | LIB3068 | g217963 | BLASTN | 1044 | 1e-93 | 94 |
| 265 | 3272 | LIB3060-014-Q1-K1-D9 | LIB3060 | g217963 | BLASTN | 934 | 1e-89 | 92 |
| 266 | 3272 | LIB3060-023-Q1-K1-H3 | LIB3060 | g1673455 | BLASTN | 666 | 1e-88 | 96 |
| 267 | 3272 | LIB84-023-Q1-E1-B2 | LIB84 | g1673455 | BLASTN | 947 | 1e-84 | 91 |
| 268 | 3272 | LIB3062-015-Q1-K1-H5 | LIB3062 | g217963 | BLASTN | 1007 | 1e-75 | 95 |
| 269 | 3272 | LIB36-013-Q1-E1-H2 | LIB36 | g1673455 | BLASTN | 976 | 1e-72 | 97 |
| 270 | 3272 | LIB36-009-Q1-E1-F4 | LIB36 | g22464 | BLASTN | 881 | 1e-63 | 98 |
| 271 | 3272 | 46-LIB84-007-Q1-E1-D6 | LIB84 | g22464 | BLASTN | 449 | 1e-38 | 95 |
| 272 | 3272 | LIB3078-054-Q1-K1-D12 | LIB3078 | g529673 | BLASTN | 349 | 1e-24 | 94 |
| 273 | 3272 | LIB36-016-Q2-E2-D1 | LIB36 | g529673 | BLASTN | 342 | 1e-19 | 97 |
| 274 | 8171 | LIB3066-019-Q1-K1-H5 | LIB3066 | g1673455 | BLASTN | 1193 | 1e-161 | 95 |
| 275 | 8171 | LIB36-005-Q1-E1-C10 | LIB36 | g1673455 | BLASTN | 1260 | 1e-155 | 99 |
| 276 | 8171 | LIB84-008-Q1-E1-E11 | LIB84 | g1673455 | BLASTN | 1300 | 1e-150 | 100 |
| 277 | 8171 | LIB36-010-Q1-E1-B4 | LIB36 | g1673455 | BLASTN | 1484 | 1e-125 | 99 |
| 278 | 8171 | LIB36-017-Q1-E1-D2 | LIB36 | g1673455 | BLASTN | 1206 | 1e-113 | 98 |

TABLE A*-continued

| Seq No. | Cluster ID | CloneID | Library | NCBI gi | Method | Score | P-value | % Ident |
|---|---|---|---|---|---|---|---|---|
| 279 | 8171 | LIB83-005-Q1-E1-B2 | LIB83 | g1673455 | BLASTN | 620 | 1e-85 | 93 |
| 280 | 8171 | LIB36-022-Q1-E1-E3 | LIB36 | g1673455 | BLASTN | 729 | 1e-60 | 95 |
| 281 | 8171 | LIB84-006-Q1-E1-B2 | LIB84 | g1673455 | BLASTN | 298 | 1e-15 | 67 |
| SOYBEAN RIBULOSE-BISPHOSPHATE CARBOXYLASE | | | | | | | | |
| 282 | -700646133 | 700646133H1 | SOYMON012 | g1079735 | BLASTN | 249 | 1e-11 | 77 |
| 283 | -700680902 | 700680902H1 | SOYMON008 | g1055367 | BLASTN | 454 | 1e-46 | 87 |
| 284 | -700737728 | 700737728H1 | SOYMON012 | g1055367 | BLASTN | 241 | 1e-18 | 91 |
| 285 | -700873832 | 700873832H1 | SOYMON018 | g1055367 | BLASTN | 424 | 1e-26 | 88 |
| 286 | -700874452 | 700874452H1 | SOYMON018 | g1079735 | BLASTN | 209 | 1e-8 | 87 |
| 287 | -700993404 | 700993404H1 | SOYMON011 | g1055367 | BLASTN | 508 | 1e-70 | 87 |
| 288 | -700995052 | 700995052H1 | SOYMON011 | g1079735 | BLASTN | 235 | 1e-10 | 91 |
| 289 | -701118676 | 701118676H1 | SOYMON037 | g1055367 | BLASTN | 427 | 1e-44 | 78 |
| 290 | 10981 | 700661710H1 | SOYMON005 | g3168587 | BLASTX | 194 | 1e-20 | 57 |
| 291 | 10981 | 700661109H1 | SOYMON005 | g3168587 | BLASTX | 128 | 1e-10 | 51 |
| 292 | 16 | 700680726H1 | SOYMON008 | g1055367 | BLASTN | 1262 | 1e-126 | 98 |
| 293 | 16 | 700680952H1 | SOYMON008 | g1055367 | BLASTN | 1362 | 1e-126 | 93 |
| 294 | 16 | 700680959H1 | SOYMON008 | g1055367 | BLASTN | 1151 | 1e-120 | 98 |
| 295 | 16 | 700763859H1 | SOYMON018 | g1055367 | BLASTN | 1472 | 1e-116 | 99 |
| 296 | 16 | 700557838H1 | SOYMON001 | g1055367 | BLASTN | 1456 | 1e-115 | 99 |
| 297 | 16 | 700558916H1 | SOYMON001 | g1055367 | BLASTN | 1441 | 1e-113 | 99 |
| 298 | 16 | 700680502H1 | SOYMON008 | g1055367 | BLASTN | 665 | 1e-112 | 96 |
| 299 | 16 | 700556877H1 | SOYMON001 | g1079735 | BLASTN | 743 | 1e-109 | 96 |
| 300 | 16 | 700606206H1 | SOYMON008 | g1055367 | BLASTN | 770 | 1e-109 | 100 |
| 301 | 16 | 700557609H1 | SOYMON001 | g1055367 | BLASTN | 1085 | 1e-109 | 99 |
| 302 | 16 | 700646293H1 | SOYMON012 | g1055367 | BLASTN | 1400 | 1e-109 | 100 |
| 303 | 16 | 700557441H1 | SOYMON001 | g1055367 | BLASTN | 1073 | 1e-108 | 99 |
| 304 | 16 | 700646203H1 | SOYMON012 | g1055367 | BLASTN | 1191 | 1e-108 | 98 |
| 305 | 16 | 700787408H2 | SOYMON011 | g1055367 | BLASTN | 1386 | 1e-108 | 99 |
| 306 | 16 | 700605320H2 | SOYMON004 | g1055367 | BLASTN | 1389 | 1e-108 | 99 |
| 307 | 16 | 700563581H1 | SOYMON002 | g1055367 | BLASTN | 1379 | 1e-107 | 98 |
| 308 | 16 | 700553939H1 | SOYMON001 | g1055367 | BLASTN | 1063 | 1e-106 | 99 |
| 309 | 16 | 701001329H1 | SOYMON018 | g1055367 | BLASTN | 1365 | 1e-106 | 97 |
| 310 | 16 | 700684042H1 | SOYMON008 | g1055367 | BLASTN | 1366 | 1e-106 | 99 |
| 311 | 16 | 700555971H1 | SOYMON001 | g1055367 | BLASTN | 708 | 1e-105 | 97 |
| 312 | 16 | 700654101H1 | SOYMON003 | g1055367 | BLASTN | 715 | 1e-105 | 98 |
| 313 | 16 | 700560889H1 | SOYMON001 | g1055367 | BLASTN | 716 | 1e-105 | 99 |
| 314 | 16 | 700963683H1 | SOYMON022 | g1055367 | BLASTN | 741 | 1e-105 | 98 |
| 315 | 16 | 700788007H1 | SOYMON011 | g1055367 | BLASTN | 1355 | 1e-105 | 100 |
| 316 | 16 | 700556641H1 | SOYMON001 | g1055367 | BLASTN | 1359 | 1e-105 | 99 |
| 317 | 16 | 700561084H1 | SOYMON001 | g1055367 | BLASTN | 1360 | 1e-105 | 100 |
| 318 | 16 | 700555936H1 | SOYMON001 | g1055367 | BLASTN | 720 | 1e-104 | 97 |
| 319 | 16 | 701059184H1 | SOYMON033 | g1055367 | BLASTN | 1192 | 1e-104 | 98 |
| 320 | 16 | 700739631H1 | SOYMON012 | g1055367 | BLASTN | 1346 | 1e-104 | 97 |
| 321 | 16 | 700683729H1 | SOYMON008 | g1055367 | BLASTN | 1346 | 1e-104 | 97 |
| 322 | 16 | 700555221H1 | SOYMON001 | g1055367 | BLASTN | 1351 | 1e-104 | 99 |
| 323 | 16 | 700680511H1 | SOYMON008 | g1079735 | BLASTN | 789 | 1e-103 | 95 |
| 324 | 16 | 700684247H1 | SOYMON008 | g1055367 | BLASTN | 1331 | 1e-103 | 99 |
| 325 | 16 | 700993018H1 | SOYMON011 | g1055367 | BLASTN | 1332 | 1e-103 | 98 |
| 326 | 16 | 700560424H1 | SOYMON001 | g1055367 | BLASTN | 1338 | 1e-103 | 95 |
| 327 | 16 | 700558552H1 | SOYMON001 | g1055367 | BLASTN | 630 | 1e-102 | 100 |
| 328 | 16 | 700980925H1 | SOYMON009 | g1055367 | BLASTN | 690 | 1e-102 | 98 |
| 329 | 16 | 700554035H1 | SOYMON001 | g1079735 | BLASTN | 730 | 1e-102 | 97 |
| 330 | 16 | 700787457H2 | SOYMON011 | g1055367 | BLASTN | 1005 | 1e-102 | 100 |
| 331 | 16 | 701066314H1 | SOYMON034 | g1055367 | BLASTN | 1115 | 1e-102 | 100 |
| 332 | 16 | 700984792H1 | SOYMON009 | g1055367 | BLASTN | 1327 | 1e-102 | 99 |
| 333 | 16 | 700993845H1 | SOYMON011 | g1055367 | BLASTN | 1256 | 1e-101 | 99 |
| 334 | 16 | 700553638H1 | SOYMON001 | g1055367 | BLASTN | 1281 | 1e-101 | 96 |
| 335 | 16 | 701108568H1 | SOYMON036 | g1055367 | BLASTN | 1309 | 1e-101 | 99 |
| 336 | 16 | 700730203H1 | SOYMON009 | g1055367 | BLASTN | 1309 | 1e-101 | 99 |
| 337 | 16 | 700686590H1 | SOYMON008 | g1055367 | BLASTN | 1310 | 1e-101 | 100 |
| 338 | 16 | 700684291H1 | SOYMON008 | g1055367 | BLASTN | 1313 | 1e-101 | 99 |
| 339 | 16 | 700686641H1 | SOYMON008 | g1055367 | BLASTN | 1317 | 1e-101 | 98 |
| 340 | 16 | 700739501H1 | SOYMON012 | g1055367 | BLASTN | 988 | 1e-100 | 99 |
| 341 | 16 | 700686672H1 | SOYMON008 | g1055367 | BLASTN | 989 | 1e-100 | 99 |
| 342 | 16 | 701105057H1 | SOYMON036 | g1055367 | BLASTN | 1170 | 1e-100 | 99 |
| 343 | 16 | 700560247H1 | SOYMON001 | g1055367 | BLASTN | 1259 | 1e-100 | 94 |
| 344 | 16 | 700685202H1 | SOYMON008 | g1055367 | BLASTN | 1269 | 1e-100 | 99 |
| 345 | 16 | 700744438H1 | SOYMON012 | g1055367 | BLASTN | 1296 | 1e-100 | 99 |
| 346 | 16 | 700987146H1 | SOYMON009 | g1055367 | BLASTN | 1298 | 1e-100 | 99 |
| 347 | 16 | 700874210H1 | SOYMON018 | g1055367 | BLASTN | 1298 | 1e-100 | 99 |
| 348 | 16 | 700558668H1 | SOYMON001 | g1055367 | BLASTN | 1299 | 1e-100 | 97 |
| 349 | 16 | 701066793H1 | SOYMON034 | g1055367 | BLASTN | 1299 | 1e-100 | 96 |
| 350 | 16 | 700897572H1 | SOYMON027 | g1055367 | BLASTN | 1301 | 1e-100 | 98 |

TABLE A*-continued

| Seq No. | Cluster ID | CloneID | Library | NCBI gi | Method | Score | P-value | % Ident |
|---|---|---|---|---|---|---|---|---|
| 351 | 16 | 700788520H1 | SOYMON011 | g1055367 | BLASTN | 1304 | 1e-100 | 97 |
| 352 | 16 | 700993424H1 | SOYMON011 | g1055367 | BLASTN | 1306 | 1e-100 | 99 |
| 353 | 16 | 700990285H1 | SOYMON011 | g1055367 | BLASTN | 1307 | 1e-100 | 98 |
| 354 | 16 | 700559016H1 | SOYMON001 | g170057 | BLASTN | 703 | 1e-99 | 96 |
| 355 | 16 | 700684946H1 | SOYMON008 | g1055367 | BLASTN | 837 | 1e-99 | 96 |
| 356 | 16 | 700994454H1 | SOYMON011 | g1079735 | BLASTN | 891 | 1e-99 | 98 |
| 357 | 16 | 700684022H1 | SOYMON008 | g1055367 | BLASTN | 974 | 1e-99 | 99 |
| 358 | 16 | 700981572H1 | SOYMON009 | g1055367 | BLASTN | 977 | 1e-99 | 97 |
| 359 | 16 | 700547916H1 | SOYMON001 | g1055367 | BLASTN | 1018 | 1e-99 | 97 |
| 360 | 16 | 701210426H1 | SOYMON035 | g1055367 | BLASTN | 1175 | 1e-99 | 96 |
| 361 | 16 | 700680983H1 | SOYMON008 | g1055367 | BLASTN | 1178 | 1e-99 | 96 |
| 362 | 16 | 700686304H1 | SOYMON008 | g1055367 | BLASTN | 1213 | 1e-99 | 95 |
| 363 | 16 | 700656925H1 | SOYMON004 | g1055367 | BLASTN | 1248 | 1e-99 | 97 |
| 364 | 16 | 700959008H1 | SOYMON022 | g1055367 | BLASTN | 1286 | 1e-99 | 99 |
| 365 | 16 | 700990104H1 | SOYMON011 | g1055367 | BLASTN | 1286 | 1e-99 | 99 |
| 366 | 16 | 700733702H1 | SOYMON010 | g1055367 | BLASTN | 1291 | 1e-99 | 99 |
| 367 | 16 | 700679911H2 | SOYMON008 | g1055367 | BLASTN | 750 | 1e-98 | 100 |
| 368 | 16 | 700683580H1 | SOYMON008 | g1055367 | BLASTN | 975 | 1e-98 | 99 |
| 369 | 16 | 701000694H1 | SOYMON018 | g1055367 | BLASTN | 981 | 1e-98 | 98 |
| 370 | 16 | 700788434H1 | SOYMON011 | g1055367 | BLASTN | 993 | 1e-98 | 99 |
| 371 | 16 | 700977489H1 | SOYMON009 | g1055367 | BLASTN | 1115 | 1e-98 | 100 |
| 372 | 16 | 700646244H1 | SOYMON012 | g1055367 | BLASTN | 1245 | 1e-98 | 93 |
| 373 | 16 | 700789239H2 | SOYMON011 | g1055367 | BLASTN | 1275 | 1e-98 | 100 |
| 374 | 16 | 700941416H1 | SOYMON024 | g1055367 | BLASTN | 1277 | 1e-98 | 98 |
| 375 | 16 | 700741114H1 | SOYMON012 | g1055367 | BLASTN | 1280 | 1e-98 | 100 |
| 376 | 16 | 700787710H2 | SOYMON011 | g1055367 | BLASTN | 1280 | 1e-98 | 100 |
| 377 | 16 | 700738915H1 | SOYMON012 | g1055367 | BLASTN | 1281 | 1e-98 | 99 |
| 378 | 16 | 700681172H2 | SOYMON008 | g1055367 | BLASTN | 1281 | 1e-98 | 97 |
| 379 | 16 | 700989627H1 | SOYMON011 | g1055367 | BLASTN | 1283 | 1e-98 | 99 |
| 380 | 16 | 700992304H1 | SOYMON011 | g1055367 | BLASTN | 631 | 1e-97 | 95 |
| 381 | 16 | 700660092H1 | SOYMON004 | g1055367 | BLASTN | 655 | 1e-97 | 100 |
| 382 | 16 | 700742022H1 | SOYMON012 | g1079735 | BLASTN | 710 | 1e-97 | 98 |
| 383 | 16 | 700787646H2 | SOYMON011 | g1055367 | BLASTN | 755 | 1e-97 | 100 |
| 384 | 16 | 700686569H1 | SOYMON008 | g1055367 | BLASTN | 955 | 1e-97 | 99 |
| 385 | 16 | 701107113H1 | SOYMON036 | g1055367 | BLASTN | 959 | 1e-97 | 98 |
| 386 | 16 | 700553876H1 | SOYMON001 | g1055367 | BLASTN | 1186 | 1e-97 | 94 |
| 387 | 16 | 701106749H1 | SOYMON036 | g1055367 | BLASTN | 1194 | 1e-97 | 94 |
| 388 | 16 | 700660208H1 | SOYMON004 | g1055367 | BLASTN | 1219 | 1e-97 | 99 |
| 389 | 16 | 700738445H1 | SOYMON012 | g1055367 | BLASTN | 1263 | 1e-97 | 96 |
| 390 | 16 | 700873776H1 | SOYMON018 | g1055367 | BLASTN | 1265 | 1e-97 | 100 |
| 391 | 16 | 700684414H1 | SOYMON008 | g1055367 | BLASTN | 1265 | 1e-97 | 100 |
| 392 | 16 | 700790868H1 | SOYMON011 | g1055367 | BLASTN | 1268 | 1e-97 | 98 |
| 393 | 16 | 700787726H2 | SOYMON011 | g1055367 | BLASTN | 1270 | 1e-97 | 100 |
| 394 | 16 | 700899186H1 | SOYMON027 | g1055367 | BLASTN | 1271 | 1e-97 | 99 |
| 395 | 16 | 700726442H1 | SOYMON009 | g1055367 | BLASTN | 670 | 1e-96 | 100 |
| 396 | 16 | 700681422H2 | SOYMON008 | g1055367 | BLASTN | 680 | 1e-96 | 98 |
| 397 | 16 | 700901301H1 | SOYMON027 | g1055367 | BLASTN | 745 | 1e-96 | 100 |
| 398 | 16 | 701214546H1 | SOYMON035 | g1055367 | BLASTN | 943 | 1e-96 | 99 |
| 399 | 16 | 701211571H1 | SOYMON035 | g1055367 | BLASTN | 970 | 1e-96 | 100 |
| 400 | 16 | 701067621H1 | SOYMON034 | g1055367 | BLASTN | 1137 | 1e-96 | 92 |
| 401 | 16 | 700656975H1 | SOYMON004 | g1055367 | BLASTN | 1157 | 1e-96 | 99 |
| 402 | 16 | 700679981H2 | SOYMON008 | g1055367 | BLASTN | 1192 | 1e-96 | 98 |
| 403 | 16 | 700788456H1 | SOYMON011 | g1055367 | BLASTN | 1250 | 1e-96 | 98 |
| 404 | 16 | 700993650H1 | SOYMON011 | g1055367 | BLASTN | 1253 | 1e-96 | 98 |
| 405 | 16 | 700738760H1 | SOYMON012 | g1055367 | BLASTN | 1255 | 1e-96 | 100 |
| 406 | 16 | 700738920H1 | SOYMON012 | g1055367 | BLASTN | 1258 | 1e-96 | 99 |
| 407 | 16 | 700992293H1 | SOYMON011 | g1055367 | BLASTN | 1258 | 1e-96 | 98 |
| 408 | 16 | 700849079H1 | SOYMON021 | g1055367 | BLASTN | 1258 | 1e-96 | 97 |
| 409 | 16 | 700683157H1 | SOYMON008 | g1055367 | BLASTN | 1258 | 1e-96 | 99 |
| 410 | 16 | 700874075H1 | SOYMON018 | g1055367 | BLASTN | 1260 | 1e-96 | 100 |
| 411 | 16 | 700988186H1 | SOYMON009 | g1079735 | BLASTN | 638 | 1e-95 | 93 |
| 412 | 16 | 700899275H1 | SOYMON027 | g1055367 | BLASTN | 920 | 1e-95 | 99 |
| 413 | 16 | 700943511H1 | SOYMON024 | g1055367 | BLASTN | 930 | 1e-95 | 98 |
| 414 | 16 | 701062407H1 | SOYMON033 | g1055367 | BLASTN | 1026 | 1e-95 | 94 |
| 415 | 16 | 700991032H1 | SOYMON011 | g1055367 | BLASTN | 1070 | 1e-95 | 98 |
| 416 | 16 | 700740521H1 | SOYMON012 | g1055367 | BLASTN | 1187 | 1e-95 | 97 |
| 417 | 16 | 700685255H1 | SOYMON008 | g1055367 | BLASTN | 1191 | 1e-95 | 94 |
| 418 | 16 | 700846540H1 | SOYMON021 | g1055367 | BLASTN | 1203 | 1e-95 | 96 |
| 419 | 16 | 700684186H1 | SOYMON008 | g1055367 | BLASTN | 1239 | 1e-95 | 99 |
| 420 | 16 | 700565092H1 | SOYMON002 | g1055367 | BLASTN | 1239 | 1e-95 | 97 |
| 421 | 16 | 700898668H1 | SOYMON027 | g1055367 | BLASTN | 1240 | 1e-95 | 100 |
| 422 | 16 | 700997221H1 | SOYMON018 | g1055367 | BLASTN | 1240 | 1e-95 | 100 |
| 423 | 16 | 700737823H1 | SOYMON012 | g1055367 | BLASTN | 1240 | 1e-95 | 100 |
| 424 | 16 | 700740566H1 | SOYMON012 | g1055367 | BLASTN | 1241 | 1e-95 | 99 |
| 425 | 16 | 700726057H1 | SOYMON009 | g1055367 | BLASTN | 1241 | 1e-95 | 99 |
| 426 | 16 | 700658843H1 | SOYMON004 | g1055367 | BLASTN | 1243 | 1e-95 | 99 |
| 427 | 16 | 700737902H1 | SOYMON012 | g1055367 | BLASTN | 1244 | 1e-95 | 97 |

TABLE A*-continued

| Seq No. | Cluster ID | CloneID | Library | NCBI gi | Method | Score | P-value | % Ident |
|---|---|---|---|---|---|---|---|---|
| 428 | 16 | 700873809H1 | SOYMON018 | g1055367 | BLASTN | 1246 | 1e-95 | 99 |
| 429 | 16 | 701210184H1 | SOYMON035 | g1055367 | BLASTN | 508 | 1e-94 | 96 |
| 430 | 16 | 700874925H1 | SOYMON018 | g1055367 | BLASTN | 655 | 1e-94 | 98 |
| 431 | 16 | 700686258H1 | SOYMON008 | g1055367 | BLASTN | 657 | 1e-94 | 98 |
| 432 | 16 | 700742042H1 | SOYMON012 | g1055367 | BLASTN | 659 | 1e-94 | 97 |
| 433 | 16 | 700679995H2 | SOYMON011 | g1055367 | BLASTN | 731 | 1e-94 | 96 |
| 434 | 16 | 700682014H1 | SOYMON008 | g1079735 | BLASTN | 800 | 1e-94 | 96 |
| 435 | 16 | 700741910H1 | SOYMON012 | g1055367 | BLASTN | 906 | 1e-94 | 98 |
| 436 | 16 | 701107208H1 | SOYMON036 | g1055367 | BLASTN | 907 | 1e-94 | 98 |
| 437 | 16 | 700896405H1 | SOYMON027 | g1055367 | BLASTN | 936 | 1e-94 | 99 |
| 438 | 16 | 700961649H1 | SOYMON022 | g1055367 | BLASTN | 941 | 1e-94 | 96 |
| 439 | 16 | 700555260H1 | SOYMON001 | g1055367 | BLASTN | 1141 | 1e-94 | 97 |
| 440 | 16 | 700646292H1 | SOYMON012 | g1055367 | BLASTN | 1155 | 1e-94 | 93 |
| 441 | 16 | 700896794H1 | SOYMON027 | g1055367 | BLASTN | 1164 | 1e-94 | 99 |
| 442 | 16 | 700900448H1 | SOYMON027 | g1055367 | BLASTN | 1227 | 1e-94 | 95 |
| 443 | 16 | 700978796H1 | SOYMON009 | g1055367 | BLASTN | 1228 | 1e-94 | 99 |
| 444 | 16 | 700874579H1 | SOYMON018 | g1055367 | BLASTN | 1229 | 1e-94 | 99 |
| 445 | 16 | 700989693H1 | SOYMON011 | g1055367 | BLASTN | 1229 | 1e-94 | 99 |
| 446 | 16 | 700872477H1 | SOYMON018 | g1055367 | BLASTN | 1230 | 1e-94 | 98 |
| 447 | 16 | 700873947H1 | SOYMON018 | g1055367 | BLASTN | 1233 | 1e-94 | 99 |
| 448 | 16 | 700740463H1 | SOYMON012 | g1055367 | BLASTN | 1234 | 1e-94 | 99 |
| 449 | 16 | 700846439H1 | SOYMON021 | g1055367 | BLASTN | 1235 | 1e-94 | 100 |
| 450 | 16 | 701143505H2 | SOYMON038 | g1055367 | BLASTN | 1235 | 1e-94 | 100 |
| 451 | 16 | 700876930H1 | SOYMON018 | g1055367 | BLASTN | 1237 | 1e-94 | 98 |
| 452 | 16 | 700787131H2 | SOYMON011 | g1055367 | BLASTN | 480 | 1e-93 | 98 |
| 453 | 16 | 701107174H1 | SOYMON036 | g1055367 | BLASTN | 908 | 1e-93 | 99 |
| 454 | 16 | 700683318H1 | SOYMON008 | g1055367 | BLASTN | 921 | 1e-93 | 97 |
| 455 | 16 | 700738122H1 | SOYMON012 | g1055367 | BLASTN | 935 | 1e-93 | 100 |
| 456 | 16 | 700683238H1 | SOYMON008 | g1055367 | BLASTN | 975 | 1e-93 | 99 |
| 457 | 16 | 700741164H1 | SOYMON012 | g1055367 | BLASTN | 1014 | 1e-93 | 98 |
| 458 | 16 | 700896476H1 | SOYMON027 | g1055367 | BLASTN | 1075 | 1e-93 | 100 |
| 459 | 16 | 700993971H1 | SOYMON011 | g1055367 | BLASTN | 1149 | 1e-93 | 94 |
| 460 | 16 | 700895401H1 | SOYMON027 | g1055367 | BLASTN | 1171 | 1e-93 | 99 |
| 461 | 16 | 700790223H2 | SOYMON011 | g1055367 | BLASTN | 1215 | 1e-93 | 98 |
| 462 | 16 | 700945189H1 | SOYMON024 | g1055367 | BLASTN | 1215 | 1e-93 | 100 |
| 463 | 16 | 700741390H1 | SOYMON012 | g1055367 | BLASTN | 1215 | 1e-93 | 100 |
| 464 | 16 | 700737811H1 | SOYMON012 | g1055367 | BLASTN | 1219 | 1e-93 | 99 |
| 465 | 16 | 700785969H2 | SOYMON011 | g1055367 | BLASTN | 1220 | 1e-93 | 100 |
| 466 | 16 | 700740478H1 | SOYMON011 | g1055367 | BLASTN | 1220 | 1e-93 | 100 |
| 467 | 16 | 700790742H1 | SOYMON011 | g1055367 | BLASTN | 1221 | 1e-93 | 99 |
| 468 | 16 | 700740462H1 | SOYMON012 | g1055367 | BLASTN | 1222 | 1e-93 | 98 |
| 469 | 16 | 700657760H1 | SOYMON004 | g1055367 | BLASTN | 1224 | 1e-93 | 99 |
| 470 | 16 | 700659336H1 | SOYMON004 | g1055367 | BLASTN | 1225 | 1e-93 | 96 |
| 471 | 16 | 700790904H1 | SOYMON011 | g1055367 | BLASTN | 616 | 1e-92 | 99 |
| 472 | 16 | 700738911H1 | SOYMON012 | g1055367 | BLASTN | 741 | 1e-92 | 100 |
| 473 | 16 | 700872532H1 | SOYMON018 | g1055367 | BLASTN | 743 | 1e-92 | 99 |
| 474 | 16 | 700967765H1 | SOYMON033 | g1055367 | BLASTN | 896 | 1e-92 | 99 |
| 475 | 16 | 700876909H1 | SOYMON018 | g1055367 | BLASTN | 913 | 1e-92 | 98 |
| 476 | 16 | 700989032H1 | SOYMON011 | g1055367 | BLASTN | 971 | 1e-92 | 99 |
| 477 | 16 | 700872401H1 | SOYMON018 | g1055367 | BLASTN | 1011 | 1e-92 | 98 |
| 478 | 16 | 701104761H1 | SOYMON036 | g1055367 | BLASTN | 1133 | 1e-92 | 93 |
| 479 | 16 | 700787439H2 | SOYMON011 | g1055367 | BLASTN | 1133 | 1e-92 | 93 |
| 480 | 16 | 700682703H1 | SOYMON008 | g1055367 | BLASTN | 1136 | 1e-92 | 93 |
| 481 | 16 | 700788179H1 | SOYMON011 | g1055367 | BLASTN | 1155 | 1e-92 | 98 |
| 482 | 16 | 700724905H1 | SOYMON009 | g1055367 | BLASTN | 1173 | 1e-92 | 98 |
| 483 | 16 | 700660182H1 | SOYMON004 | g1055367 | BLASTN | 1208 | 1e-92 | 99 |
| 484 | 16 | 700876415H1 | SOYMON018 | g1055367 | BLASTN | 1208 | 1e-92 | 99 |
| 485 | 16 | 700738544H1 | SOYMON012 | g1055367 | BLASTN | 1210 | 1e-92 | 100 |
| 486 | 16 | 700894558H1 | SOYMON024 | g1055367 | BLASTN | 1211 | 1e-92 | 99 |
| 487 | 16 | 700740901H1 | SOYMON012 | g1055367 | BLASTN | 428 | 1e-91 | 97 |
| 488 | 16 | 700683039H1 | SOYMON008 | g1055367 | BLASTN | 621 | 1e-91 | 97 |
| 489 | 16 | 700980945H1 | SOYMON009 | g1055367 | BLASTN | 624 | 1e-91 | 93 |
| 490 | 16 | 700557890H1 | SOYMON001 | g1055367 | BLASTN | 871 | 1e-91 | 97 |
| 491 | 16 | 700863566H1 | SOYMON027 | g1055367 | BLASTN | 1127 | 1e-91 | 95 |
| 492 | 16 | 701108362H1 | SOYMON036 | g1055367 | BLASTN | 1129 | 1e-91 | 95 |
| 493 | 16 | 700658190H1 | SOYMON004 | g1055367 | BLASTN | 1136 | 1e-91 | 94 |
| 494 | 16 | 700994486H1 | SOYMON011 | g1055367 | BLASTN | 1144 | 1e-91 | 94 |
| 495 | 16 | 700553851H1 | SOYMON001 | g1055367 | BLASTN | 1151 | 1e-91 | 93 |
| 496 | 16 | 700683005H1 | SOYMON008 | g1055367 | BLASTN | 1159 | 1e-91 | 98 |
| 497 | 16 | 700789709H1 | SOYMON011 | g1055367 | BLASTN | 1191 | 1e-91 | 99 |
| 498 | 16 | 700752960H1 | SOYMON014 | g1055367 | BLASTN | 1196 | 1e-91 | 99 |
| 499 | 16 | 700959845H1 | SOYMON022 | g1055367 | BLASTN | 1196 | 1e-91 | 99 |
| 500 | 16 | 700738866H1 | SOYMON012 | g1055367 | BLASTN | 1201 | 1e-91 | 99 |
| 501 | 16 | 701064223H1 | SOYMON034 | g1055367 | BLASTN | 510 | 1e-90 | 98 |
| 502 | 16 | 701002414H1 | SOYMON018 | g1055367 | BLASTN | 577 | 1e-90 | 97 |
| 503 | 16 | 700992711H1 | SOYMON011 | g1055367 | BLASTN | 751 | 1e-90 | 98 |
| 504 | 16 | 700680079H2 | SOYMON008 | g1055367 | BLASTN | 807 | 1e-90 | 97 |

TABLE A*-continued

| Seq No. | Cluster ID | CloneID | Library | NCBI gi | Method | Score | P-value | % Ident |
|---|---|---|---|---|---|---|---|---|
| 505 | 16 | 700992131H1 | SOYMON011 | g1055367 | BLASTN | 814 | 1e-90 | 98 |
| 506 | 16 | 700945939H1 | SOYMON024 | g1055367 | BLASTN | 872 | 1e-90 | 98 |
| 507 | 16 | 700995283H1 | SOYMON011 | g1055367 | BLASTN | 896 | 1e-90 | 97 |
| 508 | 16 | 700790720H1 | SOYMON011 | g1055367 | BLASTN | 898 | 1e-90 | 98 |
| 509 | 16 | 700557607H1 | SOYMON001 | g1055367 | BLASTN | 908 | 1e-90 | 91 |
| 510 | 16 | 701146551H1 | SOYMON031 | g1055367 | BLASTN | 923 | 1e-90 | 98 |
| 511 | 16 | 701002369H1 | SOYMON018 | g1055367 | BLASTN | 953 | 1e-90 | 99 |
| 512 | 16 | 700682563H2 | SOYMON008 | g1055367 | BLASTN | 1045 | 1e-90 | 100 |
| 513 | 16 | 700555211H1 | SOYMON001 | g1055367 | BLASTN | 1115 | 1e-90 | 100 |
| 514 | 16 | 700656287H1 | SOYMON004 | g1055367 | BLASTN | 1117 | 1e-90 | 96 |
| 515 | 16 | 700791902H1 | SOYMON011 | g1055367 | BLASTN | 1182 | 1e-90 | 98 |
| 516 | 16 | 700876346H1 | SOYMON018 | g1055367 | BLASTN | 1183 | 1e-90 | 96 |
| 517 | 16 | 700681759H1 | SOYMON008 | g1055367 | BLASTN | 1183 | 1e-90 | 99 |
| 518 | 16 | 701105254H1 | SOYMON036 | g1055367 | BLASTN | 1185 | 1e-90 | 100 |
| 519 | 16 | 700873322H1 | SOYMON018 | g1055367 | BLASTN | 1187 | 1e-90 | 98 |
| 520 | 16 | 700741118H1 | SOYMON012 | g1055367 | BLASTN | 1188 | 1e-90 | 96 |
| 521 | 16 | 700681782H1 | SOYMON008 | g1055367 | BLASTN | 1190 | 1e-90 | 100 |
| 522 | 16 | 700746782H1 | SOYMON013 | g1055367 | BLASTN | 1190 | 1e-90 | 100 |
| 523 | 16 | 700656875H1 | SOYMON004 | g1079735 | BLASTN | 736 | 1e-89 | 97 |
| 524 | 16 | 700993783H1 | SOYMON011 | g1055367 | BLASTN | 800 | 1e-89 | 100 |
| 525 | 16 | 700738524H1 | SOYMON012 | g1055367 | BLASTN | 846 | 1e-89 | 98 |
| 526 | 16 | 701214655H1 | SOYMON035 | g1055367 | BLASTN | 881 | 1e-89 | 98 |
| 527 | 16 | 700740449H1 | SOYMON012 | g1055367 | BLASTN | 924 | 1e-89 | 97 |
| 528 | 16 | 700556379H1 | SOYMON001 | g1055367 | BLASTN | 1096 | 1e-89 | 95 |
| 529 | 16 | 700660523H1 | SOYMON004 | g1055367 | BLASTN | 1097 | 1e-89 | 92 |
| 530 | 16 | 700791055H1 | SOYMON011 | g1055367 | BLASTN | 1173 | 1e-89 | 99 |
| 531 | 16 | 700656671H1 | SOYMON004 | g1055367 | BLASTN | 1175 | 1e-89 | 93 |
| 532 | 16 | 700740963H1 | SOYMON012 | g1055367 | BLASTN | 616 | 1e-88 | 99 |
| 533 | 16 | 701107017H1 | SOYMON036 | g1055367 | BLASTN | 617 | 1e-88 | 96 |
| 534 | 16 | 701139539H1 | SOYMON038 | g1055367 | BLASTN | 644 | 1e-88 | 95 |
| 535 | 16 | 700946365H1 | SOYMON024 | g170057 | BLASTN | 649 | 1e-88 | 97 |
| 536 | 16 | 700682509H2 | SOYMON008 | g1055367 | BLASTN | 844 | 1e-88 | 97 |
| 537 | 16 | 700994024H1 | SOYMON011 | g1055367 | BLASTN | 844 | 1e-88 | 98 |
| 538 | 16 | 700659886H1 | SOYMON004 | g1055367 | BLASTN | 850 | 1e-88 | 98 |
| 539 | 16 | 700755378H1 | SOYMON014 | g1055367 | BLASTN | 881 | 1e-88 | 98 |
| 540 | 16 | 700847182H1 | SOYMON021 | g1055367 | BLASTN | 916 | 1e-88 | 97 |
| 541 | 16 | 700789017H2 | SOYMON011 | g1055367 | BLASTN | 1110 | 1e-88 | 96 |
| 542 | 16 | 700657694H1 | SOYMON004 | g1055367 | BLASTN | 1160 | 1e-88 | 97 |
| 543 | 16 | 700894533H1 | SOYMON024 | g1055367 | BLASTN | 1164 | 1e-88 | 99 |
| 544 | 16 | 700989594H1 | SOYMON011 | g1055367 | BLASTN | 1166 | 1e-88 | 99 |
| 545 | 16 | 700560570H1 | SOYMON001 | g1055367 | BLASTN | 978 | 1e-87 | 97 |
| 546 | 16 | 700656095H1 | SOYMON004 | g1055367 | BLASTN | 1056 | 1e-87 | 95 |
| 547 | 16 | 700656137H1 | SOYMON004 | g1055367 | BLASTN | 1100 | 1e-87 | 100 |
| 548 | 16 | 700900212H1 | SOYMON027 | g1055367 | BLASTN | 1106 | 1e-87 | 98 |
| 549 | 16 | 700871945H1 | SOYMON018 | g1055367 | BLASTN | 1150 | 1e-87 | 100 |
| 550 | 16 | 701144650H1 | SOYMON031 | g1055367 | BLASTN | 1154 | 1e-87 | 99 |
| 551 | 16 | 700740357H1 | SOYMON012 | g1055367 | BLASTN | 566 | 1e-86 | 100 |
| 552 | 16 | 700790635H2 | SOYMON011 | g1079735 | BLASTN | 630 | 1e-86 | 98 |
| 553 | 16 | 700843795H1 | SOYMON021 | g1055367 | BLASTN | 834 | 1e-86 | 97 |
| 554 | 16 | 700790207H2 | SOYMON011 | g1055367 | BLASTN | 1062 | 1e-86 | 94 |
| 555 | 16 | 700725303H1 | SOYMON009 | g1055367 | BLASTN | 1064 | 1e-86 | 94 |
| 556 | 16 | 700739809H1 | SOYMON012 | g1055367 | BLASTN | 1067 | 1e-86 | 94 |
| 557 | 16 | 700659535H1 | SOYMON004 | g1055367 | BLASTN | 1068 | 1e-86 | 92 |
| 558 | 16 | 700740653H1 | SOYMON012 | g1055367 | BLASTN | 1071 | 1e-86 | 94 |
| 559 | 16 | 700993558H1 | SOYMON011 | g1055367 | BLASTN | 1071 | 1e-86 | 94 |
| 560 | 16 | 701153296H1 | SOYMON031 | g1079735 | BLASTN | 1101 | 1e-86 | 99 |
| 561 | 16 | 700992113H1 | SOYMON011 | g1055367 | BLASTN | 1104 | 1e-86 | 98 |
| 562 | 16 | 700555503H1 | SOYMON001 | g1055367 | BLASTN | 1133 | 1e-86 | 89 |
| 563 | 16 | 700792226H1 | SOYMON011 | g170057 | BLASTN | 1142 | 1e-86 | 99 |
| 564 | 16 | 701105302H1 | SOYMON036 | g1055367 | BLASTN | 1143 | 1e-86 | 89 |
| 565 | 16 | 700871129H1 | SOYMON018 | g1055367 | BLASTN | 1143 | 1e-86 | 94 |
| 566 | 16 | 700654859H1 | SOYMON004 | g1055367 | BLASTN | 519 | 1e-85 | 97 |
| 567 | 16 | 700656039H1 | SOYMON004 | g1055367 | BLASTN | 615 | 1e-85 | 98 |
| 568 | 16 | 700739061H1 | SOYMON012 | g1055367 | BLASTN | 642 | 1e-85 | 96 |
| 569 | 16 | 700655048H1 | SOYMON004 | g1055367 | BLASTN | 689 | 1e-85 | 95 |
| 570 | 16 | 700680540H1 | SOYMON008 | g1055367 | BLASTN | 696 | 1e-85 | 98 |
| 571 | 16 | 700730791H1 | SOYMON009 | g1055367 | BLASTN | 811 | 1e-85 | 99 |
| 572 | 16 | 700991246H1 | SOYMON011 | g1055367 | BLASTN | 893 | 1e-85 | 95 |
| 573 | 16 | 700876824H1 | SOYMON018 | g1055367 | BLASTN | 967 | 1e-85 | 98 |
| 574 | 16 | 700791594H1 | SOYMON011 | g1055367 | BLASTN | 1054 | 1e-85 | 94 |
| 575 | 16 | 700739144H1 | SOYMON012 | g1055367 | BLASTN | 1090 | 1e-85 | 100 |
| 576 | 16 | 700872171H1 | SOYMON018 | g1055367 | BLASTN | 1121 | 1e-85 | 99 |
| 577 | 16 | 700871089H1 | SOYMON018 | g1055367 | BLASTN | 1122 | 1e-85 | 95 |
| 578 | 16 | 700787735H2 | SOYMON011 | g1055367 | BLASTN | 1123 | 1e-85 | 95 |
| 579 | 16 | 700791676H1 | SOYMON011 | g1055367 | BLASTN | 1124 | 1e-85 | 96 |
| 580 | 16 | 700737752H1 | SOYMON012 | g1055367 | BLASTN | 1128 | 1e-85 | 92 |
| 581 | 16 | 700681539H1 | SOYMON008 | g1055367 | BLASTN | 495 | 1e-84 | 97 |

TABLE A*-continued

| Seq No. | Cluster ID | CloneID | Library | NCBI gi | Method | Score | P-value | % Ident |
|---|---|---|---|---|---|---|---|---|
| 582 | 16 | 700994222H1 | SOYMON011 | g1055367 | BLASTN | 653 | 1e-84 | 99 |
| 583 | 16 | 701000001H1 | SOYMON018 | g1055367 | BLASTN | 743 | 1e-84 | 97 |
| 584 | 16 | 700874142H1 | SOYMON018 | g1055367 | BLASTN | 803 | 1e-84 | 99 |
| 585 | 16 | 701106980H1 | SOYMON036 | g1055367 | BLASTN | 837 | 1e-84 | 98 |
| 586 | 16 | 700684527H1 | SOYMON008 | g1055367 | BLASTN | 959 | 1e-84 | 98 |
| 587 | 16 | 700738477H1 | SOYMON012 | g1055367 | BLASTN | 1111 | 1e-84 | 99 |
| 588 | 16 | 701155411H1 | SOYMON031 | g1055367 | BLASTN | 1112 | 1e-84 | 99 |
| 589 | 16 | 700994428H1 | SOYMON011 | g170057 | BLASTN | 457 | 1e-83 | 98 |
| 590 | 16 | 700738079H1 | SOYMON012 | g1079735 | BLASTN | 496 | 1e-83 | 95 |
| 591 | 16 | 700658259H1 | SOYMON004 | g1055367 | BLASTN | 510 | 1e-83 | 98 |
| 592 | 16 | 701062095H1 | SOYMON033 | g1055367 | BLASTN | 599 | 1e-83 | 94 |
| 593 | 16 | 700730588H1 | SOYMON009 | g1055367 | BLASTN | 652 | 1e-83 | 95 |
| 594 | 16 | 700900426H1 | SOYMON027 | g1055367 | BLASTN | 653 | 1e-83 | 96 |
| 595 | 16 | 700994405H1 | SOYMON011 | g1055367 | BLASTN | 760 | 1e-83 | 98 |
| 596 | 16 | 700743222H1 | SOYMON012 | g1055367 | BLASTN | 874 | 1e-83 | 98 |
| 597 | 16 | 701108454H1 | SOYMON036 | g1055367 | BLASTN | 908 | 1e-83 | 91 |
| 598 | 16 | 701061556H1 | SOYMON033 | g1055367 | BLASTN | 936 | 1e-83 | 99 |
| 599 | 16 | 700871533H1 | SOYMON018 | g1055367 | BLASTN | 1097 | 1e-83 | 99 |
| 600 | 16 | 700558546H1 | SOYMON001 | g1079735 | BLASTN | 408 | 1e-82 | 95 |
| 601 | 16 | 700741006H1 | SOYMON012 | g1055367 | BLASTN | 446 | 1e-82 | 95 |
| 602 | 16 | 700994239H1 | SOYMON011 | g1055367 | BLASTN | 611 | 1e-82 | 94 |
| 603 | 16 | 700685501H1 | SOYMON008 | g1055367 | BLASTN | 620 | 1e-82 | 100 |
| 604 | 16 | 700741993H1 | SOYMON012 | g1055367 | BLASTN | 775 | 1e-82 | 100 |
| 605 | 16 | 700741994H1 | SOYMON012 | g1055367 | BLASTN | 780 | 1e-82 | 100 |
| 606 | 16 | 700741275H1 | SOYMON012 | g1055367 | BLASTN | 955 | 1e-82 | 100 |
| 607 | 16 | 700741979H1 | SOYMON012 | g1055367 | BLASTN | 1038 | 1e-82 | 95 |
| 608 | 16 | 700873834H1 | SOYMON018 | g1055367 | BLASTN | 1088 | 1e-82 | 98 |
| 609 | 16 | 700872831H1 | SOYMON018 | g1055367 | BLASTN | 710 | 1e-81 | 96 |
| 610 | 16 | 700684862H1 | SOYMON008 | g1055367 | BLASTN | 772 | 1e-81 | 98 |
| 611 | 16 | 700991906H1 | SOYMON011 | g1055367 | BLASTN | 777 | 1e-81 | 98 |
| 612 | 16 | 700655544H1 | SOYMON004 | g1055367 | BLASTN | 840 | 1e-81 | 98 |
| 613 | 16 | 700740768H1 | SOYMON012 | g1055367 | BLASTN | 1007 | 1e-81 | 99 |
| 614 | 16 | 700992972H1 | SOYMON011 | g1055367 | BLASTN | 1073 | 1e-81 | 97 |
| 615 | 16 | 700740745H1 | SOYMON012 | g1055367 | BLASTN | 1079 | 1e-81 | 99 |
| 616 | 16 | 700728041H1 | SOYMON009 | g1055367 | BLASTN | 1080 | 1e-81 | 87 |
| 617 | 16 | 700729690H1 | SOYMON009 | g1055367 | BLASTN | 1083 | 1e-81 | 95 |
| 618 | 16 | 700743048H1 | SOYMON012 | g1055367 | BLASTN | 388 | 1e-80 | 92 |
| 619 | 16 | 700790361H2 | SOYMON011 | g1055367 | BLASTN | 588 | 1e-80 | 93 |
| 620 | 16 | 700896585H1 | SOYMON027 | g1055367 | BLASTN | 588 | 1e-80 | 100 |
| 621 | 16 | 701104185H1 | SOYMON036 | g1055367 | BLASTN | 740 | 1e-80 | 99 |
| 622 | 16 | 700741286H1 | SOYMON012 | g1055367 | BLASTN | 756 | 1e-80 | 99 |
| 623 | 16 | 700737954H1 | SOYMON012 | g1055367 | BLASTN | 916 | 1e-80 | 91 |
| 624 | 16 | 700738883H1 | SOYMON012 | g1055367 | BLASTN | 1070 | 1e-80 | 94 |
| 625 | 16 | 700872433H1 | SOYMON018 | g170057 | BLASTN | 416 | 1e-79 | 94 |
| 626 | 16 | 701059827H1 | SOYMON033 | g1055367 | BLASTN | 438 | 1e-79 | 95 |
| 627 | 16 | 701117550H2 | SOYMON037 | g1055367 | BLASTN | 488 | 1e-79 | 96 |
| 628 | 16 | 700743227H1 | SOYMON012 | g1055367 | BLASTN | 670 | 1e-79 | 96 |
| 629 | 16 | 700990060H1 | SOYMON011 | g1079735 | BLASTN | 688 | 1e-79 | 96 |
| 630 | 16 | 700789891H2 | SOYMON011 | g1079735 | BLASTN | 892 | 1e-79 | 98 |
| 631 | 16 | 700739160H1 | SOYMON012 | g1055367 | BLASTN | 1008 | 1e-79 | 95 |
| 632 | 16 | 700900244H1 | SOYMON027 | g1055367 | BLASTN | 1051 | 1e-79 | 85 |
| 633 | 16 | 700680230H2 | SOYMON008 | g1055367 | BLASTN | 1057 | 1e-79 | 93 |
| 634 | 16 | 700991489H1 | SOYMON011 | g1055367 | BLASTN | 520 | 1e-78 | 94 |
| 635 | 16 | 700744694H1 | SOYMON013 | g1055367 | BLASTN | 521 | 1e-78 | 97 |
| 636 | 16 | 700659755H1 | SOYMON004 | g1055367 | BLASTN | 711 | 1e-78 | 92 |
| 637 | 16 | 700741013H1 | SOYMON012 | g1055367 | BLASTN | 730 | 1e-78 | 91 |
| 638 | 16 | 700990946H1 | SOYMON011 | g1079735 | BLASTN | 1046 | 1e-78 | 99 |
| 639 | 16 | 700791542H1 | SOYMON011 | g1055367 | BLASTN | 625 | 1e-77 | 97 |
| 640 | 16 | 700682942H1 | SOYMON008 | g1055367 | BLASTN | 683 | 1e-77 | 98 |
| 641 | 16 | 700994722H1 | SOYMON011 | g1055367 | BLASTN | 801 | 1e-77 | 93 |
| 642 | 16 | 700788601H1 | SOYMON011 | g1055367 | BLASTN | 1036 | 1e-77 | 99 |
| 643 | 16 | 700872290H1 | SOYMON018 | g1079735 | BLASTN | 1040 | 1e-77 | 98 |
| 644 | 16 | 700741012H1 | SOYMON012 | g1055367 | BLASTN | 386 | 1e-76 | 95 |
| 645 | 16 | 700990993H1 | SOYMON011 | g1055367 | BLASTN | 712 | 1e-76 | 96 |
| 646 | 16 | 700870628H1 | SOYMON018 | g1055367 | BLASTN | 760 | 1e-76 | 95 |
| 647 | 16 | 700740220H1 | SOYMON012 | g1055367 | BLASTN | 830 | 1e-76 | 94 |
| 648 | 16 | 700683853H1 | SOYMON008 | g1079735 | BLASTN | 972 | 1e-76 | 98 |
| 649 | 16 | 700657177H1 | SOYMON004 | g1055367 | BLASTN | 986 | 1e-76 | 99 |
| 650 | 16 | 700740956H1 | SOYMON012 | g1055367 | BLASTN | 553 | 1e-75 | 93 |
| 651 | 16 | 700683812H1 | SOYMON008 | g1055367 | BLASTN | 672 | 1e-75 | 98 |
| 652 | 16 | 701058565H1 | SOYMON033 | g1055367 | BLASTN | 834 | 1e-75 | 96 |
| 653 | 16 | 700789725H1 | SOYMON011 | g1079735 | BLASTN | 1014 | 1e-75 | 98 |
| 654 | 16 | 700787907H1 | SOYMON011 | g1055367 | BLASTN | 546 | 1e-74 | 92 |
| 655 | 16 | 700870534H1 | SOYMON018 | g170057 | BLASTN | 646 | 1e-74 | 92 |
| 656 | 16 | 700743023H1 | SOYMON012 | g1055367 | BLASTN | 656 | 1e-74 | 93 |
| 657 | 16 | 700557205H1 | SOYMON001 | g1079735 | BLASTN | 775 | 1e-74 | 93 |
| 658 | 16 | 700646080H1 | SOYMON011 | g1055367 | BLASTN | 926 | 1e-74 | 97 |

TABLE A*-continued

| Seq No. | Cluster ID | CloneID | Library | NCBI gi | Method | Score | P-value | % Ident |
|---|---|---|---|---|---|---|---|---|
| 659 | 16 | 700998541H1 | SOYMON018 | g1055367 | BLASTN | 703 | 1e−73 | 100 |
| 660 | 16 | 700684330H1 | SOYMON008 | g1079735 | BLASTN | 863 | 1e−73 | 94 |
| 661 | 16 | 700739656H1 | SOYMON012 | g1055367 | BLASTN | 987 | 1e−73 | 88 |
| 662 | 16 | 700739768H1 | SOYMON012 | g1055367 | BLASTN | 481 | 1e−72 | 88 |
| 663 | 16 | 700683980H1 | SOYMON008 | g1055367 | BLASTN | 654 | 1e−72 | 92 |
| 664 | 16 | 700743962H1 | SOYMON012 | g1079735 | BLASTN | 975 | 1e−72 | 100 |
| 665 | 16 | 700742888H1 | SOYMON012 | g1079735 | BLASTN | 960 | 1e−71 | 100 |
| 666 | 16 | 700744006H1 | SOYMON012 | g1079735 | BLASTN | 962 | 1e−71 | 97 |
| 667 | 16 | 700871648H1 | SOYMON018 | g1055367 | BLASTN | 887 | 1e−70 | 92 |
| 668 | 16 | 700656924H1 | SOYMON004 | g1055367 | BLASTN | 361 | 1e−69 | 88 |
| 669 | 16 | 700743814H1 | SOYMON012 | g1079735 | BLASTN | 942 | 1e−69 | 98 |
| 670 | 16 | 700995036H1 | SOYMON011 | g1079735 | BLASTN | 930 | 1e−68 | 97 |
| 671 | 16 | 700991405H1 | SOYMON011 | g1079735 | BLASTN | 477 | 1e−67 | 96 |
| 672 | 16 | 700741463H1 | SOYMON012 | g1055367 | BLASTN | 537 | 1e−67 | 87 |
| 673 | 16 | 700870507H1 | SOYMON018 | g1055367 | BLASTN | 566 | 1e−67 | 94 |
| 674 | 16 | 701123032H1 | SOYMON037 | g1055367 | BLASTN | 687 | 1e−67 | 85 |
| 675 | 16 | 700946185H1 | SOYMON024 | g1055367 | BLASTN | 862 | 1e−67 | 96 |
| 676 | 16 | 700994265H1 | SOYMON011 | g1055367 | BLASTN | 907 | 1e−67 | 86 |
| 677 | 16 | 700742553H1 | SOYMON012 | g1055367 | BLASTN | 626 | 1e−66 | 98 |
| 678 | 16 | 700655130H1 | SOYMON004 | g1055367 | BLASTN | 895 | 1e−66 | 80 |
| 679 | 16 | 700656978H1 | SOYMON004 | g1055367 | BLASTN | 905 | 1e−66 | 82 |
| 680 | 16 | 700743939H1 | SOYMON012 | g1055367 | BLASTN | 570 | 1e−65 | 100 |
| 681 | 16 | 700742580H1 | SOYMON012 | g1055367 | BLASTN | 580 | 1e−65 | 99 |
| 682 | 16 | 700872884H1 | SOYMON018 | g1079735 | BLASTN | 737 | 1e−65 | 92 |
| 683 | 16 | 701157394H1 | SOYMON031 | g1079735 | BLASTN | 479 | 1e−64 | 95 |
| 684 | 16 | 700992046H1 | SOYMON011 | g1079735 | BLASTN | 853 | 1e−62 | 99 |
| 685 | 16 | 700808471H1 | SOYMON024 | g18755 | BLASTN | 805 | 1e−60 | 100 |
| 686 | 16 | 700992056H1 | SOYMON011 | g1055367 | BLASTN | 830 | 1e−60 | 100 |
| 687 | 16 | 700975486H1 | SOYMON009 | g1055367 | BLASTN | 764 | 1e−59 | 93 |
| 688 | 16 | 700894434H1 | SOYMON024 | g1055367 | BLASTN | 622 | 1e−58 | 95 |
| 689 | 16 | 700992089H1 | SOYMON011 | g1055367 | BLASTN | 805 | 1e−58 | 100 |
| 690 | 16 | 700744590H1 | SOYMON013 | g1055367 | BLASTN | 541 | 1e−56 | 90 |
| 691 | 16 | 700787253H2 | SOYMON011 | g1055367 | BLASTN | 783 | 1e−56 | 95 |
| 692 | 16 | 700726279H1 | SOYMON009 | g1055367 | BLASTN | 604 | 1e−55 | 97 |
| 693 | 16 | 700995242H1 | SOYMON011 | g1079735 | BLASTN | 662 | 1e−55 | 82 |
| 694 | 16 | 700659992H1 | SOYMON004 | g1055367 | BLASTN | 768 | 1e−55 | 98 |
| 695 | 16 | 700994961H1 | SOYMON011 | g1055367 | BLASTN | 756 | 1e−54 | 96 |
| 696 | 16 | 700742875H1 | SOYMON012 | g1055367 | BLASTN | 758 | 1e−54 | 93 |
| 697 | 16 | 700995941H1 | SOYMON018 | g1055367 | BLASTN | 436 | 1e−52 | 98 |
| 698 | 16 | 700743887H1 | SOYMON012 | g1055367 | BLASTN | 446 | 1e−51 | 99 |
| 699 | 16 | 700656790H1 | SOYMON004 | g1055367 | BLASTN | 484 | 1e−50 | 89 |
| 700 | 16 | 700902134H1 | SOYMON027 | g1055367 | BLASTN | 711 | 1e−50 | 99 |
| 701 | 16 | 700996857H1 | SOYMON018 | g1079735 | BLASTN | 715 | 1e−50 | 100 |
| 702 | 16 | 700685138H1 | SOYMON008 | g1055367 | BLASTN | 385 | 1e−49 | 97 |
| 703 | 16 | 700738218H1 | SOYMON012 | g1079735 | BLASTN | 701 | 1e−49 | 99 |
| 704 | 16 | 700740869H1 | SOYMON012 | g1055367 | BLASTN | 680 | 1e−48 | 100 |
| 705 | 16 | 701002564H1 | SOYMON018 | g1079735 | BLASTN | 688 | 1e−48 | 99 |
| 706 | 16 | 700900791H1 | SOYMON027 | g1055367 | BLASTN | 361 | 1e−46 | 97 |
| 707 | 16 | 701109964H1 | SOYMON036 | g1055367 | BLASTN | 441 | 1e−45 | 87 |
| 708 | 16 | 700991810H1 | SOYMON011 | g1055367 | BLASTN | 377 | 1e−44 | 92 |
| 709 | 16 | 700786845H2 | SOYMON011 | g170057 | BLASTN | 440 | 1e−42 | 95 |
| 710 | 16 | 700655630H1 | SOYMON004 | g1055367 | BLASTN | 486 | 1e−42 | 97 |
| 711 | 16 | 700739315H1 | SOYMON012 | g1079735 | BLASTN | 610 | 1e−42 | 100 |
| 712 | 16 | 700788023H1 | SOYMON011 | g1055367 | BLASTN | 602 | 1e−41 | 75 |
| 713 | 16 | 700743017H1 | SOYMON012 | g170057 | BLASTN | 349 | 1e−40 | 89 |
| 714 | 16 | 700739471H1 | SOYMON012 | g1055367 | BLASTN | 590 | 1e−40 | 100 |
| 715 | 16 | 700740508H1 | SOYMON012 | g1079735 | BLASTN | 593 | 1e−40 | 99 |
| 716 | 16 | 700790942H1 | SOYMON011 | g170057 | BLASTN | 597 | 1e−40 | 86 |
| 717 | 16 | 700902452H1 | SOYMON027 | g1079735 | BLASTN | 395 | 1e−39 | 96 |
| 718 | 16 | 700658005H1 | SOYMON004 | g1079735 | BLASTN | 575 | 1e−39 | 100 |
| 719 | 16 | 700739396H1 | SOYMON012 | g1079735 | BLASTN | 565 | 1e−38 | 100 |
| 720 | 16 | 700863675H1 | SOYMON027 | g1055367 | BLASTN | 346 | 1e−37 | 93 |
| 721 | 16 | 700657081H1 | SOYMON004 | g1055367 | BLASTN | 461 | 1e−37 | 89 |
| 722 | 16 | 700743310H1 | SOYMON012 | g1055367 | BLASTN | 557 | 1e−37 | 96 |
| 723 | 16 | 700739139H1 | SOYMON012 | g1079735 | BLASTN | 543 | 1e−36 | 99 |
| 724 | 16 | 700742781H1 | SOYMON012 | g1055367 | BLASTN | 355 | 1e−35 | 100 |
| 725 | 16 | 700742729H1 | SOYMON012 | g1079735 | BLASTN | 532 | 1e−35 | 96 |
| 726 | 16 | 700740842H1 | SOYMON012 | g1055367 | BLASTN | 204 | 1e−32 | 97 |
| 727 | 16 | 700730732H1 | SOYMON009 | g1055367 | BLASTN | 320 | 1e−32 | 94 |
| 728 | 16 | 700742728H1 | SOYMON012 | g1055367 | BLASTN | 482 | 1e−31 | 94 |
| 729 | 16 | 700845311H1 | SOYMON021 | g1055367 | BLASTN | 483 | 1e−31 | 98 |
| 730 | 16 | 700874150H1 | SOYMON018 | g18754 | BLASTN | 340 | 1e−30 | 93 |
| 731 | 16 | 700958782H1 | SOYMON022 | g1055367 | BLASTN | 475 | 1e−30 | 100 |
| 732 | 16 | 700729671H1 | SOYMON009 | g1079735 | BLASTN | 310 | 1e−26 | 97 |
| 733 | 16 | 700989477H1 | SOYMON011 | g1055367 | BLASTN | 358 | 1e−26 | 98 |
| 734 | 16 | 700790532H2 | SOYMON011 | g1055367 | BLASTN | 330 | 1e−24 | 99 |
| 735 | 16 | 700895830H1 | SOYMON027 | g1055367 | BLASTN | 286 | 1e−23 | 96 |

TABLE A*-continued

| Seq No. | Cluster ID | CloneID | Library | NCBI gi | Method | Score | P-value | % Ident |
|---|---|---|---|---|---|---|---|---|
| 736 | 16 | 700560643H1 | SOYMON001 | g1055367 | BLASTN | 295 | 1e−21 | 92 |
| 737 | 16 | 700559990H1 | SOYMON001 | g1079735 | BLASTN | 238 | 1e−20 | 98 |
| 738 | 16 | 700895956H1 | SOYMON027 | g1055367 | BLASTN | 193 | 1e−19 | 97 |
| 739 | 16 | 700680886H1 | SOYMON008 | g1055367 | BLASTN | 230 | 1e−17 | 82 |
| 740 | 16 | 700738267H1 | SOYMON012 | g1055367 | BLASTN | 246 | 1e−15 | 99 |
| 741 | 16 | 700741928H1 | SOYMON012 | g1055367 | BLASTN | 207 | 1e−12 | 90 |
| 742 | 16 | 700657321H1 | SOYMON004 | g1536889 | BLASTX | 92 | 1e−11 | 88 |
| 743 | 16 | 700742542H1 | SOYMON012 | g1079735 | BLASTN | 212 | 1e−10 | 97 |
| 744 | 16 | 700789463H2 | SOYMON011 | g1055367 | BLASTN | 159 | 1e−8 | 89 |
| 745 | 317 | 700998406H1 | SOYMON018 | g2323417 | BLASTN | 258 | 1e−33 | 80 |
| 746 | 317 | 700733345H1 | SOYMON010 | g2323461 | BLASTN | 292 | 1e−33 | 85 |
| 747 | 317 | 700681456H2 | SOYMON008 | g2323417 | BLASTN | 239 | 1e−23 | 79 |
| 748 | 317 | 700992806H1 | SOYMON011 | g2323461 | BLASTN | 252 | 1e−12 | 62 |
| 749 | -GM16862 | LIB3055-001-Q1-B1-G3 | LIB3055 | g1055367 | BLASTN | 482 | 1e−71 | 89 |
| 750 | -GM16898 | LIB3055-001-Q1-B1-H4 | LIB3055 | g1055367 | BLASTN | 594 | 1e−59 | 97 |
| 751 | -GM17216 | LIB3055-012-Q1-N1-H2 | LIB3055 | g1055367 | BLASTN | 299 | 1e−44 | 90 |
| 752 | -GM30860 | LIB3050-005-Q1-K1-D5 | LIB3050 | g21049 | BLASTN | 262 | 1e−21 | 68 |
| 753 | -GM45237 | LIB3073-001-Q1-K1-F7 | LIB3073 | g1055367 | BLASTN | 570 | 1e−38 | 64 |
| 754 | -GM45275 | LIB3073-001-Q1-K1-H6 | LIB3073 | g170057 | BLASTN | 665 | 1e−90 | 83 |
| 755 | -GM45440 | LIB3073-023-Q1-K1-A11 | LIB3073 | g1055367 | BLASTN | 906 | 1e−66 | 76 |
| 756 | 16 | LIB3055-005-Q1-N1-D8 | LIB3055 | g1055367 | BLASTN | 1704 | 1e−166 | 98 |
| 757 | 16 | LIB3073-023-Q1-K1-C6 | LIB3073 | g1055367 | BLASTN | 2074 | 1e−166 | 98 |
| 758 | 16 | LIB3073-013-Q1-K1-A5 | LIB3073 | g1055367 | BLASTN | 2057 | 1e−165 | 99 |
| 759 | 16 | LIB3055-007-Q1-N1-E4 | LIB3055 | g1055367 | BLASTN | 2065 | 1e−165 | 99 |
| 760 | 16 | LIB3055-009-Q1-N1-A9 | LIB3055 | g1055367 | BLASTN | 2067 | 1e−165 | 98 |
| 761 | 16 | LIB3055-008-Q1-N1-C9 | LIB3055 | g1055367 | BLASTN | 2047 | 1e−164 | 99 |
| 762 | 16 | LIB3030-009-Q1-B1-G2 | LIB3030 | g1055367 | BLASTN | 823 | 1e−163 | 96 |
| 763 | 16 | LIB3040-002-Q1-E1-A4 | LIB3040 | g1055367 | BLASTN | 1623 | 1e−163 | 97 |
| 764 | 16 | LIB3073-023-Q1-K1-E8 | LIB3073 | g1055367 | BLASTN | 1671 | 1e−163 | 96 |
| 765 | 16 | LIB3073-006-Q1-K1-E8 | LIB3073 | g1055367 | BLASTN | 2040 | 1e−163 | 100 |
| 766 | 16 | LIB3053-010-Q1-N1-E7 | LIB3053 | g1055367 | BLASTN | 2023 | 1e−162 | 99 |
| 767 | 16 | LIB3073-024-Q1-K1-H4 | LIB3073 | g1055367 | BLASTN | 1608 | 1e−161 | 99 |
| 768 | 16 | LIB3055-008-Q1-N1-A7 | LIB3055 | g1055367 | BLASTN | 2008 | 1e−161 | 97 |
| 769 | 16 | LIB3073-001-Q1-K1-B10 | LIB3073 | g1055367 | BLASTN | 1078 | 1e−160 | 98 |
| 770 | 16 | LIB3055-013-Q1-N1-B2 | LIB3055 | g1055367 | BLASTN | 1726 | 1e−160 | 96 |
| 771 | 16 | LIB3073-002-Q1-K1-C1 | LIB3073 | g1055367 | BLASTN | 1728 | 1e−160 | 96 |
| 772 | 16 | LIB3073-013-Q1-K1-F11 | LIB3073 | g1055367 | BLASTN | 1904 | 1e−160 | 99 |
| 773 | 16 | LIB3073-022-Q1-K1-A11 | LIB3073 | g1055367 | BLASTN | 1885 | 1e−159 | 100 |
| 774 | 16 | LIB3073-026-Q1-K1-G9 | LIB3073 | g1055367 | BLASTN | 1987 | 1e−159 | 99 |
| 775 | 16 | LIB3073-026-Q1-K1-F9 | LIB3073 | g1055367 | BLASTN | 1991 | 1e−159 | 99 |
| 776 | 16 | LIB3073-024-Q1-K1-A10 | LIB3073 | g1055367 | BLASTN | 1740 | 1e−158 | 99 |
| 777 | 16 | LIB3073-012-Q1-K1-D7 | LIB3073 | g1055367 | BLASTN | 1876 | 1e−158 | 98 |
| 778 | 16 | LIB3049-013-Q1-E1-B3 | LIB3049 | g1055367 | BLASTN | 1265 | 1e−157 | 99 |
| 779 | 16 | LIB3053-014-Q1-N1-F9 | LIB3053 | g1055367 | BLASTN | 1592 | 1e−157 | 97 |
| 780 | 16 | LIB3054-003-Q1-N1-G12 | LIB3054 | g1055367 | BLASTN | 1949 | 1e−156 | 99 |

TABLE A*-continued

| Seq No. | Cluster ID | CloneID | Library | NCBI gi | Method | Score | P-value | % Ident |
|---|---|---|---|---|---|---|---|---|
| 781 | 16 | LIB3053-001-Q1-B1-B3 | LIB3053 | g1055367 | BLASTN | 1935 | 1e-155 | 100 |
| 782 | 16 | LIB3027-005-Q1-B1-F12 | LIB3027 | g1055367 | BLASTN | 1943 | 1e-155 | 99 |
| 783 | 16 | LIB3054-001-Q1-B1-E6 | LIB3054 | g1055367 | BLASTN | 1945 | 1e-155 | 100 |
| 784 | 16 | LIB3055-007-Q1-N1-G11 | LIB3055 | g1055367 | BLASTN | 1691 | 1e-154 | 95 |
| 785 | 16 | LIB3073-026-Q1-K1-D12 | LIB3073 | g1055367 | BLASTN | 1917 | 1e-153 | 99 |
| 786 | 16 | LIB3053-009-Q1-N1-C6 | LIB3053 | g1055367 | BLASTN | 1919 | 1e-153 | 98 |
| 787 | 16 | LIB3073-013-Q1-K1-C1 | LIB3073 | g1055367 | BLASTN | 1740 | 1e-151 | 98 |
| 788 | 16 | LIB3073-006-Q1-K1-F6 | LIB3073 | g1055367 | BLASTN | 1789 | 1e-151 | 95 |
| 789 | 16 | LIB3073-011-Q1-K1-A12 | LIB3073 | g1055367 | BLASTN | 647 | 1e-150 | 94 |
| 790 | 16 | LIB3073-007-Q1-K1-B9 | LIB3073 | g1055367 | BLASTN | 1110 | 1e-150 | 98 |
| 791 | 16 | LIB3055-005-Q1-N1-G4 | LIB3055 | g1055367 | BLASTN | 1877 | 1e-150 | 93 |
| 792 | 16 | LIB3073-006-Q1-K1-F5 | LIB3073 | g1055367 | BLASTN | 1886 | 1e-150 | 99 |
| 793 | 16 | LIB3073-022-Q1-K1-B9 | LIB3073 | g1055367 | BLASTN | 1765 | 1e-149 | 94 |
| 794 | 16 | LIB3073-024-Q1-K1-F3 | LIB3073 | g1055367 | BLASTN | 1768 | 1e-149 | 95 |
| 795 | 16 | LIB3073-026-Q1-K1-E6 | LIB3073 | g1055367 | BLASTN | 1866 | 1e-149 | 98 |
| 796 | 16 | LIB3073-025-Q1-K1-F3 | LIB3073 | g1055367 | BLASTN | 1855 | 1e-148 | 98 |
| 797 | 16 | LIB3073-024-Q1-K1-B5 | LIB3073 | g1055367 | BLASTN | 1630 | 1e-147 | 94 |
| 798 | 16 | LIB3053-010-Q1-N1-A2 | LIB3053 | g1055367 | BLASTN | 1677 | 1e-147 | 94 |
| 799 | 16 | LIB3073-007-Q1-K1-F1 | LIB3073 | g1055367 | BLASTN | 946 | 1e-146 | 97 |
| 800 | 16 | LIB3055-008-Q1-N1-E12 | LIB3055 | g1055367 | BLASTN | 1731 | 1e-146 | 93 |
| 801 | 16 | LIB3073-001-Q1-K1-B7 | LIB3073 | g1055367 | BLASTN | 988 | 1e-145 | 97 |
| 802 | 16 | LIB3039-004-Q1-E1-F7 | LIB3039 | g1055367 | BLASTN | 1817 | 1e-145 | 98 |
| 803 | 16 | LIB3053-006-Q1-N1-D9 | LIB3053 | g1055367 | BLASTN | 1823 | 1e-145 | 95 |
| 804 | 16 | LIB3039-021-Q1-E1-A3 | LIB3039 | g1055367 | BLASTN | 906 | 1e-143 | 96 |
| 805 | 16 | LIB3053-001-Q1-B1-D4 | LIB3053 | g1055367 | BLASTN | 1367 | 1e-143 | 91 |
| 806 | 16 | LIB3039-046-Q1-E1-E5 | LIB3039 | g1055367 | BLASTN | 1567 | 1e-143 | 99 |
| 807 | 16 | LIB3073-007-Q1-K1-B2 | LIB3073 | g1055367 | BLASTN | 1392 | 1e-142 | 92 |
| 808 | 16 | LIB3073-023-Q1-K1-C3 | LIB3073 | g1055367 | BLASTN | 1683 | 1e-142 | 88 |
| 809 | 16 | LIB3055-002-Q1-B1-E1 | LIB3055 | g1055367 | BLASTN | 912 | 1e-141 | 90 |
| 810 | 16 | LIB3073-025-Q1-K1-H8 | LIB3073 | g1055367 | BLASTN | 1769 | 1e-141 | 93 |
| 811 | 16 | LIB3039-030-Q1-E1-H9 | LIB3039 | g1055367 | BLASTN | 1775 | 1e-141 | 99 |
| 812 | 16 | LIB3055-008-Q1-N1-H4 | LIB3055 | g1055367 | BLASTN | 659 | 1e-140 | 93 |
| 813 | 16 | LIB3054-011-Q1-N1-A1 | LIB3054 | g1055367 | BLASTN | 1384 | 1e-140 | 90 |
| 814 | 16 | LIB3073-025-Q1-K1-D2 | LIB3073 | g1055367 | BLASTN | 1758 | 1e-140 | 95 |
| 815 | 16 | LIB3073-025-Q1-K1-G3 | LIB3073 | g1055367 | BLASTN | 1763 | 1e-140 | 97 |
| 816 | 16 | LIB3053-002-Q1-B1-H2 | LIB3053 | g1055367 | BLASTN | 686 | 1e-139 | 94 |
| 817 | 16 | LIB3073-013-Q1-K1-F6 | LIB3073 | g1055367 | BLASTN | 1590 | 1e-138 | 96 |
| 818 | 16 | LIB3073-025-Q1-K1-B10 | LIB3073 | g1055367 | BLASTN | 1643 | 1e-138 | 94 |

TABLE A*-continued

| Seq No. | Cluster ID | CloneID | Library | NCBI gi | Method | Score | P-value | % Ident |
|---|---|---|---|---|---|---|---|---|
| 819 | 16 | LIB3073-023-Q1-K1-D3 | LIB3073 | g1055367 | BLASTN | 1286 | 1e-137 | 95 |
| 820 | 16 | LIB3054-011-Q1-N1-G1 | LIB3054 | g1055367 | BLASTN | 1507 | 1e-137 | 98 |
| 821 | 16 | LIB3073-024-Q1-K1-H12 | LIB3073 | g1055367 | BLASTN | 1135 | 1e-135 | 97 |
| 822 | 16 | LIB3039-002-Q1-E1-E5 | LIB3039 | g1055367 | BLASTN | 1499 | 1e-135 | 94 |
| 823 | 16 | LIB3073-026-Q1-K1-E3 | LIB3073 | g1055367 | BLASTN | 1696 | 1e-135 | 94 |
| 824 | 16 | LIB3054-006-Q1-N1-F11 | LIB3054 | g1055367 | BLASTN | 1593 | 1e-134 | 93 |
| 825 | 16 | LIB3028-009-Q1-B1-D4 | LIB3028 | g1055367 | BLASTN | 1318 | 1e-133 | 91 |
| 826 | 16 | LIB3073-026-Q1-K1-A12 | LIB3073 | g1055367 | BLASTN | 1681 | 1e-133 | 99 |
| 827 | 16 | LIB3073-011-Q1-K1-C7 | LIB3073 | g1055367 | BLASTN | 1213 | 1e-131 | 94 |
| 828 | 16 | LIB3054-001-Q1-B1-A6 | LIB3054 | g1055367 | BLASTN | 1644 | 1e-130 | 91 |
| 829 | 16 | LIB3073-002-Q1-K1-A8 | LIB3073 | g1055367 | BLASTN | 1414 | 1e-129 | 92 |
| 830 | 16 | LIB3073-002-Q1-K1-E11 | LIB3073 | g1079735 | BLASTN | 1120 | 1e-126 | 91 |
| 831 | 16 | LIB3040-056-Q1-E1-E11 | LIB3040 | g1055367 | BLASTN | 1590 | 1e-126 | 98 |
| 832 | 16 | LIB3073-025-Q1-K1-G10 | LIB3073 | g1055367 | BLASTN | 1503 | 1e-124 | 98 |
| 833 | 16 | LIB3054-003-Q1-N1-G2 | LIB3054 | g1055367 | BLASTN | 1262 | 1e-123 | 95 |
| 834 | 16 | LIB3073-011-Q1-K1-D5 | LIB3073 | g1055367 | BLASTN | 1379 | 1e-122 | 93 |
| 835 | 16 | LIB3054-011-Q1-N1-C4 | LIB3054 | g1055367 | BLASTN | 1477 | 1e-122 | 91 |
| 836 | 16 | LIB3049-038-Q1-E1-G6 | LIB3049 | g1055367 | BLASTN | 1353 | 1e-118 | 89 |
| 837 | 16 | LIB3039-033-Q1-E1-H12 | LIB3039 | g1055367 | BLASTN | 1482 | 1e-117 | 93 |
| 838 | 16 | LIB3039-031-Q1-E1-D2 | LIB3039 | g1079735 | BLASTN | 943 | 1e-111 | 94 |
| 839 | 16 | LIB3030-004-Q1-B1-A8 | LIB3030 | g1055367 | BLASTN | 1282 | 1e-109 | 96 |
| 840 | 16 | LIB3055-004-Q1-N1-F1 | LIB3055 | g1055367 | BLASTN | 1142 | 1e-101 | 96 |
| 841 | 16 | LIB3053-001-Q1-B1-H1 | LIB3053 | g1055367 | BLASTN | 724 | 1e-97 | 87 |
| 842 | 16 | LIB3054-001-Q1-B1-C9 | LIB3054 | g1055367 | BLASTN | 868 | 1e-84 | 91 |
| 843 | 16 | LIB3073-002-Q1-K1-F5 | LIB3073 | g1079735 | BLASTN | 917 | 1e-81 | 91 |
| 844 | 16 | LIB3073-026-Q1-K1-B9 | LIB3073 | g1055367 | BLASTN | 797 | 1e-79 | 85 |
| 845 | 16 | LIB3039-005-Q1-E1-E4 | LIB3039 | g1079735 | BLASTN | 897 | 1e-79 | 92 |
| 846 | 16 | LIB3054-006-Q1-N1-E5 | LIB3054 | g1055367 | BLASTN | 839 | 1e-61 | 90 |
| 847 | 16 | LIB3055-007-Q1-N1-G1 | LIB3055 | g1055367 | BLASTN | 620 | 1e-42 | 100 |
| MAIZE PHOSPHOGLYCERATE KINASE | | | | | | | | |
| 848 | -700073531 | 700073531H1 | SATMON007 | g21834 | BLASTN | 324 | 1e-16 | 69 |
| 849 | -700215712 | 700215712H1 | SATMON016 | g21272 | BLASTX | 87 | 1e-11 | 66 |
| 850 | -700220093 | 700220093H1 | SATMON011 | g21834 | BLASTN | 258 | 1e-31 | 82 |
| 851 | -700336084 | 700336084H1 | SATMON019 | g218038 | BLASTN | 389 | 1e-21 | 65 |
| 852 | -700442802 | 700442802H1 | SATMON026 | g21832 | BLASTN | 298 | 1e-60 | 90 |
| 853 | -700611444 | 700611444H1 | SATMON022 | g21832 | BLASTN | 831 | 1e-60 | 82 |
| 854 | -700623464 | 700623464H1 | SATMON034 | g21834 | BLASTN | 261 | 1e-24 | 74 |
| 855 | -700805505 | 700805505H1 | SATMON036 | g21834 | BLASTN | 512 | 1e-33 | 87 |
| 856 | 16294 | 700101571H1 | SATMON009 | g21832 | BLASTN | 891 | 1e-65 | 82 |
| 857 | 16294 | 700218404H1 | SATMON016 | g21832 | BLASTN | 595 | 1e-53 | 82 |
| 858 | 16294 | 700093042H1 | SATMON008 | g1022803 | BLASTX | 146 | 1e-13 | 88 |
| 859 | 16294 | 700093371H1 | SATMON008 | g1022803 | BLASTX | 133 | 1e-11 | 88 |
| 860 | 2232 | 700098158H1 | SATMON009 | g21832 | BLASTN | 1303 | 1e-99 | 89 |
| 861 | 2232 | 700210258H1 | SATMON016 | g21832 | BLASTN | 1246 | 1e-95 | 87 |
| 862 | 2232 | 700099304H1 | SATMON009 | g21832 | BLASTN | 1235 | 1e-94 | 87 |
| 863 | 2232 | 700100457H1 | SATMON009 | g21832 | BLASTN | 1240 | 1e-94 | 89 |
| 864 | 2232 | 700097084H1 | SATMON009 | g21832 | BLASTN | 1242 | 1e-94 | 87 |

TABLE A*-continued

| Seq No. | Cluster ID | CloneID | Library | NCBI gi | Method | Score | P-value | % Ident |
|---|---|---|---|---|---|---|---|---|
| 865 | 2232 | 700097420H1 | SATMON009 | g21832 | BLASTN | 1146 | 1e−86 | 88 |
| 866 | 2232 | 700216186H1 | SATMON016 | g21832 | BLASTN | 1128 | 1e−85 | 89 |
| 867 | 2232 | 700098880H1 | SATMON009 | g21832 | BLASTN | 1116 | 1e−84 | 83 |
| 868 | 2232 | 700098821H1 | SATMON009 | g21832 | BLASTN | 1121 | 1e−84 | 83 |
| 869 | 2232 | 700041819H1 | SATMON004 | g21832 | BLASTN | 1081 | 1e−81 | 88 |
| 870 | 2232 | 700210748H1 | SATMON016 | g21832 | BLASTN | 1069 | 1e−80 | 84 |
| 871 | 2232 | 700097556H1 | SATMON009 | g21832 | BLASTN | 1056 | 1e−79 | 84 |
| 872 | 2232 | 700578230H1 | SATMON031 | g21832 | BLASTN | 1060 | 1e−79 | 90 |
| 873 | 2232 | 700580556H1 | SATMON031 | g21832 | BLASTN | 1045 | 1e−78 | 86 |
| 874 | 2232 | 700044785H1 | SATMON004 | g21832 | BLASTN | 1050 | 1e−78 | 88 |
| 875 | 2232 | 700041775H1 | SATMON004 | g21832 | BLASTN | 1035 | 1e−77 | 88 |
| 876 | 2232 | 700045331H1 | SATMON004 | g21832 | BLASTN | 996 | 1e−74 | 87 |
| 877 | 2232 | 700046021H1 | SATMON004 | g21832 | BLASTN | 1003 | 1e−74 | 84 |
| 878 | 2232 | 700344283H1 | SATMON021 | g21832 | BLASTN | 922 | 1e−73 | 91 |
| 879 | 2232 | 700242032H1 | SATMON010 | g21832 | BLASTN | 986 | 1e−73 | 86 |
| 880 | 2232 | 700044688H1 | SATMON004 | g21832 | BLASTN | 991 | 1e−73 | 89 |
| 881 | 2232 | 700053496H1 | SATMON009 | g21832 | BLASTN | 958 | 1e−71 | 83 |
| 882 | 2232 | 700043267H1 | SATMON004 | g21832 | BLASTN | 941 | 1e−69 | 84 |
| 883 | 2232 | 700577778H1 | SATMON031 | g21832 | BLASTN | 922 | 1e−68 | 83 |
| 884 | 2232 | 700045845H1 | SATMON004 | g21832 | BLASTN | 856 | 1e−62 | 82 |
| 885 | 2232 | 700439945H1 | SATMON026 | g21832 | BLASTN | 803 | 1e−58 | 85 |
| 886 | 2232 | 700240633H1 | SATMON010 | g21832 | BLASTN | 753 | 1e−53 | 83 |
| 887 | 2232 | 700424659H1 | SATMONN01 | g21832 | BLASTN | 429 | 1e−39 | 80 |
| 888 | 2232 | 700042421H1 | SATMON004 | g21832 | BLASTN | 447 | 1e−28 | 93 |
| 889 | 2769 | 700100967H1 | SATMON009 | g21834 | BLASTN | 481 | 1e−34 | 90 |
| 890 | 66 | 700209994H1 | SATMON016 | g21834 | BLASTN | 658 | 1e−100 | 85 |
| 891 | 66 | 700103176H1 | SATMON010 | g21834 | BLASTN | 1178 | 1e−97 | 89 |
| 892 | 66 | 700262312H1 | SATMON017 | g21834 | BLASTN | 1264 | 1e−96 | 90 |
| 893 | 66 | 700103182H1 | SATMON010 | g21834 | BLASTN | 1256 | 1e−95 | 89 |
| 894 | 66 | 700216542H1 | SATMON016 | g21834 | BLASTN | 1233 | 1e−94 | 89 |
| 895 | 66 | 700104446H1 | SATMON010 | g21834 | BLASTN | 1231 | 1e−93 | 91 |
| 896 | 66 | 700236428H1 | SATMON010 | g21834 | BLASTN | 1200 | 1e−91 | 92 |
| 897 | 66 | 700257977H1 | SATMON017 | g21834 | BLASTN | 1011 | 1e−88 | 91 |
| 898 | 66 | 700072449H1 | SATMON007 | g21834 | BLASTN | 1103 | 1e−88 | 93 |
| 899 | 66 | 700089147H1 | SATMON011 | g21834 | BLASTN | 1164 | 1e−88 | 81 |
| 900 | 66 | 700208306H1 | SATMON016 | g21834 | BLASTN | 1170 | 1e−88 | 94 |
| 901 | 66 | 700104358H1 | SATMON010 | g21834 | BLASTN | 1141 | 1e−86 | 88 |
| 902 | 66 | 700266788H1 | SATMON017 | g21834 | BLASTN | 1131 | 1e−85 | 86 |
| 903 | 66 | 700219877H1 | SATMON011 | g21834 | BLASTN | 1136 | 1e−85 | 90 |
| 904 | 66 | 700083123H1 | SATMON011 | g21834 | BLASTN | 1059 | 1e−84 | 94 |
| 905 | 66 | 700087896H1 | SATMON011 | g21834 | BLASTN | 1059 | 1e−84 | 94 |
| 906 | 66 | 700265143H1 | SATMON017 | g21834 | BLASTN | 1044 | 1e−83 | 94 |
| 907 | 66 | 700097447H1 | SATMON009 | g21834 | BLASTN | 1032 | 1e−82 | 93 |
| 908 | 66 | 700072364H1 | SATMON007 | g21834 | BLASTN | 1033 | 1e−82 | 93 |
| 909 | 66 | 700099968H1 | SATMON009 | g21834 | BLASTN | 1034 | 1e−82 | 93 |
| 910 | 66 | 700075887H1 | SATMON007 | g21834 | BLASTN | 1041 | 1e−82 | 92 |
| 911 | 66 | 700027135H1 | SATMON003 | g21834 | BLASTN | 1003 | 1e−81 | 90 |
| 912 | 66 | 700097469H1 | SATMON009 | g21834 | BLASTN | 1024 | 1e−81 | 93 |
| 913 | 66 | 700267426H1 | SATMON017 | g21834 | BLASTN | 1025 | 1e−81 | 93 |
| 914 | 66 | 700215049H1 | SATMON016 | g21834 | BLASTN | 1074 | 1e−80 | 90 |
| 915 | 66 | 700619962H1 | SATMON034 | g21834 | BLASTN | 733 | 1e−79 | 93 |
| 916 | 66 | 700332089H1 | SATMON019 | g21834 | BLASTN | 997 | 1e−79 | 94 |
| 917 | 66 | 700351610H1 | SATMON023 | g21834 | BLASTN | 998 | 1e−79 | 94 |
| 918 | 66 | 700075430H1 | SATMON007 | g21834 | BLASTN | 1003 | 1e−79 | 93 |
| 919 | 66 | 700092332H1 | SATMON008 | g21834 | BLASTN | 1059 | 1e−79 | 94 |
| 920 | 66 | 700405456H1 | SATMON029 | g21834 | BLASTN | 858 | 1e−78 | 85 |
| 921 | 66 | 700798970H1 | SATMON036 | g21834 | BLASTN | 962 | 1e−78 | 89 |
| 922 | 66 | 700028644H1 | SATMON003 | g21834 | BLASTN | 1043 | 1e−78 | 88 |
| 923 | 66 | 700092404H1 | SATMON008 | g21834 | BLASTN | 1050 | 1e−78 | 81 |
| 924 | 66 | 700093208H1 | SATMON008 | g21834 | BLASTN | 1052 | 1e−78 | 81 |
| 925 | 66 | 700073284H1 | SATMON007 | g21834 | BLASTN | 977 | 1e−77 | 94 |
| 926 | 66 | 700620115H1 | SATMON034 | g21834 | BLASTN | 773 | 1e−76 | 94 |
| 927 | 66 | 700262412H1 | SATMON017 | g21834 | BLASTN | 961 | 1e−76 | 93 |
| 928 | 66 | 700025960H1 | SATMON003 | g21834 | BLASTN | 962 | 1e−76 | 94 |
| 929 | 66 | 700549575H1 | SATMON022 | g21834 | BLASTN | 996 | 1e−76 | 88 |
| 930 | 66 | 700579774H1 | SATMON031 | g21834 | BLASTN | 697 | 1e−75 | 78 |
| 931 | 66 | 700264301H1 | SATMON017 | g21834 | BLASTN | 839 | 1e−75 | 92 |
| 932 | 66 | 700333669H1 | SATMON019 | g21834 | BLASTN | 904 | 1e−75 | 91 |
| 933 | 66 | 700268190H1 | SATMON017 | g21834 | BLASTN | 947 | 1e−75 | 94 |
| 934 | 66 | 700050952H1 | SATMON003 | g21834 | BLASTN | 954 | 1e−75 | 93 |
| 935 | 66 | 700349338H1 | SATMON023 | g21834 | BLASTN | 762 | 1e−74 | 89 |
| 936 | 66 | 700282206H1 | SATMON023 | g21834 | BLASTN | 862 | 1e−74 | 88 |
| 937 | 66 | 700344952H1 | SATMON021 | g21834 | BLASTN | 926 | 1e−74 | 87 |
| 938 | 66 | 700043612H1 | SATMON004 | g21834 | BLASTN | 916 | 1e−73 | 92 |
| 939 | 66 | 700221930H1 | SATMON011 | g21834 | BLASTN | 959 | 1e−73 | 81 |
| 940 | 66 | 700204594H1 | SATMON003 | g21834 | BLASTN | 924 | 1e−72 | 83 |
| 941 | 66 | 700099108H1 | SATMON009 | g21834 | BLASTN | 975 | 1e−72 | 82 |

TABLE A*-continued

| Seq No. | Cluster ID | CloneID | Library | NCBI gi | Method | Score | P-value | % Ident |
|---|---|---|---|---|---|---|---|---|
| 942 | 66 | 700570931H1 | SATMON030 | g21834 | BLASTN | 407 | 1e-70 | 89 |
| 943 | 66 | 700077368H1 | SATMON007 | g21834 | BLASTN | 888 | 1e-70 | 94 |
| 944 | 66 | 700044806H1 | SATMON004 | g21834 | BLASTN | 892 | 1e-70 | 94 |
| 945 | 66 | 700217737H1 | SATMON016 | g21834 | BLASTN | 895 | 1e-70 | 94 |
| 946 | 66 | 700805779H1 | SATMON036 | g21834 | BLASTN | 898 | 1e-70 | 94 |
| 947 | 66 | 700211352H1 | SATMON016 | g21834 | BLASTN | 903 | 1e-70 | 90 |
| 948 | 66 | 700088868H1 | SATMON011 | g21834 | BLASTN | 947 | 1e-70 | 88 |
| 949 | 66 | 700348871H1 | SATMON023 | g21834 | BLASTN | 953 | 1e-70 | 86 |
| 950 | 66 | 700243521H1 | SATMON010 | g21834 | BLASTN | 874 | 1e-69 | 94 |
| 951 | 66 | 700350430H1 | SATMON023 | g21834 | BLASTN | 889 | 1e-69 | 94 |
| 952 | 66 | 700150315H1 | SATMON007 | g21834 | BLASTN | 945 | 1e-69 | 93 |
| 953 | 66 | 700350880H1 | SATMON023 | g21834 | BLASTN | 424 | 1e-68 | 88 |
| 954 | 66 | 700093908H1 | SATMON008 | g21834 | BLASTN | 821 | 1e-68 | 87 |
| 955 | 66 | 700076677H1 | SATMON007 | g21834 | BLASTN | 865 | 1e-68 | 95 |
| 956 | 66 | 700091547H1 | SATMON011 | g21834 | BLASTN | 867 | 1e-68 | 94 |
| 957 | 66 | 700458384H1 | SATMON029 | g21834 | BLASTN | 868 | 1e-68 | 93 |
| 958 | 66 | 700222907H1 | SATMON011 | g21834 | BLASTN | 879 | 1e-68 | 94 |
| 959 | 66 | 700618842H1 | SATMON034 | g21834 | BLASTN | 526 | 1e-67 | 94 |
| 960 | 66 | 700339442H1 | SATMON020 | g21834 | BLASTN | 771 | 1e-67 | 82 |
| 961 | 66 | 700240067H1 | SATMON010 | g21834 | BLASTN | 913 | 1e-67 | 82 |
| 962 | 66 | 700266865H1 | SATMON017 | g21834 | BLASTN | 907 | 1e-66 | 88 |
| 963 | 66 | 700451654H1 | SATMON028 | g21834 | BLASTN | 461 | 1e-65 | 93 |
| 964 | 66 | 700087164H1 | SATMON011 | g21834 | BLASTN | 644 | 1e-65 | 88 |
| 965 | 66 | 700343701H1 | SATMON021 | g21834 | BLASTN | 699 | 1e-65 | 88 |
| 966 | 66 | 700800530H1 | SATMON036 | g21834 | BLASTN | 708 | 1e-65 | 94 |
| 967 | 66 | 700441116H1 | SATMON026 | g21834 | BLASTN | 440 | 1e-64 | 87 |
| 968 | 66 | 700094769H1 | SATMON008 | g21834 | BLASTN | 779 | 1e-63 | 92 |
| 969 | 66 | 700457925H1 | SATMON029 | g21834 | BLASTN | 785 | 1e-63 | 85 |
| 970 | 66 | 700571062H1 | SATMON030 | g21834 | BLASTN | 826 | 1e-63 | 95 |
| 971 | 66 | 700258601H1 | SATMON017 | g21834 | BLASTN | 708 | 1e-62 | 95 |
| 972 | 66 | 700579874H1 | SATMON031 | g21834 | BLASTN | 773 | 1e-62 | 83 |
| 973 | 66 | 700454374H1 | SATMON029 | g21834 | BLASTN | 825 | 1e-62 | 91 |
| 974 | 66 | 700094413H1 | SATMON008 | g21834 | BLASTN | 668 | 1e-61 | 92 |
| 975 | 66 | 700072959H1 | SATMON007 | g21834 | BLASTN | 701 | 1e-61 | 95 |
| 976 | 66 | 700161495H1 | SATMON012 | g21834 | BLASTN | 765 | 1e-61 | 85 |
| 977 | 66 | 700153976H1 | SATMON007 | g21834 | BLASTN | 778 | 1e-61 | 95 |
| 978 | 66 | 700156134H2 | SATMON007 | g21834 | BLASTN | 778 | 1e-61 | 95 |
| 979 | 66 | 700043126H1 | SATMON004 | g21834 | BLASTN | 845 | 1e-61 | 83 |
| 980 | 66 | 700159683H1 | SATMON012 | g21834 | BLASTN | 845 | 1e-61 | 82 |
| 981 | 66 | 700157671H1 | SATMON012 | g21834 | BLASTN | 835 | 1e-60 | 83 |
| 982 | 66 | 700549008H1 | SATMON022 | g21834 | BLASTN | 691 | 1e-59 | 81 |
| 983 | 66 | 700104417H1 | SATMON010 | g21834 | BLASTN | 756 | 1e-59 | 91 |
| 984 | 66 | 700094721H1 | SATMON008 | g21834 | BLASTN | 815 | 1e-59 | 94 |
| 985 | 66 | 700611620H1 | SATMON022 | g21834 | BLASTN | 818 | 1e-59 | 82 |
| 986 | 66 | 700455655H1 | SATMON029 | g21834 | BLASTN | 357 | 1e-58 | 92 |
| 987 | 66 | 700549606H1 | SATMON022 | g21834 | BLASTN | 425 | 1e-58 | 79 |
| 988 | 66 | 700165361H1 | SATMON013 | g21834 | BLASTN | 748 | 1e-58 | 95 |
| 989 | 66 | 700076792H1 | SATMON007 | g21834 | BLASTN | 749 | 1e-58 | 94 |
| 990 | 66 | 700048731H1 | SATMON003 | g21834 | BLASTN | 808 | 1e-58 | 78 |
| 991 | 66 | 700168266H1 | SATMON013 | g21834 | BLASTN | 811 | 1e-58 | 82 |
| 992 | 66 | 700045117H1 | SATMON004 | g21834 | BLASTN | 812 | 1e-58 | 80 |
| 993 | 66 | 700209421H1 | SATMON016 | g21834 | BLASTN | 813 | 1e-58 | 95 |
| 994 | 66 | 700806575H1 | SATMON036 | g21834 | BLASTN | 736 | 1e-57 | 94 |
| 995 | 66 | 700456047H1 | SATMON029 | g21834 | BLASTN | 796 | 1e-57 | 81 |
| 996 | 66 | 700623432H1 | SATMON034 | g21834 | BLASTN | 801 | 1e-57 | 91 |
| 997 | 66 | 700569724H1 | SATMON030 | g21834 | BLASTN | 525 | 1e-56 | 80 |
| 998 | 66 | 700220377H1 | SATMON011 | g21834 | BLASTN | 732 | 1e-56 | 83 |
| 999 | 66 | 700336275H1 | SATMON019 | g21834 | BLASTN | 621 | 1e-55 | 87 |
| 1000 | 66 | 700151932H1 | SATMON007 | g21834 | BLASTN | 711 | 1e-55 | 94 |
| 1001 | 66 | 700258488H1 | SATMON017 | g21834 | BLASTN | 693 | 1e-54 | 94 |
| 1002 | 66 | 700333184H1 | SATMON019 | g21834 | BLASTN | 708 | 1e-54 | 93 |
| 1003 | 66 | 700236590H1 | SATMON010 | g21834 | BLASTN | 759 | 1e-54 | 94 |
| 1004 | 66 | 700440409H1 | SATMON026 | g21834 | BLASTN | 392 | 1e-53 | 83 |
| 1005 | 66 | 700615448H1 | SATMON033 | g21834 | BLASTN | 402 | 1e-53 | 91 |
| 1006 | 66 | 700023196H1 | SATMON003 | g21834 | BLASTN | 738 | 1e-52 | 80 |
| 1007 | 66 | 700577864H1 | SATMON031 | g1161601 | BLASTN | 399 | 1e-51 | 76 |
| 1008 | 66 | 700073368H1 | SATMON007 | g1161601 | BLASTN | 429 | 1e-51 | 78 |
| 1009 | 66 | 700344214H1 | SATMON021 | g21834 | BLASTN | 400 | 1e-49 | 86 |
| 1010 | 66 | 700019682H1 | SATMON001 | g21834 | BLASTN | 694 | 1e-49 | 83 |
| 1011 | 66 | 700153175H1 | SATMON007 | g21834 | BLASTN | 701 | 1e-49 | 79 |
| 1012 | 66 | 700236532H1 | SATMON010 | g1161601 | BLASTN | 435 | 1e-48 | 76 |
| 1013 | 66 | 700263441H1 | SATMON017 | g21834 | BLASTN | 688 | 1e-48 | 91 |
| 1014 | 66 | 700473818H1 | SATMON025 | g21834 | BLASTN | 667 | 1e-46 | 92 |
| 1015 | 66 | 700471618H1 | SATMON025 | g21834 | BLASTN | 591 | 1e-45 | 95 |
| 1016 | 66 | 700612632H1 | SATMON033 | g21834 | BLASTN | 591 | 1e-45 | 91 |
| 1017 | 66 | 700266580H1 | SATMON017 | g21834 | BLASTN | 455 | 1e-43 | 84 |
| 1018 | 66 | 700474244H1 | SATMON025 | g21834 | BLASTN | 563 | 1e-43 | 92 |

TABLE A*-continued

| Seq No. | Cluster ID | CloneID | Library | NCBI gi | Method | Score | P-value | % Ident |
|---|---|---|---|---|---|---|---|---|
| 1019 | 66 | 700195129H1 | SATMON014 | g21834 | BLASTN | 627 | 1e−43 | 86 |
| 1020 | 66 | 700104765H1 | SATMON010 | g21834 | BLASTN | 627 | 1e−43 | 86 |
| 1021 | 66 | 700029314H1 | SATMON003 | g21834 | BLASTN | 627 | 1e−43 | 86 |
| 1022 | 66 | 700041618H1 | SATMON004 | g21834 | BLASTN | 627 | 1e−43 | 86 |
| 1023 | 66 | 700050511H1 | SATMON003 | g21834 | BLASTN | 618 | 1e−42 | 86 |
| 1024 | 66 | 700195775H1 | SATMON014 | g21834 | BLASTN | 620 | 1e−42 | 86 |
| 1025 | 66 | 700195425H1 | SATMON014 | g21834 | BLASTN | 604 | 1e−41 | 75 |
| 1026 | 66 | 700440268H1 | SATMON026 | g21834 | BLASTN | 608 | 1e−41 | 86 |
| 1027 | 66 | 700160639H1 | SATMON012 | g21834 | BLASTN | 609 | 1e−41 | 85 |
| 1028 | 66 | 700617741H1 | SATMON033 | g2982312 | BLASTN | 402 | 1e−40 | 77 |
| 1029 | 66 | 700578506H1 | SATMON031 | g21834 | BLASTN | 580 | 1e−39 | 82 |
| 1030 | 66 | 700618491H2 | SATMON033 | g21834 | BLASTN | 591 | 1e−39 | 85 |
| 1031 | 66 | 700803231H1 | SATMON036 | g21834 | BLASTN | 455 | 1e−38 | 86 |
| 1032 | 66 | 700195008H1 | SATMON014 | g21834 | BLASTN | 559 | 1e−37 | 80 |
| 1033 | 66 | 700257337H1 | SATMON017 | g21834 | BLASTN | 463 | 1e−35 | 90 |
| 1034 | 66 | 700153701H1 | SATMON007 | g21834 | BLASTN | 529 | 1e−35 | 86 |
| 1035 | 66 | 700458028H1 | SATMON029 | g21834 | BLASTN | 270 | 1e−33 | 85 |
| 1036 | 66 | 700350024H1 | SATMON023 | g21834 | BLASTN | 387 | 1e−33 | 83 |
| 1037 | 66 | 700150871H1 | SATMON007 | g21834 | BLASTN | 431 | 1e−32 | 90 |
| 1038 | 66 | 700804078H1 | SATMON036 | g21834 | BLASTN | 491 | 1e−32 | 83 |
| 1039 | 66 | 700267617H1 | SATMON017 | g21834 | BLASTN | 423 | 1e−31 | 93 |
| 1040 | 66 | 701165809H1 | SATMONN04 | g21834 | BLASTN | 279 | 1e−26 | 83 |
| 1041 | 66 | 700552775H1 | SATMON022 | g21834 | BLASTN | 429 | 1e−25 | 79 |
| 1042 | 66 | 700616491H1 | SATMON033 | g21835 | BLASTX | 89 | 1e−16 | 82 |
| 1043 | 66 | 700450825H1 | SATMON028 | g21834 | BLASTN | 240 | 1e−16 | 90 |
| 1044 | 66 | 700334736H1 | SATMON019 | g1161602 | BLASTX | 126 | 1e−14 | 76 |
| 1045 | 66 | 700202264H1 | SATMON003 | g21834 | BLASTN | 214 | 1e−14 | 92 |
| 1046 | 66 | 700583352H1 | SATMON031 | g1161602 | BLASTX | 117 | 1e−9 | 100 |
| 1047 | 66 | 700802543H1 | SATMON036 | g21834 | BLASTN | 233 | 1e−9 | 94 |
| 1048 | 66 | 700018689H1 | SATMON001 | g3309631 | BLASTX | 103 | 1e−8 | 89 |
| 1049 | -L30621557 | LIB3062-018-Q1-K1-F2 | LIB3062 | g313266 | BLASTN | 776 | 1e−60 | 79 |
| 1050 | -L30624706 | LIB3062-049-Q1-K1-H7 | LIB3062 | g21832 | BLASTN | 906 | 1e−102 | 79 |
| 1051 | -L30672623 | LIB3067-004-Q1-K1-A5 | LIB3067 | g21834 | BLASTN | 571 | 1e−38 | 89 |
| 1052 | 16294 | LIB3078-050-Q1-K1-D12 | LIB3078 | g21832 | BLASTN | 747 | 1e−60 | 83 |
| 1053 | 16294 | LIB3078-049-Q1-K1-H7 | LIB3078 | g21832 | BLASTN | 207 | 1e−14 | 84 |
| 1054 | 2232 | LIB3078-002-Q1-K1-C4 | LIB3078 | g21832 | BLASTN | 1606 | 1e−125 | 87 |
| 1055 | 2232 | LIB36-001-Q1-E1-B11 | LIB36 | g21832 | BLASTN | 1293 | 1e−123 | 84 |
| 1056 | 2232 | LIB36-009-Q1-E1-G7 | LIB36 | g21832 | BLASTN | 1591 | 1e−123 | 88 |
| 1057 | 2232 | LIB3078-003-Q1-K1-G10 | LIB3078 | g21832 | BLASTN | 1429 | 1e−117 | 88 |
| 1058 | 2232 | LIB36-008-Q1-E1-H5 | LIB36 | g21832 | BLASTN | 1340 | 1e−110 | 84 |
| 1059 | 2232 | LIB3078-014-Q1-K1-F7 | LIB3078 | g21832 | BLASTN | 1422 | 1e−109 | 86 |
| 1060 | 2232 | LIB36-017-Q1-E1-D8 | LIB36 | g21832 | BLASTN | 1230 | 1e−99 | 84 |
| 1061 | 2232 | LIB3078-052-Q1-K1-F3 | LIB3078 | g21832 | BLASTN | 1045 | 1e−96 | 79 |
| 1062 | 2232 | 11-LIB189-015-Q1-E1-C11 | LIB189 | g21832 | BLASTN | 912 | 1e−72 | 81 |
| 1063 | 2769 | LIB143-014-Q1-E1-A9 | LIB143 | g21834 | BLASTN | 199 | 1e−10 | 82 |
| 1064 | 66 | LIB3060-012-Q1-K1-H11 | LIB3060 | g21834 | BLASTN | 1691 | 1e−132 | 87 |
| 1065 | 66 | LIB3069-045-Q1-K1-C4 | LIB3069 | g21834 | BLASTN | 1224 | 1e−124 | 92 |
| 1066 | 66 | LIB3059-047-Q1-K1-A8 | LIB3059 | g21834 | BLASTN | 1338 | 1e−115 | 92 |
| 1067 | 66 | LIB189-027-Q1-E1-D10 | LIB189 | g21834 | BLASTN | 1485 | 1e−115 | 88 |
| 1068 | 66 | LIB83-006-Q1-E1-F2 | LIB83 | g21834 | BLASTN | 1148 | 1e−114 | 80 |
| 1069 | 66 | LIB3060-017-Q1-K1-G5 | LIB3060 | g21834 | BLASTN | 1187 | 1e−113 | 79 |
| 1070 | 66 | LIB143-011-Q1-E1-B6 | LIB143 | g21834 | BLASTN | 1412 | 1e−113 | 93 |
| 1071 | 66 | LIB3059-006-Q1-K1-A4 | LIB3059 | g21834 | BLASTN | 1452 | 1e−112 | 82 |

TABLE A*-continued

| Seq No. | Cluster ID | CloneID | Library | NCBI gi | Method | Score | P-value | % Ident |
|---|---|---|---|---|---|---|---|---|
| 1072 | 66 | LIB143-011-Q1-E1-E3 | LIB143 | g21834 | BLASTN | 1460 | 1e−112 | 89 |
| 1073 | 66 | LIB3059-041-Q1-K1-D2 | LIB3059 | g21834 | BLASTN | 1441 | 1e−111 | 82 |
| 1074 | 66 | LIB3079-002-Q1-K1-H3 | LIB3079 | g21834 | BLASTN | 977 | 1e−101 | 85 |
| 1075 | 66 | LIB3061-049-Q1-K1-G6 | LIB3061 | g21834 | BLASTN | 1247 | 1e−99 | 79 |
| 1076 | 66 | LIB3059-038-Q1-K1-H8 | LIB3059 | g21834 | BLASTN | 1094 | 1e−97 | 81 |
| 1077 | 66 | LIB3062-017-Q1-K1-D10 | LIB3062 | g21834 | BLASTN | 1236 | 1e−97 | 93 |
| 1078 | 66 | LIB3059-022-Q1-K1-C10 | LIB3059 | g21834 | BLASTN | 982 | 1e−94 | 82 |
| 1079 | 66 | LIB3059-027-Q1-K1-C7 | LIB3059 | g21834 | BLASTN | 1029 | 1e−89 | 78 |
| 1080 | 66 | LIB3060-011-Q1-K1-A10 | LIB3060 | g21834 | BLASTN | 1139 | 1e−86 | 81 |
| 1081 | 66 | LIB3067-046-Q1-K1-A9 | LIB3067 | g21834 | BLASTN | 967 | 1e−82 | 75 |
| 1082 | 66 | LIB3061-049-Q1-K1-G5 | LIB3061 | g21834 | BLASTN | 950 | 1e−79 | 91 |
| 1083 | 66 | LIB3067-007-Q1-K1-E6 | LIB3067 | g21834 | BLASTN | 979 | 1e−72 | 81 |
| 1084 | 66 | LIB143-052-Q1-E1-C5 | LIB143 | g1161601 | BLASTN | 528 | 1e−69 | 77 |
| 1085 | 66 | LIB143-068-Q1-E1-H4 | LIB143 | g21834 | BLASTN | 879 | 1e−67 | 90 |
| 1086 | 66 | LIB3069-052-Q1-K1-E12 | LIB3069 | g21834 | BLASTN | 843 | 1e−65 | 93 |
| 1087 | 66 | LIB3059-012-Q1-K1-B7 | LIB3059 | g21834 | BLASTN | 611 | 1e−62 | 82 |
| 1088 | 66 | LIB3078-056-Q1-K1-D5 | LIB3078 | g1161601 | BLASTN | 467 | 1e−58 | 77 |
| 1089 | 66 | LIB3062-035-Q1-K1-H2 | LIB3062 | g21834 | BLASTN | 320 | 1e−47 | 81 |
| 1090 | 66 | LIB3069-045-Q1-K1-D11 | LIB3069 | g21834 | BLASTN | 627 | 1e−41 | 86 |
| SOYBEAN PHOSPHOGLYCERATE KINASE ||||||||||
| 1091 | −700561750 | 700561750H1 | SOYMON002 | g1161602 | BLASTX | 98 | 1e−16 | 90 |
| 1092 | −700655290 | 700655290H1 | SOYMON004 | g1177860 | BLASTX | 58 | 1e−14 | 67 |
| 1093 | −700846548 | 700846548H1 | SOYMON021 | g21833 | BLASTX | 158 | 1e−14 | 83 |
| 1094 | −700867263 | 700867263H1 | SOYMON016 | g1161602 | BLASTX | 132 | 1e−11 | 85 |
| 1095 | −700989319 | 700989319H1 | SOYMON011 | g1022803 | BLASTX | 99 | 1e−15 | 72 |
| 1096 | −700998533 | 700998533H1 | SOYMON018 | g2257597 | BLASTN | 406 | 1e−25 | 75 |
| 1097 | −701104514 | 701104514H1 | SOYMON036 | g21272 | BLASTX | 169 | 1e−17 | 78 |
| 1098 | −701108251 | 701108251H1 | SOYMON036 | g21271 | BLASTN | 561 | 1e−37 | 83 |
| 1099 | 16 | 701045420H1 | SOYMON032 | g2257597 | BLASTN | 937 | 1e−69 | 92 |
| 1100 | 16 | 700979939H1 | SOYMON009 | g21271 | BLASTN | 921 | 1e−67 | 82 |
| 1101 | 16 | 700962832H1 | SOYMON022 | g1022804 | BLASTN | 882 | 1e−64 | 82 |
| 1102 | 16 | 700648009H1 | SOYMON003 | g21271 | BLASTN | 859 | 1e−62 | 75 |
| 1103 | 16 | 700901512H1 | SOYMON027 | g1022804 | BLASTN | 840 | 1e−61 | 79 |
| 1104 | 16 | 701120901H1 | SOYMON037 | g21271 | BLASTN | 816 | 1e−59 | 76 |
| 1105 | 16 | 700731242H1 | SOYMON009 | g1022804 | BLASTN | 803 | 1e−58 | 80 |
| 1106 | 16 | 700995275H1 | SOYMON011 | g1022804 | BLASTN | 791 | 1e−57 | 84 |
| 1107 | 16 | 700566593H1 | SOYMON002 | g1161601 | BLASTN | 795 | 1e−57 | 75 |
| 1108 | 16 | 701152346H1 | SOYMON031 | g1161599 | BLASTN | 636 | 1e−56 | 78 |
| 1109 | 16 | 700999851H1 | SOYMON018 | g21271 | BLASTN | 769 | 1e−55 | 83 |
| 1110 | 16 | 700877067H1 | SOYMON018 | g1022804 | BLASTN | 774 | 1e−55 | 82 |
| 1111 | 16 | 700743313H1 | SOYMON012 | g1022804 | BLASTN | 765 | 1e−54 | 84 |
| 1112 | 16 | 700605425H2 | SOYMON004 | g1161601 | BLASTN | 747 | 1e−53 | 75 |
| 1113 | 16 | 700846107H1 | SOYMON021 | g1161601 | BLASTN | 750 | 1e−53 | 76 |
| 1114 | 16 | 700755167H1 | SOYMON014 | g1022804 | BLASTN | 730 | 1e−52 | 80 |
| 1115 | 16 | 700986996H1 | SOYMON009 | g21271 | BLASTN | 736 | 1e−52 | 73 |
| 1116 | 16 | 700873077H1 | SOYMON018 | g1161601 | BLASTN | 721 | 1e−51 | 75 |
| 1117 | 16 | 700995849H1 | SOYMON011 | g1161601 | BLASTN | 698 | 1e−49 | 76 |
| 1118 | 16 | 700754326H1 | SOYMON014 | g1022804 | BLASTN | 301 | 1e−48 | 84 |
| 1119 | 16 | 701063449H1 | SOYMON033 | g1161601 | BLASTN | 685 | 1e−48 | 75 |
| 1120 | 16 | 700906269H1 | SOYMON022 | g1161601 | BLASTN | 687 | 1e−48 | 73 |
| 1121 | 16 | 701121153H1 | SOYMON037 | g1161601 | BLASTN | 669 | 1e−46 | 76 |
| 1122 | 16 | 700750611H1 | SOYMON014 | g1161601 | BLASTN | 653 | 1e−45 | 75 |
| 1123 | 16 | 701051356H1 | SOYMON032 | g1161601 | BLASTN | 636 | 1e−44 | 74 |
| 1124 | 16 | 701040938H1 | SOYMON029 | g1161601 | BLASTN | 637 | 1e−44 | 76 |
| 1125 | 16 | 701141327H1 | SOYMON038 | g1161601 | BLASTN | 638 | 1e−44 | 76 |
| 1126 | 16 | 701041022H1 | SOYMON029 | g1161601 | BLASTN | 642 | 1e−44 | 76 |
| 1127 | 16 | 700560223H1 | SOYMON001 | g1161601 | BLASTN | 548 | 1e−42 | 77 |

TABLE A*-continued

| Seq No. | Cluster ID | CloneID | Library | NCBI gi | Method | Score | P-value | % Ident |
|---|---|---|---|---|---|---|---|---|
| 1128 | 16 | 701069688H1 | SOYMON034 | g1161601 | BLASTN | 610 | 1e-42 | 74 |
| 1129 | 16 | 700868226H1 | SOYMON016 | g1161601 | BLASTN | 593 | 1e-40 | 75 |
| 1130 | 16 | 700867389H1 | SOYMON016 | g1022804 | BLASTN | 476 | 1e-39 | 82 |
| 1131 | 16 | 700792652H1 | SOYMON017 | g1161601 | BLASTN | 574 | 1e-39 | 75 |
| 1132 | 16 | 701206846H1 | SOYMON035 | g1161601 | BLASTN | 576 | 1e-39 | 78 |
| 1133 | 16 | 700966925H1 | SOYMON029 | g1161601 | BLASTN | 577 | 1e-39 | 76 |
| 1134 | 16 | 700676242H1 | SOYMON007 | g1161601 | BLASTN | 579 | 1e-39 | 75 |
| 1135 | 16 | 700982087H1 | SOYMON009 | g1161601 | BLASTN | 533 | 1e-38 | 76 |
| 1136 | 16 | 701206122H1 | SOYMON035 | g1161601 | BLASTN | 541 | 1e-38 | 76 |
| 1137 | 16 | 700561967H1 | SOYMON002 | g1161601 | BLASTN | 566 | 1e-38 | 78 |
| 1138 | 16 | 701038580H1 | SOYMON029 | g1161601 | BLASTN | 568 | 1e-38 | 78 |
| 1139 | 16 | 700831261H1 | SOYMON019 | g21834 | BLASTN | 569 | 1e-38 | 77 |
| 1140 | 16 | 700909538H1 | SOYMON022 | g1161601 | BLASTN | 475 | 1e-37 | 75 |
| 1141 | 16 | 701109480H1 | SOYMON036 | g1161601 | BLASTN | 551 | 1e-37 | 76 |
| 1142 | 16 | 700754158H1 | SOYMON014 | g1161601 | BLASTN | 552 | 1e-37 | 74 |
| 1143 | 16 | 701138938H1 | SOYMON038 | g1161601 | BLASTN | 558 | 1e-37 | 77 |
| 1144 | 16 | 700728645H1 | SOYMON009 | g1161601 | BLASTN | 559 | 1e-37 | 77 |
| 1145 | 16 | 701037523H1 | SOYMON029 | g1161601 | BLASTN | 560 | 1e-37 | 73 |
| 1146 | 16 | 700746355H1 | SOYMON013 | g1161601 | BLASTN | 544 | 1e-36 | 81 |
| 1147 | 16 | 700753250H1 | SOYMON014 | g1161601 | BLASTN | 544 | 1e-36 | 81 |
| 1148 | 16 | 700742113H1 | SOYMON012 | g1022804 | BLASTN | 546 | 1e-36 | 85 |
| 1149 | 16 | 700754067H1 | SOYMON014 | g1161599 | BLASTN | 547 | 1e-36 | 76 |
| 1150 | 16 | 701060528H1 | SOYMON033 | g1161601 | BLASTN | 548 | 1e-36 | 77 |
| 1151 | 16 | 701002709H2 | SOYMON019 | g1161601 | BLASTN | 549 | 1e-36 | 76 |
| 1152 | 16 | 700958261H1 | SOYMON022 | g1161601 | BLASTN | 549 | 1e-36 | 76 |
| 1153 | 16 | 701212692H1 | SOYMON035 | g1161601 | BLASTN | 549 | 1e-36 | 76 |
| 1154 | 16 | 701129677H1 | SOYMON037 | g1161601 | BLASTN | 301 | 1e-35 | 75 |
| 1155 | 16 | 700755130H1 | SOYMON014 | g1161601 | BLASTN | 526 | 1e-35 | 80 |
| 1156 | 16 | 700855106H1 | SOYMON023 | g1161601 | BLASTN | 528 | 1e-35 | 75 |
| 1157 | 16 | 700672102H1 | SOYMON006 | g1161601 | BLASTN | 530 | 1e-35 | 75 |
| 1158 | 16 | 700985023H1 | SOYMON009 | g1161601 | BLASTN | 530 | 1e-35 | 73 |
| 1159 | 16 | 700561815H1 | SOYMON002 | g1161601 | BLASTN | 531 | 1e-35 | 77 |
| 1160 | 16 | 700650261H1 | SOYMON003 | g1161601 | BLASTN | 535 | 1e-35 | 81 |
| 1161 | 16 | 701155840H1 | SOYMON031 | g1161601 | BLASTN | 535 | 1e-35 | 81 |
| 1162 | 16 | 701011614H1 | SOYMON019 | g1161601 | BLASTN | 535 | 1e-35 | 75 |
| 1163 | 16 | 700756614H1 | SOYMON014 | g1161601 | BLASTN | 536 | 1e-35 | 80 |
| 1164 | 16 | 700753242H1 | SOYMON014 | g1161601 | BLASTN | 537 | 1e-35 | 77 |
| 1165 | 16 | 701062065H1 | SOYMON033 | g1161601 | BLASTN | 343 | 1e-34 | 76 |
| 1166 | 16 | 700734980H1 | SOYMON010 | g1161601 | BLASTN | 372 | 1e-34 | 78 |
| 1167 | 16 | 700894670H1 | SOYMON024 | g1161601 | BLASTN | 515 | 1e-34 | 80 |
| 1168 | 16 | 701004704H1 | SOYMON019 | g1161601 | BLASTN | 521 | 1e-34 | 80 |
| 1169 | 16 | 701125560H1 | SOYMON037 | g1161601 | BLASTN | 504 | 1e-33 | 81 |
| 1170 | 16 | 700673963H1 | SOYMON007 | g1161601 | BLASTN | 512 | 1e-33 | 80 |
| 1171 | 16 | 700664685H1 | SOYMON005 | g218212 | BLASTN | 417 | 1e-32 | 71 |
| 1172 | 16 | 700756635H1 | SOYMON014 | g1161601 | BLASTN | 498 | 1e-32 | 66 |
| 1173 | 16 | 701066933H1 | SOYMON034 | g1161601 | BLASTN | 487 | 1e-31 | 80 |
| 1174 | 16 | 701156137H1 | SOYMON031 | g1161601 | BLASTN | 412 | 1e-30 | 81 |
| 1175 | 16 | 701043044H1 | SOYMON029 | g1161601 | BLASTN | 456 | 1e-29 | 79 |
| 1176 | 16 | 700832331H1 | SOYMON019 | g1161601 | BLASTN | 387 | 1e-28 | 79 |
| 1177 | 16 | 701046244H1 | SOYMON032 | g1161601 | BLASTN | 451 | 1e-28 | 81 |
| 1178 | 16 | 700555893H1 | SOYMON001 | g1161602 | BLASTX | 153 | 1e-26 | 81 |
| 1179 | 16 | 700999829H1 | SOYMON018 | g21271 | BLASTN | 355 | 1e-26 | 73 |
| 1180 | 16 | 701142924H2 | SOYMON038 | g1161601 | BLASTN | 428 | 1e-26 | 81 |
| 1181 | 16 | 701156281H1 | SOYMON031 | g1161601 | BLASTN | 428 | 1e-26 | 81 |
| 1182 | 16 | 701015402H1 | SOYMON019 | g1161602 | BLASTX | 126 | 1e-23 | 78 |
| 1183 | 16 | 700870906H1 | SOYMON018 | g1161602 | BLASTX | 108 | 1e-19 | 85 |
| 1184 | 16 | 701060159H1 | SOYMON033 | g1161601 | BLASTN | 348 | 1e-18 | 72 |
| 1185 | 16 | 700830018H1 | SOYMON019 | g1161602 | BLASTX | 116 | 1e-16 | 73 |
| 1186 | 16 | 700910043H1 | SOYMON022 | g1161601 | BLASTN | 328 | 1e-16 | 75 |
| 1187 | 16 | 701043760H1 | SOYMON032 | g1161602 | BLASTX | 154 | 1e-14 | 83 |
| 1188 | 16 | 700845883H1 | SOYMON021 | g1022805 | BLASTX | 86 | 1e-13 | 77 |
| 1189 | 16 | 700967838H1 | SOYMON033 | g1161602 | BLASTX | 87 | 1e-11 | 59 |
| 1190 | 16 | 700731857H1 | SOYMON010 | g21835 | BLASTX | 71 | 1e-10 | 58 |
| 1191 | 16 | 701064594H1 | SOYMON034 | g1161602 | BLASTX | 125 | 1e-10 | 86 |
| 1192 | 16 | 701062162H1 | SOYMON033 | g1161599 | BLASTN | 255 | 1e-10 | 72 |
| 1193 | 1699 | 700560995H1 | SOYMON001 | g1022804 | BLASTN | 986 | 1e-73 | 82 |
| 1194 | 1699 | 700562380H1 | SOYMON002 | g1022804 | BLASTN | 954 | 1e-70 | 82 |
| 1195 | 1699 | 700985880H1 | SOYMON009 | g1161599 | BLASTN | 957 | 1e-70 | 82 |
| 1196 | 1699 | 700560287H1 | SOYMON001 | g1022802 | BLASTN | 924 | 1e-68 | 80 |
| 1197 | 1699 | 700963530H1 | SOYMON022 | g3328121 | BLASTN | 886 | 1e-65 | 80 |
| 1198 | 1699 | 700875947H1 | SOYMON018 | g1161599 | BLASTN | 862 | 1e-63 | 83 |
| 1199 | 1699 | 701000877H1 | SOYMON018 | g3328121 | BLASTN | 871 | 1e-63 | 78 |
| 1200 | 1699 | 700875149H1 | SOYMON018 | g1161599 | BLASTN | 854 | 1e-62 | 82 |
| 1201 | 1699 | 700562040H1 | SOYMON002 | g1022804 | BLASTN | 589 | 1e-60 | 82 |
| 1202 | 1699 | 700988386H1 | SOYMON009 | g1022804 | BLASTN | 831 | 1e-60 | 80 |
| 1203 | 1699 | 700684389H1 | SOYMON008 | g3328121 | BLASTN | 834 | 1e-60 | 81 |
| 1204 | 1699 | 700561801H1 | SOYMON002 | g1161599 | BLASTN | 769 | 1e-59 | 77 |

TABLE A*-continued

| Seq No. | Cluster ID | CloneID | Library | NCBI gi | Method | Score | P-value | % Ident |
|---|---|---|---|---|---|---|---|---|
| 1205 | 1699 | 700898022H1 | SOYMON027 | g1022802 | BLASTN | 817 | 1e−59 | 80 |
| 1206 | 1699 | 700790662H2 | SOYMON011 | g1161599 | BLASTN | 806 | 1e−58 | 82 |
| 1207 | 1699 | 700684507H1 | SOYMON008 | g1022802 | BLASTN | 609 | 1e−57 | 80 |
| 1208 | 1699 | 700844926H1 | SOYMON021 | g1022802 | BLASTN | 777 | 1e−56 | 81 |
| 1209 | 1699 | 700875409H1 | SOYMON018 | g21271 | BLASTN | 585 | 1e−55 | 80 |
| 1210 | 1699 | 700677812H1 | SOYMON007 | g21271 | BLASTN | 776 | 1e−55 | 82 |
| 1211 | 1699 | 701133849H1 | SOYMON038 | g21832 | BLASTN | 759 | 1e−54 | 80 |
| 1212 | 1699 | 700978393H1 | SOYMON009 | g21271 | BLASTN | 440 | 1e−53 | 82 |
| 1213 | 1699 | 700741608H1 | SOYMON012 | g3328121 | BLASTN | 669 | 1e−53 | 79 |
| 1214 | 1699 | 700741228H1 | SOYMON012 | g1022804 | BLASTN | 753 | 1e−53 | 81 |
| 1215 | 1699 | 700562038H1 | SOYMON002 | g21271 | BLASTN | 662 | 1e−52 | 82 |
| 1216 | 1699 | 700740204H1 | SOYMON012 | g3328121 | BLASTN | 730 | 1e−52 | 81 |
| 1217 | 1699 | 700740733H1 | SOYMON012 | g1161599 | BLASTN | 662 | 1e−51 | 80 |
| 1218 | 1699 | 700685870H1 | SOYMON008 | g1022802 | BLASTN | 720 | 1e−51 | 81 |
| 1219 | 1699 | 700554310H1 | SOYMON001 | g1161599 | BLASTN | 558 | 1e−49 | 76 |
| 1220 | 1699 | 700863147H1 | SOYMON023 | g21832 | BLASTN | 704 | 1e−49 | 83 |
| 1221 | 1699 | 700991401H1 | SOYMON011 | g3328121 | BLASTN | 591 | 1e−48 | 80 |
| 1222 | 1699 | 700998332H1 | SOYMON018 | g1022802 | BLASTN | 678 | 1e−47 | 81 |
| 1223 | 1699 | 700945115H1 | SOYMON024 | g21271 | BLASTN | 408 | 1e−46 | 77 |
| 1224 | 1699 | 700556386H1 | SOYMON001 | g21271 | BLASTN | 615 | 1e−46 | 81 |
| 1225 | 1699 | 700566403H1 | SOYMON002 | g21271 | BLASTN | 667 | 1e−46 | 80 |
| 1226 | 1699 | 700683958H1 | SOYMON008 | g1161599 | BLASTN | 299 | 1e−45 | 83 |
| 1227 | 1699 | 700686245H1 | SOYMON008 | g1022802 | BLASTN | 456 | 1e−40 | 84 |
| 1228 | 1699 | 700787536H1 | SOYMON011 | g1161599 | BLASTN | 581 | 1e−39 | 81 |
| 1229 | 1699 | 700740635H1 | SOYMON012 | g1022804 | BLASTN | 363 | 1e−38 | 84 |
| 1230 | 1699 | 700875038H1 | SOYMON018 | g1161599 | BLASTN | 551 | 1e−37 | 81 |
| 1231 | 1699 | 700677613H1 | SOYMON007 | g3328121 | BLASTN | 552 | 1e−37 | 83 |
| 1232 | 1699 | 700683146H1 | SOYMON008 | g21834 | BLASTN | 467 | 1e−29 | 82 |
| 1233 | 182 | 700652503H1 | SOYMON003 | g2257597 | BLASTN | 861 | 1e−102 | 87 |
| 1234 | 182 | 700653271H1 | SOYMON003 | g2257597 | BLASTN | 1303 | 1e−102 | 92 |
| 1235 | 182 | 700653809H1 | SOYMON003 | g2257597 | BLASTN | 1303 | 1e−102 | 92 |
| 1236 | 182 | 700653270H1 | SOYMON003 | g2257597 | BLASTN | 1303 | 1e−102 | 92 |
| 1237 | 182 | 700653817H1 | SOYMON003 | g2257597 | BLASTN | 1289 | 1e−101 | 91 |
| 1238 | 182 | 701105168H1 | SOYMON036 | g2257597 | BLASTN | 1219 | 1e−93 | 91 |
| 1239 | 182 | 701045331H1 | SOYMON032 | g2257597 | BLASTN | 1194 | 1e−91 | 91 |
| 1240 | 182 | 701049149H1 | SOYMON032 | g2257597 | BLASTN | 1162 | 1e−88 | 90 |
| 1241 | 182 | 700661992H1 | SOYMON005 | g2257597 | BLASTN | 499 | 1e−85 | 86 |
| 1242 | 182 | 701051265H1 | SOYMON032 | g2257597 | BLASTN | 1119 | 1e−85 | 91 |
| 1243 | 182 | 701058557H1 | SOYMON033 | g2257597 | BLASTN | 893 | 1e−83 | 88 |
| 1244 | 182 | 700956835H1 | SOYMON022 | g2257597 | BLASTN | 1102 | 1e−83 | 91 |
| 1245 | 182 | 701054480H1 | SOYMON032 | g2257597 | BLASTN | 918 | 1e−82 | 87 |
| 1246 | 182 | 700903222H1 | SOYMON022 | g2257597 | BLASTN | 1074 | 1e−81 | 90 |
| 1247 | 182 | 700959058H1 | SOYMON022 | g2257597 | BLASTN | 1078 | 1e−81 | 91 |
| 1248 | 182 | 701105272H1 | SOYMON036 | g2257597 | BLASTN | 1081 | 1e−81 | 89 |
| 1249 | 182 | 701058567H1 | SOYMON033 | g2257597 | BLASTN | 617 | 1e−80 | 91 |
| 1250 | 182 | 701206133H1 | SOYMON035 | g2257597 | BLASTN | 1068 | 1e−80 | 88 |
| 1251 | 182 | 701061140H1 | SOYMON033 | g2257597 | BLASTN | 556 | 1e−79 | 87 |
| 1252 | 182 | 700749775H1 | SOYMON013 | g2257597 | BLASTN | 1054 | 1e−79 | 88 |
| 1253 | 182 | 700946208H1 | SOYMON024 | g2257597 | BLASTN | 1056 | 1e−79 | 87 |
| 1254 | 182 | 700952526H1 | SOYMON022 | g2257597 | BLASTN | 1027 | 1e−77 | 89 |
| 1255 | 182 | 700902915H1 | SOYMON022 | g2257597 | BLASTN | 1028 | 1e−77 | 90 |
| 1256 | 182 | 700739757H1 | SOYMON012 | g2257597 | BLASTN | 1029 | 1e−77 | 90 |
| 1257 | 182 | 700685033H1 | SOYMON008 | g2257597 | BLASTN | 1034 | 1e−77 | 89 |
| 1258 | 182 | 700890918H1 | SOYMON024 | g2257597 | BLASTN | 1017 | 1e−76 | 90 |
| 1259 | 182 | 700849869H1 | SOYMON021 | g2257597 | BLASTN | 1006 | 1e−75 | 91 |
| 1260 | 182 | 701132415H1 | SOYMON038 | g2257597 | BLASTN | 521 | 1e−74 | 89 |
| 1261 | 182 | 700835725H1 | SOYMON019 | g2257597 | BLASTN | 572 | 1e−74 | 88 |
| 1262 | 182 | 701125828H1 | SOYMON037 | g2257597 | BLASTN | 988 | 1e−74 | 89 |
| 1263 | 182 | 700891372H1 | SOYMON024 | g2257597 | BLASTN | 967 | 1e−72 | 90 |
| 1264 | 182 | 700898167H1 | SOYMON027 | g2257597 | BLASTN | 967 | 1e−72 | 87 |
| 1265 | 182 | 700891730H1 | SOYMON024 | g2257597 | BLASTN | 941 | 1e−70 | 88 |
| 1266 | 182 | 700901850H1 | SOYMON027 | g2257597 | BLASTN | 933 | 1e−69 | 93 |
| 1267 | 182 | 700838329H1 | SOYMON020 | g2257597 | BLASTN | 935 | 1e−69 | 91 |
| 1268 | 182 | 700895548H1 | SOYMON027 | g2257597 | BLASTN | 916 | 1e−67 | 88 |
| 1269 | 182 | 700645519H1 | SOYMON009 | g2257597 | BLASTN | 904 | 1e−66 | 91 |
| 1270 | 182 | 701102605H1 | SOYMON028 | g2257597 | BLASTN | 882 | 1e−65 | 91 |
| 1271 | 182 | 701039360H1 | SOYMON029 | g2257597 | BLASTN | 546 | 1e−64 | 87 |
| 1272 | 182 | 701151305H1 | SOYMON031 | g2257597 | BLASTN | 661 | 1e−53 | 93 |
| 1273 | 182 | 701151405H1 | SOYMON031 | g2257597 | BLASTN | 696 | 1e−49 | 93 |
| 1274 | 182 | 700940911H1 | SOYMON024 | g2257597 | BLASTN | 356 | 1e−38 | 72 |
| 1275 | 182 | 700648994H1 | SOYMON003 | g2257597 | BLASTN | 529 | 1e−35 | 85 |
| 1276 | 182 | 700564729H1 | SOYMON002 | g2257597 | BLASTN | 451 | 1e−28 | 84 |
| 1277 | 23349 | 700894074H1 | SOYMON024 | g143760 | BLASTX | 137 | 1e−13 | 83 |
| 1278 | 5614 | 700558488H1 | SOYMON001 | g1161599 | BLASTN | 949 | 1e−70 | 84 |
| 1279 | 5614 | 700792287H1 | SOYMON011 | g1161599 | BLASTN | 935 | 1e−69 | 84 |
| 1280 | 5614 | 701000168H1 | SOYMON018 | g1161599 | BLASTN | 916 | 1e−67 | 81 |
| 1281 | 5614 | 700739376H1 | SOYMON012 | g1161599 | BLASTN | 920 | 1e−67 | 85 |

TABLE A*-continued

| Seq No. | Cluster ID | CloneID | Library | NCBI gi | Method | Score | P-value | % Ident |
|---|---|---|---|---|---|---|---|---|
| 1282 | 5614 | 700854915H1 | SOYMON023 | g1161599 | BLASTN | 894 | 1e-65 | 87 |
| 1283 | 5614 | 700874304H1 | SOYMON018 | g1161599 | BLASTN | 827 | 1e-60 | 82 |
| 1284 | 5614 | 700656867H1 | SOYMON004 | g1161599 | BLASTN | 626 | 1e-43 | 84 |
| 1285 | 5614 | 700996544H1 | SOYMON018 | g1161599 | BLASTN | 385 | 1e-40 | 75 |
| 1286 | 5614 | 700742706H1 | SOYMON012 | g1161600 | BLASTX | 160 | 1e-15 | 88 |
| 1287 | -GM16843 | LIB3055-001-Q1-B1-B7 | LIB3055 | g1022802 | BLASTN | 665 | 1e-48 | 71 |
| 1288 | -GM3918 | LIB3029-012-Q1-B1-G1 | LIB3029 | g21834 | BLASTN | 241 | 1e-8 | 66 |
| 1289 | 16 | LIB3040-022-Q1-E1-D5 | LIB3040 | g1161601 | BLASTN | 1074 | 1e-78 | 72 |
| 1290 | 16 | LIB3039-049-Q1-E1-D8 | LIB3039 | g1161601 | BLASTN | 906 | 1e-66 | 75 |
| 1291 | 16 | LIB3052-002-Q1-B1-H2 | LIB3052 | g1161601 | BLASTN | 858 | 1e-62 | 75 |
| 1292 | 16 | LIB3040-020-Q1-E1-C8 | LIB3040 | g1161601 | BLASTN | 842 | 1e-61 | 75 |
| 1293 | 16 | LIB3056-007-Q1-N1-G5 | LIB3056 | g1161601 | BLASTN | 849 | 1e-61 | 75 |
| 1294 | 16 | LIB3039-040-Q1-E1-D8 | LIB3039 | g1161601 | BLASTN | 767 | 1e-55 | 74 |
| 1295 | 16 | LIB3040-033-Q1-E1-B5 | LIB3040 | g1161601 | BLASTN | 418 | 1e-47 | 75 |
| 1296 | 16 | LIB3039-012-Q1-E1-F12 | LIB3039 | g1161601 | BLASTN | 643 | 1e-42 | 74 |
| 1297 | 16 | LIB3053-014-Q1-N1-A3 | LIB3053 | g1161602 | BLASTX | 101 | 1e-39 | 58 |
| 1298 | 1699 | LIB3028-001-Q1-B1-A12 | LIB3028 | g21271 | BLASTN | 1151 | 1e-87 | 78 |
| 1299 | 1699 | LIB3065-008-Q1-N1-F5 | LIB3065 | g21832 | BLASTN | 606 | 1e-40 | 79 |
| 1300 | 1699 | LIB3055-012-Q1-N1-E3 | LIB3055 | g21832 | BLASTN | 457 | 1e-26 | 83 |
| 1301 | 1699 | LIB3055-005-Q1-N1-A2 | LIB3055 | g21832 | BLASTN | 263 | 1e-13 | 76 |
| 1302 | 182 | LIB3051-039-Q1-K1-B6 | LIB3051 | g2257597 | BLASTN | 1757 | 1e-140 | 90 |
| 1303 | 182 | LIB3054-007-Q1-N1-A7 | LIB3054 | g2257597 | BLASTN | 1354 | 1e-112 | 88 |
| 1304 | 182 | LIB3039-027-Q1-E1-H9 | LIB3039 | g2257597 | BLASTN | 1089 | 1e-110 | 90 |
| 1305 | 5614 | LIB3049-026-Q1-E1-D8 | LIB3049 | g1161599 | BLASTN | 798 | 1e-88 | 84 |
| 1306 | 5614 | LIB3028-006-Q1-B1-C12 | LIB3028 | g1161599 | BLASTN | 935 | 1e-69 | 86 |
| 1307 | 5614 | LIB3028-007-Q1-B1-C11 | LIB3028 | g1161599 | BLASTN | 665 | 1e-44 | 83 |
| MAIZE GLYCERALDEHYDE 3-PHOSPHATE DEHYDROGENASE | | | | | | | | |
| 1308 | -700016883 | 700016883H1 | SATMON001 | g1185553 | BLASTN | 459 | 1e-35 | 95 |
| 1309 | -700021845 | 700021845H1 | SATMON001 | g1185553 | BLASTN | 379 | 1e-22 | 95 |
| 1310 | -700042428 | 700042428H1 | SATMON004 | g168520 | BLASTN | 810 | 1e-61 | 87 |
| 1311 | -700042586 | 700042586H1 | SATMON004 | g168478 | BLASTN | 572 | 1e-68 | 96 |
| 1312 | -700076627 | 700076627H1 | SATMON007 | g1185553 | BLASTN | 406 | 1e-23 | 89 |
| 1313 | -700082565 | 700082565H1 | SATMON011 | g1185553 | BLASTN | 415 | 1e-23 | 78 |
| 1314 | -700083976 | 700083976H1 | SATMON011 | g22237 | BLASTN | 365 | 1e-21 | 90 |
| 1315 | -700085105 | 700085105H1 | SATMON011 | g1185553 | BLASTN | 344 | 1e-17 | 74 |
| 1316 | -700087058 | 700087058H1 | SATMON011 | g1184773 | BLASTN | 278 | 1e-14 | 98 |
| 1317 | -700087967 | 700087967H1 | SATMON011 | g168478 | BLASTN | 1240 | 1e-94 | 100 |
| 1318 | -700095618 | 700095618H1 | SATMON008 | g168478 | BLASTN | 567 | 1e-84 | 89 |
| 1319 | -700098365 | 700098365H1 | SATMON009 | g168478 | BLASTN | 222 | 1e-9 | 80 |
| 1320 | -700100580 | 700100580H1 | SATMON009 | g168478 | BLASTN | 463 | 1e-54 | 96 |
| 1321 | -700103906 | 700103906H1 | SATMON010 | g1185553 | BLASTN | 329 | 1e-32 | 86 |
| 1322 | -700152882 | 700152882H1 | SATMON007 | g293886 | BLASTN | 578 | 1e-39 | 94 |
| 1323 | -700155165 | 700155165H1 | SATMON007 | g1184771 | BLASTN | 450 | 1e-28 | 100 |
| 1324 | -700157523 | 700157523H1 | SATMON012 | g1185553 | BLASTN | 337 | 1e-17 | 97 |
| 1325 | -700163947 | 700163947H1 | SATMON013 | g717080 | BLASTN | 327 | 1e-16 | 82 |
| 1326 | -700197939 | 700197939H1 | SATMON016 | g22237 | BLASTN | 635 | 1e-44 | 82 |
| 1327 | -700201904 | 700201904H1 | SATMON003 | g1185553 | BLASTN | 397 | 1e-22 | 88 |
| 1328 | -700204190 | 700204190H1 | SATMON003 | g22302 | BLASTN | 295 | 1e-43 | 90 |
| 1329 | -700236061 | 700236061H1 | SATMON010 | g1185553 | BLASTN | 273 | 1e-12 | 79 |
| 1330 | -700238253 | 700238253H1 | SATMON010 | g2143408 | BLASTN | 1099 | 1e-82 | 96 |
| 1331 | -700256918 | 700256918H1 | SATMON017 | g474407 | BLASTN | 1367 | 1e-112 | 98 |
| 1332 | -700259576 | 700259576H1 | SATMON017 | g717080 | BLASTN | 280 | 1e-48 | 81 |
| 1333 | -700263524 | 700263524H1 | SATMON017 | g22302 | BLASTN | 547 | 1e-59 | 97 |
| 1334 | -700281884 | 700281884H2 | SATMON021 | g717080 | BLASTN | 296 | 1e-14 | 65 |
| 1335 | -700340490 | 700340490H1 | SATMON020 | g1185553 | BLASTN | 372 | 1e-22 | 88 |

TABLE A*-continued

| Seq No. | Cluster ID | CloneID | Library | NCBI gi | Method | Score | P-value | % Ident |
|---|---|---|---|---|---|---|---|---|
| 1336 | -700346430 | 700346430H1 | SATMON021 | g1185553 | BLASTN | 334 | 1e-20 | 85 |
| 1337 | -700349202 | 700349202H1 | SATMON023 | g157476 | BLASTX | 126 | 1e-22 | 71 |
| 1338 | -700349272 | 700349272H1 | SATMON023 | g1100222 | BLASTN | 466 | 1e-28 | 67 |
| 1339 | -700356209 | 700356209H1 | SATMON024 | g1184773 | BLASTN | 325 | 1e-24 | 95 |
| 1340 | -700377496 | 700377496H1 | SATMON019 | g1184773 | BLASTN | 549 | 1e-70 | 93 |
| 1341 | -700404753 | 700404753H1 | SATMON026 | g168520 | BLASTN | 455 | 1e-29 | 88 |
| 1342 | -700421516 | 700421516H1 | SATMONN01 | g717080 | BLASTN | 269 | 1e-17 | 83 |
| 1343 | -700427941 | 700427941H1 | SATMONN01 | g717080 | BLASTN | 524 | 1e-34 | 68 |
| 1344 | -700428888 | 700428888H1 | SATMONN01 | g22302 | BLASTN | 232 | 1e-10 | 70 |
| 1345 | -700432127 | 700432127H1 | SATMONN01 | g168521 | BLASTN | 269 | 1e-21 | 97 |
| 1346 | -700438281 | 700438281H1 | SATMON026 | g168478 | BLASTN | 283 | 1e-38 | 92 |
| 1347 | -700551026 | 700551026H1 | SATMON022 | g1185553 | BLASTN | 243 | 1e-9 | 72 |
| 1348 | -700553346 | 700553346H1 | SATMON022 | g717080 | BLASTN | 218 | 1e-12 | 80 |
| 1349 | -700570760 | 700570760H1 | SATMON030 | g1184773 | BLASTN | 358 | 1e-21 | 76 |
| 1350 | -700580159 | 700580159H1 | SATMON031 | g1185553 | BLASTN | 381 | 1e-22 | 76 |
| 1351 | -700616468 | 700616468H1 | SATMON033 | g1100225 | BLASTX | 160 | 1e-15 | 85 |
| 1352 | -700616996 | 700616996H1 | SATMON033 | g20732 | BLASTN | 468 | 1e-30 | 80 |
| 1353 | -700618295 | 700618295H1 | SATMON033 | g1184773 | BLASTN | 307 | 1e-47 | 89 |
| 1354 | -700622760 | 700622760H1 | SATMON034 | g1184771 | BLASTN | 358 | 1e-24 | 86 |
| 1355 | -700799777 | 700799777H1 | SATMON036 | g12158 | BLASTN | 198 | 1e-14 | 76 |
| 1356 | -700801109 | 700801109H1 | SATMON036 | g22302 | BLASTN | 978 | 1e-92 | 99 |
| 1357 | -701161482 | 701161482H1 | SATMONN04 | g1185553 | BLASTN | 310 | 1e-26 | 91 |
| 1358 | -701166637 | 701166637H1 | SATMONN04 | g1184771 | BLASTN | 398 | 1e-24 | 86 |
| 1359 | -701169309 | 701169309H1 | SATMONN05 | g168478 | BLASTN | 303 | 1e-14 | 69 |
| 1360 | -701182137 | 701182137H1 | SATMONN06 | g168478 | BLASTN | 235 | 1e-8 | 91 |
| 1361 | -701186041 | 701186041H1 | SATMONN06 | g1185555 | BLASTN | 261 | 1e-12 | 67 |
| 1362 | 11871 | 700017162H1 | SATMON001 | g1185553 | BLASTN | 479 | 1e-34 | 88 |
| 1363 | 11871 | 700100796H1 | SATMON009 | g1185553 | BLASTN | 480 | 1e-31 | 87 |
| 1364 | 11926 | 700623916H1 | SATMON034 | g168478 | BLASTN | 255 | 1e-10 | 76 |
| 1365 | 11926 | 700623908H1 | SATMON034 | g168478 | BLASTN | 241 | 1e-9 | 75 |
| 1366 | 1334 | 700470437H1 | SATMON025 | g717080 | BLASTN | 312 | 1e-19 | 80 |
| 1367 | 1334 | 700578860H1 | SATMON031 | g717080 | BLASTN | 310 | 1e-14 | 83 |
| 1368 | 14664 | 700163212H1 | SATMON013 | g1100222 | BLASTN | 844 | 1e-61 | 80 |
| 1369 | 14664 | 700382256H1 | SATMON024 | g1100222 | BLASTN | 764 | 1e-54 | 81 |
| 1370 | 1692 | 700085317H1 | SATMON011 | g3059121 | BLASTN | 970 | 1e-72 | 79 |
| 1371 | 1692 | 700222942H1 | SATMON011 | g1100222 | BLASTN | 898 | 1e-66 | 81 |
| 1372 | 1692 | 700618371H1 | SATMON033 | g3059121 | BLASTN | 554 | 1e-65 | 78 |
| 1373 | 1692 | 700381022H1 | SATMON023 | g1100222 | BLASTN | 660 | 1e-48 | 76 |
| 1374 | 1692 | 700264023H1 | SATMON017 | g1100222 | BLASTN | 678 | 1e-47 | 84 |
| 1375 | 1692 | 700258875H1 | SATMON017 | g1100222 | BLASTN | 556 | 1e-44 | 80 |
| 1376 | 1692 | 700612308H1 | SATMON033 | g460978 | BLASTN | 442 | 1e-28 | 80 |
| 1377 | 1692 | 700552370H1 | SATMON022 | g624679 | BLASTX | 124 | 1e-22 | 69 |
| 1378 | 1692 | 700458135H1 | SATMON029 | g1100222 | BLASTN | 299 | 1e-20 | 83 |
| 1379 | 17968 | 700339973H1 | SATMON020 | g1184775 | BLASTN | 1235 | 1e-98 | 100 |
| 1380 | 17968 | 700800152H1 | SATMON036 | g1184775 | BLASTN | 625 | 1e-43 | 100 |
| 1381 | 18309 | 700381457H1 | SATMON023 | g3101 | BLASTN | 444 | 1e-28 | 72 |
| 1382 | 19858 | 700102991H1 | SATMON010 | g1100223 | BLASTX | 118 | 1e-9 | 69 |
| 1383 | 20203 | 700017766H1 | SATMON001 | g1185553 | BLASTN | 525 | 1e-37 | 91 |
| 1384 | 20203 | 700020155H1 | SATMON001 | g1185553 | BLASTN | 518 | 1e-36 | 90 |
| 1385 | 2148 | 700617018H1 | SATMON033 | g474407 | BLASTN | 960 | 1e-112 | 95 |
| 1386 | 2148 | 701166093H1 | SATMONN04 | g474407 | BLASTN | 1005 | 1e-80 | 96 |
| 1387 | 2148 | 700430939H1 | SATMONN01 | g474407 | BLASTN | 438 | 1e-46 | 91 |
| 1388 | 22918 | 701175483H1 | SATMONN05 | g1185553 | BLASTN | 492 | 1e-32 | 88 |
| 1389 | 22918 | 701176645H1 | SATMONN05 | g1185553 | BLASTN | 397 | 1e-23 | 81 |
| 1390 | 2468 | 700100660H1 | SATMON009 | g168478 | BLASTN | 1490 | 1e-115 | 100 |
| 1391 | 2468 | 700097261H1 | SATMON009 | g22239 | BLASTN | 1135 | 1e-114 | 100 |
| 1392 | 2468 | 700097360H1 | SATMON009 | g168478 | BLASTN | 1468 | 1e-113 | 99 |
| 1393 | 2468 | 700098573H1 | SATMON009 | g22239 | BLASTN | 1305 | 1e-100 | 100 |
| 1394 | 2468 | 700101255H1 | SATMON009 | g168478 | BLASTN | 840 | 1e-85 | 96 |
| 1395 | 2468 | 700580636H1 | SATMON031 | g22239 | BLASTN | 903 | 1e-74 | 95 |
| 1396 | 2468 | 700044915H1 | SATMON004 | g22239 | BLASTN | 870 | 1e-63 | 100 |
| 1397 | 27323 | 700166009H1 | SATMON013 | g474407 | BLASTN | 1166 | 1e-88 | 99 |
| 1398 | 27323 | 700075283H1 | SATMON007 | g474407 | BLASTN | 997 | 1e-74 | 99 |
| 1399 | 30327 | 700158422H1 | SATMON012 | g22302 | BLASTN | 339 | 1e-44 | 83 |
| 1400 | 31280 | 700470273H1 | SATMON025 | g1185553 | BLASTN | 160 | 1e-8 | 71 |
| 1401 | 32165 | 700212044H1 | SATMON016 | g474407 | BLASTN | 1468 | 1e-113 | 99 |
| 1402 | 325 | 700201678H1 | SATMON003 | g22237 | BLASTN | 1478 | 1e-132 | 99 |
| 1403 | 325 | 700618123H1 | SATMON033 | g1184775 | BLASTN | 1007 | 1e-130 | 99 |
| 1404 | 325 | 700091437H1 | SATMON011 | g1184771 | BLASTN | 1162 | 1e-129 | 97 |
| 1405 | 325 | 700096907H1 | SATMON008 | g1184771 | BLASTN | 1650 | 1e-128 | 100 |
| 1406 | 325 | 700090956H1 | SATMON011 | g22237 | BLASTN | 1635 | 1e-127 | 100 |
| 1407 | 325 | 700573711H1 | SATMON030 | g1184773 | BLASTN | 1624 | 1e-126 | 99 |
| 1408 | 325 | 700208421H1 | SATMON016 | g22237 | BLASTN | 1606 | 1e-125 | 99 |
| 1409 | 325 | 700573153H1 | SATMON030 | g1184771 | BLASTN | 1392 | 1e-124 | 97 |
| 1410 | 325 | 700106667H1 | SATMON010 | g1184771 | BLASTN | 1595 | 1e-124 | 100 |
| 1411 | 325 | 700266257H1 | SATMON017 | g1184771 | BLASTN | 1595 | 1e-124 | 100 |
| 1412 | 325 | 700082726H1 | SATMON011 | g1184771 | BLASTN | 1599 | 1e-124 | 99 |

TABLE A*-continued

| Seq No. | Cluster ID | CloneID | Library | NCBI gi | Method | Score | P-value | % Ident |
|---|---|---|---|---|---|---|---|---|
| 1413 | 325 | 700092552H1 | SATMON008 | g1184771 | BLASTN | 1585 | 1e-123 | 100 |
| 1414 | 325 | 700075862H1 | SATMON007 | g1184773 | BLASTN | 1589 | 1e-123 | 99 |
| 1415 | 325 | 700621325H1 | SATMON034 | g1184771 | BLASTN | 1589 | 1e-123 | 99 |
| 1416 | 325 | 700282389H2 | SATMON023 | g1184771 | BLASTN | 1590 | 1e-123 | 100 |
| 1417 | 325 | 700082207H1 | SATMON011 | g1184773 | BLASTN | 1568 | 1e-122 | 99 |
| 1418 | 325 | 700103258H1 | SATMON010 | g1184771 | BLASTN | 1575 | 1e-122 | 98 |
| 1419 | 325 | 700331931H1 | SATMON019 | g1184771 | BLASTN | 1575 | 1e-122 | 100 |
| 1420 | 325 | 700575033H1 | SATMON030 | g22237 | BLASTN | 763 | 1e-121 | 95 |
| 1421 | 325 | 700073504H1 | SATMON007 | g1184771 | BLASTN | 1412 | 1e-121 | 97 |
| 1422 | 325 | 700573737H1 | SATMON030 | g1184771 | BLASTN | 1540 | 1e-121 | 94 |
| 1423 | 325 | 700077448H1 | SATMON007 | g1184775 | BLASTN | 1555 | 1e-121 | 100 |
| 1424 | 325 | 700082338H1 | SATMON011 | g1184771 | BLASTN | 1560 | 1e-121 | 100 |
| 1425 | 325 | 700575985H1 | SATMON030 | g1184771 | BLASTN | 1208 | 1e-120 | 96 |
| 1426 | 325 | 700091658H1 | SATMON011 | g1184771 | BLASTN | 1453 | 1e-120 | 99 |
| 1427 | 325 | 700259305H1 | SATMON017 | g22237 | BLASTN | 1476 | 1e-120 | 99 |
| 1428 | 325 | 700092013H1 | SATMON008 | g22237 | BLASTN | 1545 | 1e-120 | 100 |
| 1429 | 325 | 700104625H1 | SATMON010 | g1184771 | BLASTN | 1545 | 1e-120 | 100 |
| 1430 | 325 | 700082934H1 | SATMON011 | g22237 | BLASTN | 1546 | 1e-120 | 99 |
| 1431 | 325 | 700083987H1 | SATMON011 | g1184771 | BLASTN | 1548 | 1e-120 | 99 |
| 1432 | 325 | 700084648H1 | SATMON011 | g22237 | BLASTN | 1551 | 1e-120 | 99 |
| 1433 | 325 | 700095742H1 | SATMON008 | g22237 | BLASTN | 1552 | 1e-120 | 99 |
| 1434 | 325 | 700049963H1 | SATMON003 | g1184771 | BLASTN | 1554 | 1e-120 | 99 |
| 1435 | 325 | 700086285H1 | SATMON011 | g1184771 | BLASTN | 1555 | 1e-120 | 100 |
| 1436 | 325 | 700622187H1 | SATMON034 | g1184771 | BLASTN | 1555 | 1e-120 | 98 |
| 1437 | 325 | 700082208H1 | SATMON011 | g1184771 | BLASTN | 1076 | 1e-119 | 99 |
| 1438 | 325 | 700615142H1 | SATMON033 | g1184775 | BLASTN | 1141 | 1e-119 | 98 |
| 1439 | 325 | 700072750H1 | SATMON007 | g1184773 | BLASTN | 1538 | 1e-119 | 99 |
| 1440 | 325 | 700210619H1 | SATMON016 | g22237 | BLASTN | 1540 | 1e-119 | 100 |
| 1441 | 325 | 700083321H1 | SATMON011 | g1184771 | BLASTN | 1540 | 1e-119 | 100 |
| 1442 | 325 | 700090105H1 | SATMON011 | g1184771 | BLASTN | 1541 | 1e-119 | 99 |
| 1443 | 325 | 700049167H1 | SATMON003 | g1184771 | BLASTN | 1033 | 1e-118 | 97 |
| 1444 | 325 | 700074010H1 | SATMON007 | g1184773 | BLASTN | 1523 | 1e-118 | 98 |
| 1445 | 325 | 700101165H1 | SATMON009 | g22237 | BLASTN | 1524 | 1e-118 | 99 |
| 1446 | 325 | 700049769H1 | SATMON003 | g1184771 | BLASTN | 1525 | 1e-118 | 100 |
| 1447 | 325 | 700263267H1 | SATMON017 | g1184771 | BLASTN | 1510 | 1e-117 | 100 |
| 1448 | 325 | 700265580H1 | SATMON017 | g22237 | BLASTN | 1510 | 1e-117 | 100 |
| 1449 | 325 | 700266447H1 | SATMON017 | g22237 | BLASTN | 1513 | 1e-117 | 99 |
| 1450 | 325 | 700026705H1 | SATMON003 | g1184771 | BLASTN | 1515 | 1e-117 | 100 |
| 1451 | 325 | 700098736H1 | SATMON009 | g22237 | BLASTN | 1515 | 1e-117 | 100 |
| 1452 | 325 | 700106693H1 | SATMON010 | g1184775 | BLASTN | 1517 | 1e-117 | 99 |
| 1453 | 325 | 700086276H1 | SATMON011 | g22237 | BLASTN | 1364 | 1e-116 | 92 |
| 1454 | 325 | 700087952H1 | SATMON011 | g1184771 | BLASTN | 1381 | 1e-116 | 99 |
| 1455 | 325 | 700206583H1 | SATMON003 | g1184771 | BLASTN | 1400 | 1e-116 | 98 |
| 1456 | 325 | 700088779H1 | SATMON011 | g22237 | BLASTN | 1497 | 1e-116 | 99 |
| 1457 | 325 | 700212176H1 | SATMON016 | g1184773 | BLASTN | 1499 | 1e-116 | 99 |
| 1458 | 325 | 700085815H1 | SATMON011 | g1184773 | BLASTN | 1500 | 1e-116 | 100 |
| 1459 | 325 | 700085668H1 | SATMON011 | g22237 | BLASTN | 1501 | 1e-116 | 99 |
| 1460 | 325 | 700106805H1 | SATMON010 | g1184771 | BLASTN | 1501 | 1e-116 | 99 |
| 1461 | 325 | 700103136H1 | SATMON010 | g1184773 | BLASTN | 1502 | 1e-116 | 99 |
| 1462 | 325 | 700089503H1 | SATMON011 | g22237 | BLASTN | 1507 | 1e-116 | 99 |
| 1463 | 325 | 700260534H2 | SATMON017 | g22237 | BLASTN | 792 | 1e-115 | 97 |
| 1464 | 325 | 700083056H1 | SATMON011 | g1184771 | BLASTN | 970 | 1e-115 | 100 |
| 1465 | 325 | 700211911H1 | SATMON016 | g1184771 | BLASTN | 1300 | 1e-115 | 100 |
| 1466 | 325 | 700343952H1 | SATMON021 | g22237 | BLASTN | 1485 | 1e-115 | 100 |
| 1467 | 325 | 700220468H1 | SATMON011 | g1184771 | BLASTN | 1485 | 1e-115 | 100 |
| 1468 | 325 | 700331968H1 | SATMON019 | g1184771 | BLASTN | 1485 | 1e-115 | 100 |
| 1469 | 325 | 700077160H1 | SATMON007 | g1184775 | BLASTN | 1487 | 1e-115 | 99 |
| 1470 | 325 | 700466212H1 | SATMON025 | g22237 | BLASTN | 1487 | 1e-115 | 98 |
| 1471 | 325 | 700085480H1 | SATMON011 | g1184771 | BLASTN | 1488 | 1e-115 | 99 |
| 1472 | 325 | 700097118H1 | SATMON009 | g1184773 | BLASTN | 1489 | 1e-115 | 97 |
| 1473 | 325 | 700267631H1 | SATMON017 | g22237 | BLASTN | 1491 | 1e-115 | 99 |
| 1474 | 325 | 700106452H1 | SATMON010 | g1184771 | BLASTN | 1492 | 1e-115 | 98 |
| 1475 | 325 | 700349721H1 | SATMON023 | g1184775 | BLASTN | 1493 | 1e-115 | 99 |
| 1476 | 325 | 700084191H1 | SATMON011 | g1184773 | BLASTN | 1494 | 1e-115 | 99 |
| 1477 | 325 | 700265560H1 | SATMON017 | g22237 | BLASTN | 1495 | 1e-115 | 100 |
| 1478 | 325 | 700083729H1 | SATMON011 | g22237 | BLASTN | 1495 | 1e-115 | 100 |
| 1479 | 325 | 700074701H1 | SATMON007 | g1184773 | BLASTN | 779 | 1e-114 | 97 |
| 1480 | 325 | 700620211H1 | SATMON034 | g1184771 | BLASTN | 1149 | 1e-114 | 99 |
| 1481 | 325 | 700026713H1 | SATMON003 | g22237 | BLASTN | 1210 | 1e-114 | 100 |
| 1482 | 325 | 700102767H1 | SATMON010 | g1184773 | BLASTN | 1256 | 1e-114 | 98 |
| 1483 | 325 | 700048868H1 | SATMON003 | g1184773 | BLASTN | 1328 | 1e-114 | 99 |
| 1484 | 325 | 700211328H1 | SATMON016 | g1184771 | BLASTN | 1332 | 1e-114 | 97 |
| 1485 | 325 | 700348453H1 | SATMON023 | g22237 | BLASTN | 1473 | 1e-114 | 99 |
| 1486 | 325 | 700622770H1 | SATMON034 | g1184771 | BLASTN | 1474 | 1e-114 | 99 |
| 1487 | 325 | 700213013H1 | SATMON016 | g1184773 | BLASTN | 1479 | 1e-114 | 97 |
| 1488 | 325 | 700093628H1 | SATMON008 | g22237 | BLASTN | 1480 | 1e-114 | 100 |
| 1489 | 325 | 700201306H1 | SATMON003 | g1184775 | BLASTN | 1480 | 1e-114 | 100 |

TABLE A*-continued

| Seq No. | Cluster ID | CloneID | Library | NCBI gi | Method | Score | P-value | % Ident |
|---|---|---|---|---|---|---|---|---|
| 1490 | 325 | 700083087H1 | SATMON011 | g22237 | BLASTN | 1480 | 1e-114 | 100 |
| 1491 | 325 | 700085692H1 | SATMON011 | gl184773 | BLASTN | 1481 | 1e-114 | 99 |
| 1492 | 325 | 700263282H1 | SATMON017 | g22237 | BLASTN | 1481 | 1e-114 | 99 |
| 1493 | 325 | 700049783H1 | SATMON003 | gl184773 | BLASTN | 1133 | 1e-113 | 99 |
| 1494 | 325 | 700446715H1 | SATMON027 | g22237 | BLASTN | 1228 | 1e-113 | 99 |
| 1495 | 325 | 700077235H1 | SATMON007 | gl184773 | BLASTN | 1460 | 1e-113 | 100 |
| 1496 | 325 | 700028530H1 | SATMON003 | gl184771 | BLASTN | 1460 | 1e-113 | 100 |
| 1497 | 325 | 700048175H1 | SATMON003 | gl184773 | BLASTN | 1460 | 1e-113 | 98 |
| 1498 | 325 | 700343356H1 | SATMON021 | gl184773 | BLASTN | 1464 | 1e-113 | 99 |
| 1499 | 325 | 700073041H1 | SATMON007 | gl184773 | BLASTN | 1465 | 1e-113 | 100 |
| 1500 | 325 | 700092544H1 | SATMON008 | gl184773 | BLASTN | 1466 | 1e-113 | 99 |
| 1501 | 325 | 700086852H1 | SATMON011 | gl184773 | BLASTN | 1470 | 1e-113 | 100 |
| 1502 | 325 | 700357153H1 | SATMON024 | gl184775 | BLASTN | 785 | 1e-112 | 99 |
| 1503 | 325 | 700576167H1 | SATMON030 | gl184771 | BLASTN | 1151 | 1e-112 | 96 |
| 1504 | 325 | 700262594H1 | SATMON017 | g22237 | BLASTN | 1241 | 1e-112 | 99 |
| 1505 | 325 | 700553438H1 | SATMON022 | g22237 | BLASTN | 1450 | 1e-112 | 100 |
| 1506 | 325 | 700053639H1 | SATMON010 | g22237 | BLASTN | 1450 | 1e-112 | 100 |
| 1507 | 325 | 700093171H1 | SATMON008 | gl184771 | BLASTN | 1451 | 1e-112 | 99 |
| 1508 | 325 | 700257051H1 | SATMON017 | g22237 | BLASTN | 1451 | 1e-112 | 97 |
| 1509 | 325 | 700106505H1 | SATMON010 | gl184771 | BLASTN | 1452 | 1e-112 | 99 |
| 1510 | 325 | 700104544H1 | SATMON010 | gl184773 | BLASTN | 1452 | 1e-112 | 98 |
| 1511 | 325 | 700072406H2 | SATMON007 | gl184771 | BLASTN | 1455 | 1e-112 | 100 |
| 1512 | 325 | 700048728H1 | SATMON003 | gl184773 | BLASTN | 1456 | 1e-112 | 98 |
| 1513 | 325 | 700076367H1 | SATMON007 | gl184771 | BLASTN | 1456 | 1e-112 | 99 |
| 1514 | 325 | 700381774H1 | SATMON023 | g22237 | BLASTN | 1458 | 1e-112 | 95 |
| 1515 | 325 | 700347358H1 | SATMON021 | gl184771 | BLASTN | 1036 | 1e-111 | 99 |
| 1516 | 325 | 700049511H1 | SATMON003 | gl184771 | BLASTN | 1051 | 1e-111 | 99 |
| 1517 | 325 | 700075705H1 | SATMON007 | g22237 | BLASTN | 1066 | 1e-111 | 99 |
| 1518 | 325 | 700047687H1 | SATMON003 | gl184771 | BLASTN | 1191 | 1e-111 | 99 |
| 1519 | 325 | 700206516H1 | SATMON003 | gl184773 | BLASTN | 1209 | 1e-111 | 97 |
| 1520 | 325 | 700210478H1 | SATMON016 | gl184771 | BLASTN | 1351 | 1e-111 | 99 |
| 1521 | 325 | 700087443H1 | SATMON011 | gl184771 | BLASTN | 1390 | 1e-111 | 97 |
| 1522 | 325 | 700103213H1 | SATMON010 | gl184771 | BLASTN | 1440 | 1e-111 | 100 |
| 1523 | 325 | 700071776H1 | SATMON007 | g22237 | BLASTN | 1442 | 1e-111 | 99 |
| 1524 | 325 | 700073331H1 | SATMON007 | gl184771 | BLASTN | 1444 | 1e-111 | 99 |
| 1525 | 325 | 700212530H1 | SATMON016 | gl184771 | BLASTN | 1446 | 1e-111 | 99 |
| 1526 | 325 | 700346220H1 | SATMON021 | gl184775 | BLASTN | 962 | 1e-110 | 98 |
| 1527 | 325 | 700346201H1 | SATMON021 | g22237 | BLASTN | 1089 | 1e-110 | 99 |
| 1528 | 325 | 700434507H1 | SATMONN01 | g22302 | BLASTN | 1375 | 1e-110 | 100 |
| 1529 | 325 | 700077047H1 | SATMON007 | gl184771 | BLASTN | 1425 | 1e-110 | 98 |
| 1530 | 325 | 700028536H1 | SATMON003 | gl184771 | BLASTN | 1425 | 1e-110 | 100 |
| 1531 | 325 | 700096704H1 | SATMON008 | gl184771 | BLASTN | 1425 | 1e-110 | 100 |
| 1532 | 325 | 700263591H1 | SATMON017 | gl184771 | BLASTN | 1426 | 1e-110 | 99 |
| 1533 | 325 | 700219528H1 | SATMON011 | g22237 | BLASTN | 1426 | 1e-110 | 99 |
| 1534 | 325 | 700094978H1 | SATMON008 | g22237 | BLASTN | 1431 | 1e-110 | 99 |
| 1535 | 325 | 700549520H1 | SATMON022 | g22237 | BLASTN | 1432 | 1e-110 | 99 |
| 1536 | 325 | 700082071H1 | SATMON011 | gl184773 | BLASTN | 1434 | 1e-110 | 99 |
| 1537 | 325 | 700092419H1 | SATMON008 | gl184773 | BLASTN | 1434 | 1e-110 | 93 |
| 1538 | 325 | 700347660H1 | SATMON023 | gl184771 | BLASTN | 1435 | 1e-110 | 100 |
| 1539 | 325 | 700100257H1 | SATMON009 | gl184771 | BLASTN | 1048 | 1e-109 | 96 |
| 1540 | 325 | 700381813H1 | SATMON023 | g22237 | BLASTN | 1090 | 1e-109 | 99 |
| 1541 | 325 | 700095790H1 | SATMON008 | g22237 | BLASTN | 1412 | 1e-109 | 99 |
| 1542 | 325 | 700342267H1 | SATMON021 | gl184773 | BLASTN | 1415 | 1e-109 | 98 |
| 1543 | 325 | 700349135H1 | SATMON023 | gl184771 | BLASTN | 1416 | 1e-109 | 99 |
| 1544 | 325 | 700344742H1 | SATMON021 | g22237 | BLASTN | 1423 | 1e-109 | 98 |
| 1545 | 325 | 700027120H1 | SATMON003 | gl184775 | BLASTN | 777 | 1e-108 | 99 |
| 1546 | 325 | 700029549H1 | SATMON003 | gl184771 | BLASTN | 1178 | 1e-108 | 99 |
| 1547 | 325 | 700051917H1 | SATMON003 | gl184775 | BLASTN | 1349 | 1e-108 | 97 |
| 1548 | 325 | 700053569H1 | SATMON010 | g22237 | BLASTN | 1401 | 1e-108 | 99 |
| 1549 | 325 | 700105941H1 | SATMON010 | g22237 | BLASTN | 1405 | 1e-108 | 100 |
| 1550 | 325 | 700219201H1 | SATMON011 | g22237 | BLASTN | 1406 | 1e-108 | 99 |
| 1551 | 325 | 700050951H1 | SATMON003 | gl184771 | BLASTN | 1406 | 1e-108 | 99 |
| 1552 | 325 | 700258792H1 | SATMON017 | g22237 | BLASTN | 1411 | 1e-108 | 97 |
| 1553 | 325 | 700084946H1 | SATMON011 | g22237 | BLASTN | 793 | 1e-107 | 99 |
| 1554 | 325 | 700571888H1 | SATMON030 | gl184775 | BLASTN | 1146 | 1e-107 | 96 |
| 1555 | 325 | 700029725H1 | SATMON003 | gl184771 | BLASTN | 1390 | 1e-107 | 100 |
| 1556 | 325 | 700802139H1 | SATMON036 | gl184773 | BLASTN | 1391 | 1e-107 | 99 |
| 1557 | 325 | 700030653H1 | SATMON003 | g22237 | BLASTN | 1395 | 1e-107 | 100 |
| 1558 | 325 | 700217462H1 | SATMON016 | gl184771 | BLASTN | 1395 | 1e-107 | 100 |
| 1559 | 325 | 700382314H1 | SATMON024 | gl184773 | BLASTN | 1396 | 1e-107 | 99 |
| 1560 | 325 | 700263059H1 | SATMON017 | g22237 | BLASTN | 1342 | 1e-106 | 98 |
| 1561 | 325 | 700332495H1 | SATMON019 | gl184773 | BLASTN | 1378 | 1e-106 | 98 |
| 1562 | 325 | 700053881H1 | SATMON011 | gl184773 | BLASTN | 1379 | 1e-106 | 97 |
| 1563 | 325 | 700216184H1 | SATMON016 | g22237 | BLASTN | 1385 | 1e-106 | 100 |
| 1564 | 325 | 700442583H1 | SATMON026 | g22237 | BLASTN | 1385 | 1e-106 | 100 |
| 1565 | 325 | 700089492H1 | SATMON011 | gl184771 | BLASTN | 1385 | 1e-106 | 100 |
| 1566 | 325 | 700211930H1 | SATMON016 | gl184773 | BLASTN | 1385 | 1e-106 | 97 |

TABLE A*-continued

| Seq No. | Cluster ID | CloneID | Library | NCBI gi | Method | Score | P-value | % Ident |
|---|---|---|---|---|---|---|---|---|
| 1567 | 325 | 700262445H1 | SATMON017 | g22237 | BLASTN | 1386 | 1e-106 | 99 |
| 1568 | 325 | 700074068H1 | SATMON007 | g1184773 | BLASTN | 1387 | 1e-106 | 98 |
| 1569 | 325 | 700444054H1 | SATMON027 | g1184771 | BLASTN | 1387 | 1e-106 | 98 |
| 1570 | 325 | 700207212H1 | SATMON017 | g1184771 | BLASTN | 700 | 1e-105 | 97 |
| 1571 | 325 | 700349424H1 | SATMON023 | g1184773 | BLASTN | 723 | 1e-105 | 96 |
| 1572 | 325 | 700348215H1 | SATMON023 | g1184773 | BLASTN | 990 | 1e-105 | 96 |
| 1573 | 325 | 700345971H1 | SATMON021 | g1184773 | BLASTN | 1090 | 1e-105 | 98 |
| 1574 | 325 | 700048167H1 | SATMON003 | g1184771 | BLASTN | 1116 | 1e-105 | 98 |
| 1575 | 325 | 700081996H1 | SATMON011 | g1184771 | BLASTN | 1143 | 1e-105 | 96 |
| 1576 | 325 | 700104353H1 | SATMON010 | g1184771 | BLASTN | 1158 | 1e-105 | 96 |
| 1577 | 325 | 700026169H1 | SATMON003 | g1184771 | BLASTN | 1365 | 1e-105 | 100 |
| 1578 | 325 | 700405492H1 | SATMON029 | g1184771 | BLASTN | 1366 | 1e-105 | 99 |
| 1579 | 325 | 700354644H1 | SATMON024 | g1184773 | BLASTN | 1370 | 1e-105 | 100 |
| 1580 | 325 | 700442572H1 | SATMON026 | g1184771 | BLASTN | 1370 | 1e-105 | 100 |
| 1581 | 325 | 700612003H1 | SATMON022 | g22237 | BLASTN | 1370 | 1e-105 | 100 |
| 1582 | 325 | 700082158H1 | SATMON011 | g22237 | BLASTN | 1371 | 1e-105 | 99 |
| 1583 | 325 | 700348605H1 | SATMON023 | g1184771 | BLASTN | 1373 | 1e-105 | 98 |
| 1584 | 325 | 700045650H1 | SATMON004 | g22237 | BLASTN | 1375 | 1e-105 | 100 |
| 1585 | 325 | 700053842H1 | SATMON011 | g1184773 | BLASTN | 1375 | 1e-105 | 98 |
| 1586 | 325 | 700083488H1 | SATMON011 | g1184771 | BLASTN | 1375 | 1e-105 | 100 |
| 1587 | 325 | 700344378H1 | SATMON021 | g1184771 | BLASTN | 1040 | 1e-104 | 99 |
| 1588 | 325 | 700102971H1 | SATMON010 | g1184771 | BLASTN | 1143 | 1e-104 | 96 |
| 1589 | 325 | 700347294H1 | SATMON021 | g1184771 | BLASTN | 1177 | 1e-104 | 99 |
| 1590 | 325 | 700236512H1 | SATMON010 | g1184773 | BLASTN | 1205 | 1e-104 | 99 |
| 1591 | 325 | 700550622H1 | SATMON022 | g1184773 | BLASTN | 1311 | 1e-104 | 98 |
| 1592 | 325 | 700550613H1 | SATMON022 | g1184773 | BLASTN | 1322 | 1e-104 | 99 |
| 1593 | 325 | 700241417H1 | SATMON010 | g1184775 | BLASTN | 1353 | 1e-104 | 99 |
| 1594 | 325 | 700050635H1 | SATMON003 | g1184771 | BLASTN | 1354 | 1e-104 | 93 |
| 1595 | 325 | 700045260H1 | SATMON004 | g1184771 | BLASTN | 1355 | 1e-104 | 100 |
| 1596 | 325 | 700343844H1 | SATMON021 | g1184771 | BLASTN | 1355 | 1e-104 | 100 |
| 1597 | 325 | 700347975H1 | SATMON023 | g22237 | BLASTN | 1357 | 1e-104 | 98 |
| 1598 | 325 | 700345348H1 | SATMON021 | g1184773 | BLASTN | 1360 | 1e-104 | 100 |
| 1599 | 325 | 700345878H1 | SATMON021 | g22237 | BLASTN | 1360 | 1e-104 | 98 |
| 1600 | 325 | 700469928H1 | SATMON025 | g1184771 | BLASTN | 1361 | 1e-104 | 99 |
| 1601 | 325 | 700093631H1 | SATMON008 | g1184773 | BLASTN | 961 | 1e-103 | 99 |
| 1602 | 325 | 700427662H1 | SATMONN01 | g22302 | BLASTN | 1088 | 1e-103 | 99 |
| 1603 | 325 | 700099528H1 | SATMON009 | g1184771 | BLASTN | 1133 | 1e-103 | 96 |
| 1604 | 325 | 700347950H1 | SATMON023 | g1184773 | BLASTN | 1138 | 1e-103 | 98 |
| 1605 | 325 | 700267976H1 | SATMON017 | g1184771 | BLASTN | 1231 | 1e-103 | 96 |
| 1606 | 325 | 700224847H1 | SATMON011 | g22237 | BLASTN | 1255 | 1e-103 | 100 |
| 1607 | 325 | 700465854H1 | SATMON025 | g1184773 | BLASTN | 1294 | 1e-103 | 99 |
| 1608 | 325 | 700257309H1 | SATMON017 | g1184771 | BLASTN | 1302 | 1e-103 | 97 |
| 1609 | 325 | 700577862H1 | SATMON031 | g22237 | BLASTN | 1341 | 1e-103 | 99 |
| 1610 | 325 | 700550007H1 | SATMON022 | g1184773 | BLASTN | 1341 | 1e-103 | 99 |
| 1611 | 325 | 700573448H2 | SATMON030 | g1184771 | BLASTN | 1342 | 1e-103 | 99 |
| 1612 | 325 | 700217477H1 | SATMON016 | g1184771 | BLASTN | 1345 | 1e-103 | 100 |
| 1613 | 325 | 700381851H1 | SATMON023 | g1184771 | BLASTN | 734 | 1e-102 | 92 |
| 1614 | 325 | 700095091H1 | SATMON008 | g1184771 | BLASTN | 1112 | 1e-102 | 97 |
| 1615 | 325 | 700444008H1 | SATMON027 | g1184771 | BLASTN | 1123 | 1e-102 | 98 |
| 1616 | 325 | 700470785H1 | SATMON025 | g22237 | BLASTN | 1142 | 1e-102 | 98 |
| 1617 | 325 | 700551739H1 | SATMON022 | g22237 | BLASTN | 1245 | 1e-102 | 100 |
| 1618 | 325 | 700237938H1 | SATMON010 | g1184771 | BLASTN | 1292 | 1e-102 | 97 |
| 1619 | 325 | 700215507H1 | SATMON016 | g22237 | BLASTN | 1330 | 1e-102 | 98 |
| 1620 | 325 | 700350778H1 | SATMON023 | g1184771 | BLASTN | 1330 | 1e-102 | 98 |
| 1621 | 325 | 700029783H1 | SATMON003 | g22237 | BLASTN | 1330 | 1e-102 | 98 |
| 1622 | 325 | 701161421H1 | SATMONN04 | g1184771 | BLASTN | 1330 | 1e-102 | 100 |
| 1623 | 325 | 700209510H1 | SATMON016 | g22237 | BLASTN | 1331 | 1e-102 | 99 |
| 1624 | 325 | 700552375H1 | SATMON022 | g1184771 | BLASTN | 1332 | 1e-102 | 99 |
| 1625 | 325 | 701183327H1 | SATMONN06 | g1184771 | BLASTN | 1333 | 1e-102 | 98 |
| 1626 | 325 | 700611372H1 | SATMON022 | g22237 | BLASTN | 1335 | 1e-102 | 100 |
| 1627 | 325 | 700243589H1 | SATMON010 | g1184771 | BLASTN | 1335 | 1e-102 | 100 |
| 1628 | 325 | 700805727H1 | SATMON036 | g1184773 | BLASTN | 1339 | 1e-102 | 99 |
| 1629 | 325 | 700051631H1 | SATMON003 | g1184771 | BLASTN | 1339 | 1e-102 | 97 |
| 1630 | 325 | 700465454H1 | SATMON025 | g1184773 | BLASTN | 780 | 1e-101 | 100 |
| 1631 | 325 | 700348239H1 | SATMON023 | g1184773 | BLASTN | 989 | 1e-101 | 98 |
| 1632 | 325 | 700353680H1 | SATMON024 | g1184773 | BLASTN | 1171 | 1e-101 | 99 |
| 1633 | 325 | 700265106H1 | SATMON017 | g1184773 | BLASTN | 1292 | 1e-101 | 95 |
| 1634 | 325 | 700053220H1 | SATMON008 | g1184775 | BLASTN | 1317 | 1e-101 | 99 |
| 1635 | 325 | 700052903H1 | SATMON007 | g1184771 | BLASTN | 1317 | 1e-101 | 99 |
| 1636 | 325 | 700053069H1 | SATMON007 | g1184773 | BLASTN | 1319 | 1e-101 | 97 |
| 1637 | 325 | 700352222H1 | SATMON023 | g1184773 | BLASTN | 1322 | 1e-101 | 94 |
| 1638 | 325 | 700458334H1 | SATMON029 | g1184773 | BLASTN | 1323 | 1e-101 | 99 |
| 1639 | 325 | 700072219H1 | SATMON007 | g1184773 | BLASTN | 1323 | 1e-101 | 97 |
| 1640 | 325 | 700082679H1 | SATMON011 | g22237 | BLASTN | 1326 | 1e-101 | 99 |
| 1641 | 325 | 700219959H1 | SATMON011 | g1184775 | BLASTN | 1327 | 1e-101 | 99 |
| 1642 | 325 | 700216192H1 | SATMON016 | g1184771 | BLASTN | 1327 | 1e-101 | 99 |
| 1643 | 325 | 700453649H1 | SATMON028 | g1184771 | BLASTN | 1328 | 1e-101 | 99 |

TABLE A*-continued

| Seq No. | Cluster ID | CloneID | Library | NCBI gi | Method | Score | P-value | % Ident |
|---|---|---|---|---|---|---|---|---|
| 1644 | 325 | 700611371H1 | SATMON022 | g22237 | BLASTN | 1328 | 1e-101 | 99 |
| 1645 | 325 | 700261174H1 | SATMON017 | g1184771 | BLASTN | 706 | 1e-100 | 95 |
| 1646 | 325 | 700378143H1 | SATMON019 | g1184771 | BLASTN | 1032 | 1e-100 | 95 |
| 1647 | 325 | 700345693H1 | SATMON021 | g1184773 | BLASTN | 1108 | 1e-100 | 98 |
| 1648 | 325 | 700075095H1 | SATMON007 | g1184773 | BLASTN | 1113 | 1e-100 | 99 |
| 1649 | 325 | 700549026H1 | SATMON022 | g1184771 | BLASTN | 1187 | 1e-100 | 98 |
| 1650 | 325 | 700333933H1 | SATMON019 | g22237 | BLASTN | 1228 | 1e-100 | 99 |
| 1651 | 325 | 700027389H1 | SATMON003 | g1184773 | BLASTN | 1305 | 1e-100 | 98 |
| 1652 | 325 | 700798802H1 | SATMON036 | g1184773 | BLASTN | 1306 | 1e-100 | 99 |
| 1653 | 325 | 700045878H1 | SATMON004 | g22237 | BLASTN | 1310 | 1e-100 | 98 |
| 1654 | 325 | 700087030H1 | SATMON011 | g1184773 | BLASTN | 1311 | 1e-100 | 94 |
| 1655 | 325 | 700221038H1 | SATMON011 | g1184771 | BLASTN | 1311 | 1e-100 | 99 |
| 1656 | 325 | 700333822H1 | SATMON019 | g1184771 | BLASTN | 1311 | 1e-100 | 93 |
| 1657 | 325 | 700085206H1 | SATMON011 | g1184773 | BLASTN | 1311 | 1e-100 | 99 |
| 1658 | 325 | 700161303H1 | SATMON012 | g1184775 | BLASTN | 1313 | 1e-100 | 98 |
| 1659 | 325 | 700087502H1 | SATMON011 | g1184771 | BLASTN | 1313 | 1e-100 | 98 |
| 1660 | 325 | 700105477H1 | SATMON010 | g1184773 | BLASTN | 1314 | 1e-100 | 99 |
| 1661 | 325 | 700441823H1 | SATMON026 | g1184771 | BLASTN | 1315 | 1e-100 | 100 |
| 1662 | 325 | 700196854H1 | SATMON014 | g1184771 | BLASTN | 1315 | 1e-100 | 100 |
| 1663 | 325 | 700457283H1 | SATMON029 | g1184771 | BLASTN | 1315 | 1e-100 | 100 |
| 1664 | 325 | 700223356H1 | SATMON011 | g1184773 | BLASTN | 1316 | 1e-100 | 99 |
| 1665 | 325 | 700550323H1 | SATMON022 | g1184771 | BLASTN | 1316 | 1e-100 | 99 |
| 1666 | 325 | 700212296H1 | SATMON016 | g1184771 | BLASTN | 895 | 1e-99 | 100 |
| 1667 | 325 | 700073907H1 | SATMON007 | g1184771 | BLASTN | 1154 | 1e-99 | 95 |
| 1668 | 325 | 700550683H1 | SATMON022 | g1184771 | BLASTN | 1266 | 1e-99 | 99 |
| 1669 | 325 | 700041553H1 | SATMON004 | g22302 | BLASTN | 1286 | 1e-99 | 97 |
| 1670 | 325 | 700197418H1 | SATMON014 | g1184775 | BLASTN | 1292 | 1e-99 | 99 |
| 1671 | 325 | 700083704H1 | SATMON011 | g22237 | BLASTN | 1293 | 1e-99 | 98 |
| 1672 | 325 | 700218362H1 | SATMON016 | g1184771 | BLASTN | 1295 | 1e-99 | 100 |
| 1673 | 325 | 700082314H1 | SATMON011 | g1184773 | BLASTN | 1295 | 1e-99 | 93 |
| 1674 | 325 | 700045668H1 | SATMON004 | g1184771 | BLASTN | 1297 | 1e-99 | 99 |
| 1675 | 325 | 700158619H1 | SATMON012 | g1184771 | BLASTN | 1297 | 1e-99 | 98 |
| 1676 | 325 | 700611967H1 | SATMON022 | g1184773 | BLASTN | 1298 | 1e-99 | 99 |
| 1677 | 325 | 700336112H1 | SATMON019 | g22237 | BLASTN | 1299 | 1e-99 | 98 |
| 1678 | 325 | 700444055H1 | SATMON027 | g1184771 | BLASTN | 1300 | 1e-99 | 100 |
| 1679 | 325 | 700236678H1 | SATMON010 | g1184771 | BLASTN | 1300 | 1e-99 | 100 |
| 1680 | 325 | 700214048H1 | SATMON016 | g1184773 | BLASTN | 1303 | 1e-99 | 99 |
| 1681 | 325 | 700351262H1 | SATMON023 | g1184773 | BLASTN | 1304 | 1e-99 | 94 |
| 1682 | 325 | 700583372H1 | SATMON031 | g1184771 | BLASTN | 632 | 1e-98 | 95 |
| 1683 | 325 | 700339709H1 | SATMON020 | g22237 | BLASTN | 852 | 1e-98 | 94 |
| 1684 | 325 | 700211842H1 | SATMON016 | g22237 | BLASTN | 920 | 1e-98 | 94 |
| 1685 | 325 | 700355436H1 | SATMON024 | g1184771 | BLASTN | 953 | 1e-98 | 98 |
| 1686 | 325 | 700221763H1 | SATMON011 | g22237 | BLASTN | 1011 | 1e-98 | 99 |
| 1687 | 325 | 700619245H1 | SATMON034 | g1184771 | BLASTN | 1012 | 1e-98 | 95 |
| 1688 | 325 | 700262781H1 | SATMON017 | g1184771 | BLASTN | 1016 | 1e-98 | 98 |
| 1689 | 325 | 700243153H1 | SATMON010 | g22237 | BLASTN | 1065 | 1e-98 | 100 |
| 1690 | 325 | 700344173H1 | SATMON021 | g1184771 | BLASTN | 1137 | 1e-98 | 97 |
| 1691 | 325 | 700349565H1 | SATMON023 | g1184771 | BLASTN | 1145 | 1e-98 | 96 |
| 1692 | 325 | 700157320H1 | SATMON012 | g1184773 | BLASTN | 1281 | 1e-98 | 99 |
| 1693 | 325 | 700611471H1 | SATMON022 | g22237 | BLASTN | 1282 | 1e-98 | 98 |
| 1694 | 325 | 700550503H1 | SATMON022 | g1184771 | BLASTN | 1283 | 1e-98 | 99 |
| 1695 | 325 | 700222893H1 | SATMON011 | g22237 | BLASTN | 1285 | 1e-98 | 100 |
| 1696 | 325 | 700242404H1 | SATMON010 | g1184771 | BLASTN | 1285 | 1e-98 | 100 |
| 1697 | 325 | 700218820H1 | SATMON011 | g1184771 | BLASTN | 1285 | 1e-98 | 100 |
| 1698 | 325 | 700220021H1 | SATMON011 | g22237 | BLASTN | 1286 | 1e-98 | 99 |
| 1699 | 325 | 700243542H1 | SATMON010 | g1184773 | BLASTN | 1286 | 1e-98 | 99 |
| 1700 | 325 | 700354379H1 | SATMON024 | g1184771 | BLASTN | 1288 | 1e-98 | 93 |
| 1701 | 325 | 700799328H1 | SATMON036 | g1184773 | BLASTN | 1289 | 1e-98 | 99 |
| 1702 | 325 | 700452454H1 | SATMON028 | g1184771 | BLASTN | 1290 | 1e-98 | 100 |
| 1703 | 325 | 700085246H1 | SATMON011 | g1184771 | BLASTN | 1290 | 1e-98 | 100 |
| 1704 | 325 | 700218590H1 | SATMON011 | g1184771 | BLASTN | 1290 | 1e-98 | 100 |
| 1705 | 325 | 700456377H1 | SATMON029 | g1184771 | BLASTN | 1291 | 1e-98 | 99 |
| 1706 | 325 | 700050750H1 | SATMON003 | g1185553 | BLASTN | 559 | 1e-97 | 99 |
| 1707 | 325 | 700351952H1 | SATMON023 | g1184771 | BLASTN | 797 | 1e-97 | 97 |
| 1708 | 325 | 700345594H1 | SATMON021 | g1184773 | BLASTN | 851 | 1e-97 | 99 |
| 1709 | 325 | 700267853H1 | SATMON017 | g1184771 | BLASTN | 890 | 1e-97 | 94 |
| 1710 | 325 | 700350105H1 | SATMON023 | g1184773 | BLASTN | 1006 | 1e-97 | 99 |
| 1711 | 325 | 700334557H1 | SATMON019 | g1184773 | BLASTN | 1028 | 1e-97 | 95 |
| 1712 | 325 | 700457542H1 | SATMON029 | g1184773 | BLASTN | 1067 | 1e-97 | 99 |
| 1713 | 325 | 700352772H1 | SATMON024 | g22237 | BLASTN | 1181 | 1e-97 | 98 |
| 1714 | 325 | 700550657H1 | SATMON022 | g22237 | BLASTN | 1226 | 1e-97 | 99 |
| 1715 | 325 | 700224772H1 | SATMON011 | g1184771 | BLASTN | 1270 | 1e-97 | 100 |
| 1716 | 325 | 700618874H1 | SATMON034 | g1184775 | BLASTN | 1270 | 1e-97 | 100 |
| 1717 | 325 | 700162968H1 | SATMON013 | g22237 | BLASTN | 1270 | 1e-97 | 100 |
| 1718 | 325 | 700025839H1 | SATMON003 | g1184775 | BLASTN | 1270 | 1e-97 | 100 |
| 1719 | 325 | 700075210H1 | SATMON007 | g1184773 | BLASTN | 1272 | 1e-97 | 93 |
| 1720 | 325 | 700025602H1 | SATMON004 | g22237 | BLASTN | 1275 | 1e-97 | 98 |

TABLE A*-continued

| Seq No. | Cluster ID | CloneID | Library | NCBI gi | Method | Score | P-value | % Ident |
|---|---|---|---|---|---|---|---|---|
| 1721 | 325 | 700573453H2 | SATMON030 | g1184771 | BLASTN | 1276 | 1e−97 | 99 |
| 1722 | 325 | 700268153H1 | SATMON017 | g1184773 | BLASTN | 1277 | 1e−97 | 94 |
| 1723 | 325 | 700085062H1 | SATMON011 | g1184773 | BLASTN | 1279 | 1e−97 | 99 |
| 1724 | 325 | 700197210H1 | SATMON014 | g1184773 | BLASTN | 1280 | 1e−97 | 98 |
| 1725 | 325 | 700053187H1 | SATMON008 | g22237 | BLASTN | 1280 | 1e−97 | 100 |
| 1726 | 325 | 700239541H1 | SATMON010 | g1184771 | BLASTN | 1280 | 1e−97 | 100 |
| 1727 | 325 | 700381789H1 | SATMON023 | g1184773 | BLASTN | 1280 | 1e−97 | 93 |
| 1728 | 325 | 700382074H1 | SATMON024 | g1184773 | BLASTN | 737 | 1e−96 | 93 |
| 1729 | 325 | 700615886H1 | SATMON033 | g1184771 | BLASTN | 814 | 1e−96 | 96 |
| 1730 | 325 | 700203271H1 | SATMON003 | g1184771 | BLASTN | 1047 | 1e−96 | 96 |
| 1731 | 325 | 700090047H1 | SATMON011 | g1184771 | BLASTN | 1047 | 1e−96 | 96 |
| 1732 | 325 | 700345983H1 | SATMON021 | g1184771 | BLASTN | 1048 | 1e−96 | 96 |
| 1733 | 325 | 700580224H1 | SATMON031 | g1184771 | BLASTN | 1060 | 1e−96 | 94 |
| 1734 | 325 | 700163304H1 | SATMON013 | g1184771 | BLASTN | 1260 | 1e−96 | 100 |
| 1735 | 325 | 700218377H1 | SATMON016 | g1184771 | BLASTN | 1260 | 1e−96 | 100 |
| 1736 | 325 | 700090628H1 | SATMON011 | g22237 | BLASTN | 1262 | 1e−96 | 98 |
| 1737 | 325 | 700205936H1 | SATMON003 | g1184773 | BLASTN | 1265 | 1e−96 | 91 |
| 1738 | 325 | 700087928H1 | SATMON011 | g22237 | BLASTN | 1265 | 1e−96 | 100 |
| 1739 | 325 | 700195069H1 | SATMON014 | g1184775 | BLASTN | 1266 | 1e−96 | 98 |
| 1740 | 325 | 700552795H1 | SATMON022 | g1184773 | BLASTN | 658 | 1e−95 | 94 |
| 1741 | 325 | 700093666H1 | SATMON008 | g22237 | BLASTN | 873 | 1e−95 | 96 |
| 1742 | 325 | 700196963H1 | SATMON014 | g1184773 | BLASTN | 957 | 1e−95 | 98 |
| 1743 | 325 | 700083992H1 | SATMON011 | g1184773 | BLASTN | 1034 | 1e−95 | 96 |
| 1744 | 325 | 700334351H1 | SATMON019 | g1184773 | BLASTN | 1162 | 1e−95 | 96 |
| 1745 | 325 | 700165979H1 | SATMON013 | g22237 | BLASTN | 1211 | 1e−95 | 98 |
| 1746 | 325 | 700612175H1 | SATMON022 | g1184773 | BLASTN | 1245 | 1e−95 | 100 |
| 1747 | 325 | 700157886H1 | SATMON012 | g1184771 | BLASTN | 1245 | 1e−95 | 100 |
| 1748 | 325 | 700218843H1 | SATMON011 | g22237 | BLASTN | 1246 | 1e−95 | 99 |
| 1749 | 325 | 700223241H1 | SATMON011 | g22237 | BLASTN | 1253 | 1e−95 | 99 |
| 1750 | 325 | 700382157H1 | SATMON024 | g1184773 | BLASTN | 1254 | 1e−95 | 93 |
| 1751 | 325 | 700163655H1 | SATMON013 | g22237 | BLASTN | 1255 | 1e−95 | 100 |
| 1752 | 325 | 700219734H1 | SATMON011 | g1184773 | BLASTN | 1256 | 1e−95 | 99 |
| 1753 | 325 | 700258401H1 | SATMON017 | g22237 | BLASTN | 744 | 1e−94 | 91 |
| 1754 | 325 | 700569409H2 | SATMON030 | g1184771 | BLASTN | 755 | 1e−94 | 100 |
| 1755 | 325 | 700449985H1 | SATMON028 | g22237 | BLASTN | 1041 | 1e−94 | 99 |
| 1756 | 325 | 700209417H1 | SATMON016 | g22237 | BLASTN | 1192 | 1e−94 | 96 |
| 1757 | 325 | 700218233H1 | SATMON016 | g1184773 | BLASTN | 1235 | 1e−94 | 98 |
| 1758 | 325 | 700023172H1 | SATMON003 | g1184773 | BLASTN | 1241 | 1e−94 | 99 |
| 1759 | 325 | 700165002H1 | SATMON013 | g1184771 | BLASTN | 1242 | 1e−94 | 99 |
| 1760 | 325 | 700240575H1 | SATMON010 | g1184771 | BLASTN | 1243 | 1e−94 | 98 |
| 1761 | 325 | 700193127H1 | SATMON014 | g1184775 | BLASTN | 1243 | 1e−94 | 98 |
| 1762 | 325 | 700202138H1 | SATMON003 | g1184771 | BLASTN | 635 | 1e−93 | 94 |
| 1763 | 325 | 700619314H1 | SATMON034 | g1184771 | BLASTN | 697 | 1e−93 | 93 |
| 1764 | 325 | 700611272H1 | SATMON022 | g22237 | BLASTN | 743 | 1e−93 | 97 |
| 1765 | 325 | 700235577H1 | SATMON010 | g1184771 | BLASTN | 810 | 1e−93 | 98 |
| 1766 | 325 | 700048739H1 | SATMON003 | g1184771 | BLASTN | 1012 | 1e−93 | 97 |
| 1767 | 325 | 700337602H1 | SATMON020 | g22237 | BLASTN | 1097 | 1e−93 | 97 |
| 1768 | 325 | 700457423H1 | SATMON029 | g22237 | BLASTN | 1138 | 1e−93 | 98 |
| 1769 | 325 | 700048682H1 | SATMON003 | g1184773 | BLASTN | 1154 | 1e−93 | 92 |
| 1770 | 325 | 700456449H1 | SATMON029 | g1184773 | BLASTN | 1221 | 1e−93 | 94 |
| 1771 | 325 | 700239518H1 | SATMON010 | g1184771 | BLASTN | 1228 | 1e−93 | 98 |
| 1772 | 325 | 700457982H1 | SATMON029 | g22237 | BLASTN | 1229 | 1e−93 | 96 |
| 1773 | 325 | 700103576H1 | SATMON010 | g1184771 | BLASTN | 1230 | 1e−93 | 98 |
| 1774 | 325 | 700454265H1 | SATMON029 | g1184771 | BLASTN | 555 | 1e−92 | 96 |
| 1775 | 325 | 700340854H1 | SATMON020 | g22237 | BLASTN | 580 | 1e−92 | 97 |
| 1776 | 325 | 700458888H1 | SATMON029 | g1184771 | BLASTN | 769 | 1e−92 | 98 |
| 1777 | 325 | 700581403H1 | SATMON031 | g1184771 | BLASTN | 775 | 1e−92 | 96 |
| 1778 | 325 | 700224722H1 | SATMON011 | g22237 | BLASTN | 979 | 1e−92 | 94 |
| 1779 | 325 | 700217644H1 | SATMON016 | g1184771 | BLASTN | 1072 | 1e−92 | 96 |
| 1780 | 325 | 700454195H1 | SATMON029 | g22237 | BLASTN | 1084 | 1e−92 | 96 |
| 1781 | 325 | 700215504H1 | SATMON016 | g1184775 | BLASTN | 1122 | 1e−92 | 96 |
| 1782 | 325 | 700214190H1 | SATMON016 | g1184771 | BLASTN | 1210 | 1e−92 | 100 |
| 1783 | 325 | 700456941H1 | SATMON029 | g1184771 | BLASTN | 1211 | 1e−92 | 94 |
| 1784 | 325 | 700193816H1 | SATMON014 | g1184775 | BLASTN | 1212 | 1e−92 | 99 |
| 1785 | 325 | 700241930H1 | SATMON010 | g1184771 | BLASTN | 1213 | 1e−92 | 98 |
| 1786 | 325 | 700160162H1 | SATMON012 | g1184775 | BLASTN | 1215 | 1e−92 | 98 |
| 1787 | 325 | 700171289H1 | SATMON013 | g22237 | BLASTN | 1220 | 1e−92 | 100 |
| 1788 | 325 | 700549474H1 | SATMON022 | g1184773 | BLASTN | 665 | 1e−91 | 100 |
| 1789 | 325 | 700422573H1 | SATMONN01 | g22237 | BLASTN | 715 | 1e−91 | 92 |
| 1790 | 325 | 700377664H1 | SATMON019 | g1184771 | BLASTN | 747 | 1e−91 | 94 |
| 1791 | 325 | 700193034H1 | SATMON014 | g1184775 | BLASTN | 881 | 1e−91 | 99 |
| 1792 | 325 | 700163652H1 | SATMON013 | g1184771 | BLASTN | 990 | 1e−91 | 100 |
| 1793 | 325 | 700212649H1 | SATMON016 | g22237 | BLASTN | 1159 | 1e−91 | 99 |
| 1794 | 325 | 700165066H1 | SATMON013 | g1184771 | BLASTN | 1201 | 1e−91 | 99 |
| 1795 | 325 | 700152004H1 | SATMON007 | g1184773 | BLASTN | 1202 | 1e−91 | 99 |
| 1796 | 325 | 700243428H1 | SATMON010 | g1184773 | BLASTN | 1203 | 1e−91 | 99 |
| 1797 | 325 | 700167249H1 | SATMON013 | g1184771 | BLASTN | 1206 | 1e−91 | 99 |

TABLE A*-continued

| Seq No. | Cluster ID | CloneID | Library | NCBI gi | Method | Score | P-value | % Ident |
|---|---|---|---|---|---|---|---|---|
| 1798 | 325 | 700150450H1 | SATMON007 | g1184773 | BLASTN | 1206 | 1e-91 | 99 |
| 1799 | 325 | 700089949H1 | SATMON011 | g1184771 | BLASTN | 599 | 1e-90 | 83 |
| 1800 | 325 | 700443495H1 | SATMON027 | g1184771 | BLASTN | 617 | 1e-90 | 97 |
| 1801 | 325 | 700469283H1 | SATMON025 | g1184771 | BLASTN | 672 | 1e-90 | 98 |
| 1802 | 325 | 700072276H1 | SATMON007 | g1184771 | BLASTN | 916 | 1e-90 | 96 |
| 1803 | 325 | 700457552H1 | SATMON029 | g1184771 | BLASTN | 953 | 1e-90 | 96 |
| 1804 | 325 | 700351671H1 | SATMON023 | g1184771 | BLASTN | 984 | 1e-90 | 99 |
| 1805 | 325 | 700571583H1 | SATMON030 | g22237 | BLASTN | 1059 | 1e-90 | 94 |
| 1806 | 325 | 700803969H1 | SATMON036 | g1184773 | BLASTN | 1186 | 1e-90 | 93 |
| 1807 | 325 | 700150936H1 | SATMON007 | g1184771 | BLASTN | 1196 | 1e-90 | 94 |
| 1808 | 325 | 700570929H1 | SATMON030 | g1184773 | BLASTN | 495 | 1e-89 | 100 |
| 1809 | 325 | 700338407H1 | SATMON020 | g1184773 | BLASTN | 1065 | 1e-89 | 95 |
| 1810 | 325 | 700021640H1 | SATMON001 | g1184771 | BLASTN | 1173 | 1e-89 | 99 |
| 1811 | 325 | 700151914H1 | SATMON007 | g1184773 | BLASTN | 1175 | 1e-89 | 100 |
| 1812 | 325 | 700167480H1 | SATMON013 | g22237 | BLASTN | 1176 | 1e-89 | 98 |
| 1813 | 325 | 700236453H1 | SATMON010 | g1184771 | BLASTN | 1178 | 1e-89 | 98 |
| 1814 | 325 | 700238168H1 | SATMON010 | g1184771 | BLASTN | 1182 | 1e-89 | 99 |
| 1815 | 325 | 700613413H1 | SATMON033 | g1184771 | BLASTN | 484 | 1e-88 | 91 |
| 1816 | 325 | 700357450H1 | SATMON024 | g1184773 | BLASTN | 527 | 1e-88 | 98 |
| 1817 | 325 | 700450090H2 | SATMON028 | g1184771 | BLASTN | 684 | 1e-88 | 93 |
| 1818 | 325 | 700801459H1 | SATMON036 | g1184773 | BLASTN | 850 | 1e-88 | 99 |
| 1819 | 325 | 700457313H1 | SATMON029 | g22237 | BLASTN | 855 | 1e-88 | 100 |
| 1820 | 325 | 700382823H1 | SATMON024 | g1184773 | BLASTN | 875 | 1e-88 | 96 |
| 1821 | 325 | 700085440H1 | SATMON011 | g1184771 | BLASTN | 951 | 1e-88 | 97 |
| 1822 | 325 | 700216971H1 | SATMON016 | g1184771 | BLASTN | 951 | 1e-88 | 97 |
| 1823 | 325 | 700239980H1 | SATMON010 | g1184771 | BLASTN | 1123 | 1e-88 | 98 |
| 1824 | 325 | 700801083H1 | SATMON036 | g1184773 | BLASTN | 1162 | 1e-88 | 93 |
| 1825 | 325 | 700202393H1 | SATMON003 | g1184775 | BLASTN | 1166 | 1e-88 | 98 |
| 1826 | 325 | 700105153H1 | SATMON010 | g1184771 | BLASTN | 1169 | 1e-88 | 99 |
| 1827 | 325 | 700087788H1 | SATMON011 | g1184771 | BLASTN | 1169 | 1e-88 | 96 |
| 1828 | 325 | 700152166H1 | SATMON007 | g22237 | BLASTN | 1171 | 1e-88 | 99 |
| 1829 | 325 | 700332968H1 | SATMON019 | g22237 | BLASTN | 437 | 1e-87 | 93 |
| 1830 | 325 | 700204350H1 | SATMON003 | g1184771 | BLASTN | 441 | 1e-87 | 96 |
| 1831 | 325 | 700150168H1 | SATMON007 | g1184773 | BLASTN | 901 | 1e-87 | 98 |
| 1832 | 325 | 700449984H1 | SATMON028 | g22237 | BLASTN | 907 | 1e-87 | 94 |
| 1833 | 325 | 700156642H1 | SATMON012 | g1184773 | BLASTN | 1149 | 1e-87 | 98 |
| 1834 | 325 | 700152779H1 | SATMON007 | g1184773 | BLASTN | 1150 | 1e-87 | 100 |
| 1835 | 325 | 700160261H1 | SATMON012 | g1184775 | BLASTN | 1151 | 1e-87 | 99 |
| 1836 | 325 | 700804718H1 | SATMON036 | g1184775 | BLASTN | 1153 | 1e-87 | 97 |
| 1837 | 325 | 700356233H1 | SATMON024 | g1184775 | BLASTN | 1156 | 1e-87 | 99 |
| 1838 | 325 | 700043272H1 | SATMON004 | g1184771 | BLASTN | 1160 | 1e-87 | 92 |
| 1839 | 325 | 700456666H1 | SATMON029 | g1184771 | BLASTN | 519 | 1e-86 | 94 |
| 1840 | 325 | 700205926H1 | SATMON003 | g1184771 | BLASTN | 587 | 1e-86 | 98 |
| 1841 | 325 | 700454102H1 | SATMON029 | g1184771 | BLASTN | 670 | 1e-86 | 94 |
| 1842 | 325 | 700207045H1 | SATMON003 | g1184771 | BLASTN | 935 | 1e-86 | 95 |
| 1843 | 325 | 700377244H1 | SATMON019 | g1184771 | BLASTN | 985 | 1e-86 | 99 |
| 1844 | 325 | 700549440H1 | SATMON022 | g1184773 | BLASTN | 990 | 1e-86 | 100 |
| 1845 | 325 | 700166882H1 | SATMON013 | g22237 | BLASTN | 1141 | 1e-86 | 97 |
| 1846 | 325 | 700167140H1 | SATMON013 | g1184771 | BLASTN | 1143 | 1e-86 | 97 |
| 1847 | 325 | 700152640H1 | SATMON007 | g1184773 | BLASTN | 1145 | 1e-86 | 100 |
| 1848 | 325 | 700020603H1 | SATMON001 | g22237 | BLASTN | 1146 | 1e-86 | 99 |
| 1849 | 325 | 700152109H1 | SATMON007 | g1184773 | BLASTN | 1147 | 1e-86 | 99 |
| 1850 | 325 | 700442690H1 | SATMON026 | g1184771 | BLASTN | 635 | 1e-85 | 95 |
| 1851 | 325 | 700156713H1 | SATMON012 | g1184775 | BLASTN | 705 | 1e-85 | 100 |
| 1852 | 325 | 700239313H1 | SATMON010 | g1184771 | BLASTN | 907 | 1e-85 | 92 |
| 1853 | 325 | 700102871H1 | SATMON010 | g1184771 | BLASTN | 916 | 1e-85 | 96 |
| 1854 | 325 | 700224872H1 | SATMON011 | g1184771 | BLASTN | 916 | 1e-85 | 96 |
| 1855 | 325 | 700448596H1 | SATMON028 | g1184771 | BLASTN | 951 | 1e-85 | 95 |
| 1856 | 325 | 700218841H1 | SATMON011 | g1184771 | BLASTN | 998 | 1e-85 | 93 |
| 1857 | 325 | 700258654H1 | SATMON017 | g1184771 | BLASTN | 1090 | 1e-85 | 97 |
| 1858 | 325 | 700798771H1 | SATMON036 | g1184771 | BLASTN | 1125 | 1e-85 | 100 |
| 1859 | 325 | 700152891H1 | SATMON007 | g22237 | BLASTN | 1126 | 1e-85 | 99 |
| 1860 | 325 | 700805450H1 | SATMON036 | g1184773 | BLASTN | 1130 | 1e-85 | 94 |
| 1861 | 325 | 700152783H1 | SATMON007 | g22237 | BLASTN | 1131 | 1e-85 | 99 |
| 1862 | 325 | 700085765H1 | SATMON011 | g1184771 | BLASTN | 1135 | 1e-85 | 100 |
| 1863 | 325 | 700263179H1 | SATMON017 | g22237 | BLASTN | 827 | 1e-84 | 99 |
| 1864 | 325 | 700163973H1 | SATMON013 | g22237 | BLASTN | 1113 | 1e-84 | 97 |
| 1865 | 325 | 700152630H1 | SATMON007 | g1184773 | BLASTN | 1115 | 1e-84 | 100 |
| 1866 | 325 | 700152546H1 | SATMON007 | g22237 | BLASTN | 1116 | 1e-84 | 99 |
| 1867 | 325 | 700217728H1 | SATMON016 | g1184773 | BLASTN | 1118 | 1e-84 | 99 |
| 1868 | 325 | 700336157H1 | SATMON019 | g1184773 | BLASTN | 1119 | 1e-84 | 91 |
| 1869 | 325 | 700332651H1 | SATMON019 | g1184775 | BLASTN | 908 | 1e-83 | 96 |
| 1870 | 325 | 700348702H1 | SATMON023 | g1184771 | BLASTN | 963 | 1e-83 | 87 |
| 1871 | 325 | 700611336H1 | SATMON022 | g22237 | BLASTN | 1042 | 1e-83 | 90 |
| 1872 | 325 | 700151934H1 | SATMON007 | g1184773 | BLASTN | 1105 | 1e-83 | 100 |
| 1873 | 325 | 700150270H1 | SATMON007 | g1184773 | BLASTN | 1106 | 1e-83 | 99 |
| 1874 | 325 | 700021115H1 | SATMON001 | g1184771 | BLASTN | 1111 | 1e-83 | 97 |

TABLE A*-continued

| Seq No. | Cluster ID | CloneID | Library | NCBI gi | Method | Score | P-value | % Ident |
|---|---|---|---|---|---|---|---|---|
| 1875 | 325 | 700213761H1 | SATMON016 | g1184773 | BLASTN | 1111 | 1e−83 | 97 |
| 1876 | 325 | 700083759H1 | SATMON011 | g1184773 | BLASTN | 596 | 1e−82 | 93 |
| 1877 | 325 | 700263853H1 | SATMON017 | g1184771 | BLASTN | 883 | 1e−82 | 95 |
| 1878 | 325 | 700347719H1 | SATMON023 | g1184775 | BLASTN | 996 | 1e−82 | 96 |
| 1879 | 325 | 700048938H1 | SATMON003 | g1184775 | BLASTN | 1014 | 1e−82 | 97 |
| 1880 | 325 | 700150141H1 | SATMON007 | g1184771 | BLASTN | 1095 | 1e−82 | 100 |
| 1881 | 325 | 700019545H1 | SATMON001 | g1184773 | BLASTN | 1095 | 1e−82 | 100 |
| 1882 | 325 | 700019463H1 | SATMON001 | g1184773 | BLASTN | 1096 | 1e−82 | 97 |
| 1883 | 325 | 700455246H1 | SATMON029 | g1184771 | BLASTN | 1100 | 1e−82 | 92 |
| 1884 | 325 | 700382892H1 | SATMON024 | g1184773 | BLASTN | 613 | 1e−81 | 89 |
| 1885 | 325 | 700346309H1 | SATMON021 | g1184771 | BLASTN | 858 | 1e−81 | 92 |
| 1886 | 325 | 700257372H1 | SATMON017 | g1184771 | BLASTN | 903 | 1e−81 | 94 |
| 1887 | 325 | 700802008H1 | SATMON036 | g1184775 | BLASTN | 969 | 1e−81 | 97 |
| 1888 | 325 | 700083602H1 | SATMON011 | g22237 | BLASTN | 1081 | 1e−81 | 96 |
| 1889 | 325 | 700266939H1 | SATMON017 | g22237 | BLASTN | 1083 | 1e−81 | 98 |
| 1890 | 325 | 700431491H1 | SATMONN01 | g22237 | BLASTN | 1084 | 1e−81 | 87 |
| 1891 | 325 | 700611180H1 | SATMON022 | g22237 | BLASTN | 481 | 1e−80 | 91 |
| 1892 | 325 | 700348016H1 | SATMON023 | g1184773 | BLASTN | 611 | 1e−80 | 89 |
| 1893 | 325 | 700577294H1 | SATMON031 | g1184771 | BLASTN | 809 | 1e−80 | 92 |
| 1894 | 325 | 700457970H1 | SATMON029 | g1184771 | BLASTN | 934 | 1e−80 | 96 |
| 1895 | 325 | 700239677H1 | SATMON010 | g1184773 | BLASTN | 1066 | 1e−80 | 93 |
| 1896 | 325 | 700242889H1 | SATMON010 | g1184773 | BLASTN | 1066 | 1e−80 | 99 |
| 1897 | 325 | 700016313H1 | SATMON001 | g22237 | BLASTN | 1072 | 1e−80 | 99 |
| 1898 | 325 | 700155241H1 | SATMON007 | g1184771 | BLASTN | 1076 | 1e−80 | 99 |
| 1899 | 325 | 700223882H1 | SATMON011 | g1184771 | BLASTN | 696 | 1e−79 | 90 |
| 1900 | 325 | 700047915H1 | SATMON003 | g1184771 | BLASTN | 724 | 1e−79 | 98 |
| 1901 | 325 | 700449818H2 | SATMON028 | g1184771 | BLASTN | 761 | 1e−79 | 91 |
| 1902 | 325 | 700804993H1 | SATMON036 | g1184773 | BLASTN | 827 | 1e−79 | 98 |
| 1903 | 325 | 700570972H1 | SATMON030 | g1184773 | BLASTN | 867 | 1e−79 | 97 |
| 1904 | 325 | 700016664H1 | SATMON001 | g1185553 | BLASTN | 885 | 1e−79 | 100 |
| 1905 | 325 | 700213557H1 | SATMON016 | g1184773 | BLASTN | 908 | 1e−79 | 92 |
| 1906 | 325 | 700613214H1 | SATMON033 | g1184771 | BLASTN | 997 | 1e−79 | 88 |
| 1907 | 325 | 700343710H1 | SATMON021 | g1184773 | BLASTN | 1055 | 1e−79 | 88 |
| 1908 | 325 | 700442421H1 | SATMON026 | g22237 | BLASTN | 501 | 1e−78 | 96 |
| 1909 | 325 | 700265008H1 | SATMON017 | g1184773 | BLASTN | 866 | 1e−78 | 98 |
| 1910 | 325 | 700218525H1 | SATMON011 | g1184771 | BLASTN | 899 | 1e−78 | 96 |
| 1911 | 325 | 700551922H1 | SATMON022 | g22237 | BLASTN | 1045 | 1e−78 | 97 |
| 1912 | 325 | 700017612H1 | SATMON001 | g22237 | BLASTN | 1047 | 1e−78 | 96 |
| 1913 | 325 | 700579349H1 | SATMON031 | g22237 | BLASTN | 791 | 1e−77 | 87 |
| 1914 | 325 | 700197914H1 | SATMON016 | g1184771 | BLASTN | 811 | 1e−77 | 96 |
| 1915 | 325 | 700083456H1 | SATMON011 | g1184773 | BLASTN | 1035 | 1e−77 | 86 |
| 1916 | 325 | 700018387H1 | SATMON001 | g1184771 | BLASTN | 1035 | 1e−77 | 100 |
| 1917 | 325 | 700611470H1 | SATMON022 | g22237 | BLASTN | 618 | 1e−76 | 87 |
| 1918 | 325 | 700074067H1 | SATMON007 | g22237 | BLASTN | 837 | 1e−76 | 95 |
| 1919 | 325 | 700237659H1 | SATMON010 | g1184771 | BLASTN | 957 | 1e−76 | 96 |
| 1920 | 325 | 700018236H1 | SATMON001 | g1184773 | BLASTN | 1025 | 1e−76 | 100 |
| 1921 | 325 | 700240687H1 | SATMON010 | g1184771 | BLASTN | 957 | 1e−75 | 96 |
| 1922 | 325 | 700152594H1 | SATMON007 | g1184773 | BLASTN | 1009 | 1e−75 | 93 |
| 1923 | 325 | 700050944H1 | SATMON003 | g1184771 | BLASTN | 1009 | 1e−75 | 94 |
| 1924 | 325 | 700016175H1 | SATMON001 | g1184775 | BLASTN | 1015 | 1e−75 | 96 |
| 1925 | 325 | 700238172H1 | SATMON010 | g1184771 | BLASTN | 1016 | 1e−75 | 99 |
| 1926 | 325 | 700349862H1 | SATMON023 | g22237 | BLASTN | 459 | 1e−74 | 96 |
| 1927 | 325 | 700336123H1 | SATMON019 | g1184771 | BLASTN | 842 | 1e−74 | 89 |
| 1928 | 325 | 700151243H1 | SATMON007 | g22237 | BLASTN | 994 | 1e−74 | 99 |
| 1929 | 325 | 700164181H1 | SATMON013 | g1184773 | BLASTN | 998 | 1e−74 | 98 |
| 1930 | 325 | 700149684H1 | SATMON007 | g1184773 | BLASTN | 999 | 1e−74 | 93 |
| 1931 | 325 | 700615060H1 | SATMON033 | g1184773 | BLASTN | 469 | 1e−73 | 90 |
| 1932 | 325 | 700456658H1 | SATMON029 | g1184771 | BLASTN | 580 | 1e−73 | 93 |
| 1933 | 325 | 700151426H1 | SATMON007 | g1184771 | BLASTN | 618 | 1e−73 | 100 |
| 1934 | 325 | 700261414H1 | SATMON017 | g1184771 | BLASTN | 709 | 1e−73 | 95 |
| 1935 | 325 | 700353168H1 | SATMON024 | g1184773 | BLASTN | 716 | 1e−73 | 91 |
| 1936 | 325 | 700350156H1 | SATMON023 | g1184771 | BLASTN | 757 | 1e−73 | 88 |
| 1937 | 325 | 700171133H1 | SATMON013 | g1184771 | BLASTN | 771 | 1e−73 | 94 |
| 1938 | 325 | 700150636H1 | SATMON007 | g1184771 | BLASTN | 771 | 1e−73 | 96 |
| 1939 | 325 | 700354231H1 | SATMON024 | g1184773 | BLASTN | 984 | 1e−73 | 98 |
| 1940 | 325 | 700454489H1 | SATMON029 | g22237 | BLASTN | 565 | 1e−72 | 94 |
| 1941 | 325 | 700241567H1 | SATMON010 | g1184771 | BLASTN | 622 | 1e−72 | 94 |
| 1942 | 325 | 700171506H1 | SATMON013 | g22237 | BLASTN | 847 | 1e−72 | 98 |
| 1943 | 325 | 700354944H1 | SATMON024 | g1184773 | BLASTN | 974 | 1e−72 | 93 |
| 1944 | 325 | 700160388H1 | SATMON012 | g1184773 | BLASTN | 974 | 1e−72 | 93 |
| 1945 | 325 | 700806125H1 | SATMON036 | g1184773 | BLASTN | 976 | 1e−72 | 87 |
| 1946 | 325 | 700072347H2 | SATMON007 | g1184773 | BLASTN | 962 | 1e−71 | 92 |
| 1947 | 325 | 700264638H1 | SATMON017 | g1185553 | BLASTN | 568 | 1e−70 | 95 |
| 1948 | 325 | 701181725H1 | SATMONN06 | g1184773 | BLASTN | 796 | 1e−70 | 91 |
| 1949 | 325 | 700439643H1 | SATMON026 | g1184771 | BLASTN | 885 | 1e−70 | 89 |
| 1950 | 325 | 700473276H1 | SATMON025 | g1184771 | BLASTN | 953 | 1e−70 | 99 |
| 1951 | 325 | 700335504H1 | SATMON019 | g1184773 | BLASTN | 597 | 1e−69 | 82 |

TABLE A*-continued

| Seq No. | Cluster ID | CloneID | Library | NCBI gi | Method | Score | P-value | % Ident |
|---|---|---|---|---|---|---|---|---|
| 1952 | 325 | 700439983H1 | SATMON026 | g1184771 | BLASTN | 810 | 1e−69 | 99 |
| 1953 | 325 | 700803685H1 | SATMON036 | g1184773 | BLASTN | 825 | 1e−69 | 94 |
| 1954 | 325 | 700089572H1 | SATMON011 | g1184773 | BLASTN | 943 | 1e−69 | 99 |
| 1955 | 325 | 700620191H1 | SATMON034 | g1184771 | BLASTN | 838 | 1e−68 | 90 |
| 1956 | 325 | 700336318H1 | SATMON019 | g22237 | BLASTN | 930 | 1e−68 | 100 |
| 1957 | 325 | 700218257H1 | SATMON016 | g22237 | BLASTN | 584 | 1e−67 | 88 |
| 1958 | 325 | 700471821H1 | SATMON025 | g1184771 | BLASTN | 590 | 1e−67 | 100 |
| 1959 | 325 | 700335407H1 | SATMON019 | g22237 | BLASTN | 912 | 1e−67 | 79 |
| 1960 | 325 | 700242905H1 | SATMON010 | g1184771 | BLASTN | 577 | 1e−66 | 93 |
| 1961 | 325 | 700333089H1 | SATMON019 | g1184773 | BLASTN | 760 | 1e−66 | 93 |
| 1962 | 325 | 700615210H1 | SATMON033 | g1184773 | BLASTN | 824 | 1e−66 | 93 |
| 1963 | 325 | 700197701H1 | SATMON014 | g1184773 | BLASTN | 901 | 1e−66 | 82 |
| 1964 | 325 | 700017877H1 | SATMON001 | g1184771 | BLASTN | 526 | 1e−64 | 93 |
| 1965 | 325 | 700467503H1 | SATMON025 | g293888 | BLASTN | 510 | 1e−63 | 94 |
| 1966 | 325 | 700457187H1 | SATMON029 | g1184771 | BLASTN | 648 | 1e−63 | 86 |
| 1967 | 325 | 700381477H1 | SATMON023 | g1184773 | BLASTN | 837 | 1e−63 | 98 |
| 1968 | 325 | 700614350H1 | SATMON033 | g22237 | BLASTN | 868 | 1e−63 | 96 |
| 1969 | 325 | 700092925H1 | SATMON008 | g22237 | BLASTN | 752 | 1e−62 | 94 |
| 1970 | 325 | 700016350H1 | SATMON001 | g22237 | BLASTN | 853 | 1e−62 | 98 |
| 1971 | 325 | 700019729H1 | SATMON001 | g22237 | BLASTN | 853 | 1e−62 | 98 |
| 1972 | 325 | 700167419H1 | SATMON013 | g1184771 | BLASTN | 860 | 1e−62 | 100 |
| 1973 | 325 | 700152703H1 | SATMON007 | g22237 | BLASTN | 860 | 1e−62 | 100 |
| 1974 | 325 | 700449337H1 | SATMON028 | g1184771 | BLASTN | 860 | 1e−62 | 100 |
| 1975 | 325 | 700151887H1 | SATMON007 | g1184775 | BLASTN | 848 | 1e−61 | 99 |
| 1976 | 325 | 700578028H1 | SATMON031 | g1184771 | BLASTN | 618 | 1e−60 | 91 |
| 1977 | 325 | 700440305H1 | SATMON026 | g1184771 | BLASTN | 660 | 1e−60 | 97 |
| 1978 | 325 | 700354945H1 | SATMON024 | g1184775 | BLASTN | 837 | 1e−60 | 98 |
| 1979 | 325 | 700341302H1 | SATMON020 | g1184771 | BLASTN | 375 | 1e−59 | 91 |
| 1980 | 325 | 700026117H1 | SATMON003 | g1185553 | BLASTN | 501 | 1e−58 | 98 |
| 1981 | 325 | 700150218H1 | SATMON007 | g1184771 | BLASTN | 732 | 1e−58 | 93 |
| 1982 | 325 | 700446832H1 | SATMON027 | g1184771 | BLASTN | 802 | 1e−58 | 97 |
| 1983 | 325 | 700171562H1 | SATMON013 | g1184771 | BLASTN | 805 | 1e−58 | 100 |
| 1984 | 325 | 700156216H1 | SATMON007 | g1184773 | BLASTN | 779 | 1e−56 | 87 |
| 1985 | 325 | 700095551H1 | SATMON008 | g22237 | BLASTN | 779 | 1e−56 | 98 |
| 1986 | 325 | 701165479H1 | SATMONN04 | g1184771 | BLASTN | 786 | 1e−56 | 98 |
| 1987 | 325 | 700151917H1 | SATMON007 | g1184773 | BLASTN | 682 | 1e−55 | 90 |
| 1988 | 325 | 700153313H1 | SATMON007 | g22237 | BLASTN | 771 | 1e−55 | 99 |
| 1989 | 325 | 700204963H1 | SATMON003 | g1184771 | BLASTN | 472 | 1e−54 | 93 |
| 1990 | 325 | 700450961H1 | SATMON028 | g22237 | BLASTN | 480 | 1e−54 | 99 |
| 1991 | 325 | 700434230H1 | SATMONN01 | g1184771 | BLASTN | 765 | 1e−54 | 93 |
| 1992 | 325 | 700265994H1 | SATMON017 | g22237 | BLASTN | 748 | 1e−53 | 88 |
| 1993 | 325 | 700090231H1 | SATMON011 | g1184773 | BLASTN | 750 | 1e−53 | 100 |
| 1994 | 325 | 700073935H1 | SATMON007 | g1184773 | BLASTN | 751 | 1e−53 | 99 |
| 1995 | 325 | 700084392H1 | SATMON011 | g22237 | BLASTN | 640 | 1e−52 | 100 |
| 1996 | 325 | 700382560H1 | SATMON024 | g1184773 | BLASTN | 730 | 1e−52 | 81 |
| 1997 | 325 | 700257449H2 | SATMON017 | g1184771 | BLASTN | 555 | 1e−51 | 97 |
| 1998 | 325 | 700210766H1 | SATMON016 | g22237 | BLASTN | 723 | 1e−51 | 99 |
| 1999 | 325 | 700427913H1 | SATMONN01 | g22237 | BLASTN | 728 | 1e−51 | 98 |
| 2000 | 325 | 700351216H1 | SATMON023 | g1184771 | BLASTN | 550 | 1e−50 | 98 |
| 2001 | 325 | 700806073H1 | SATMON036 | g1184773 | BLASTN | 390 | 1e−49 | 79 |
| 2002 | 325 | 700207249H1 | SATMON017 | g1184771 | BLASTN | 480 | 1e−49 | 95 |
| 2003 | 325 | 700261719H1 | SATMON017 | g1184771 | BLASTN | 611 | 1e−49 | 94 |
| 2004 | 325 | 700430989H1 | SATMONN01 | g22237 | BLASTN | 631 | 1e−49 | 90 |
| 2005 | 325 | 700807308H1 | SATMON036 | g1184773 | BLASTN | 698 | 1e−49 | 86 |
| 2006 | 325 | 700334327H1 | SATMON019 | g1184771 | BLASTN | 704 | 1e−49 | 97 |
| 2007 | 325 | 700172805H1 | SATMON013 | g1184771 | BLASTN | 705 | 1e−49 | 95 |
| 2008 | 325 | 700422633H1 | SATMONN01 | g1184771 | BLASTN | 411 | 1e−47 | 89 |
| 2009 | 325 | 700353962H1 | SATMON024 | g1184773 | BLASTN | 678 | 1e−47 | 99 |
| 2010 | 325 | 701161133H1 | SATMONN04 | g1184771 | BLASTN | 655 | 1e−45 | 100 |
| 2011 | 325 | 700802550H1 | SATMON036 | g1184773 | BLASTN | 438 | 1e−44 | 92 |
| 2012 | 325 | 700440239H1 | SATMON026 | g22237 | BLASTN | 449 | 1e−44 | 95 |
| 2013 | 325 | 700454565H1 | SATMON029 | g1184771 | BLASTN | 524 | 1e−44 | 89 |
| 2014 | 325 | 700053528H1 | SATMON010 | g22237 | BLASTN | 635 | 1e−44 | 100 |
| 2015 | 325 | 700257743H1 | SATMON017 | g1184771 | BLASTN | 352 | 1e−43 | 92 |
| 2016 | 325 | 700072283H1 | SATMON007 | g1184773 | BLASTN | 626 | 1e−43 | 99 |
| 2017 | 325 | 700260796H1 | SATMON017 | g22237 | BLASTN | 628 | 1e−43 | 99 |
| 2018 | 325 | 700262496H1 | SATMON017 | g1184771 | BLASTN | 455 | 1e−42 | 90 |
| 2019 | 325 | 700155358H1 | SATMON007 | g1184771 | BLASTN | 610 | 1e−42 | 100 |
| 2020 | 325 | 700196762H1 | SATMON014 | g1184773 | BLASTN | 615 | 1e−42 | 100 |
| 2021 | 325 | 700450601H1 | SATMON028 | g22237 | BLASTN | 615 | 1e−42 | 96 |
| 2022 | 325 | 700581050H1 | SATMON031 | g22237 | BLASTN | 618 | 1e−42 | 99 |
| 2023 | 325 | 700072316H2 | SATMON007 | g1184773 | BLASTN | 366 | 1e−40 | 92 |
| 2024 | 325 | 700427659H1 | SATMONN01 | g22302 | BLASTN | 416 | 1e−38 | 94 |
| 2025 | 325 | 700356507H1 | SATMON024 | g1184773 | BLASTN | 422 | 1e−38 | 89 |
| 2026 | 325 | 700169472H1 | SATMON013 | g1184773 | BLASTN | 339 | 1e−37 | 93 |
| 2027 | 325 | 700377362H1 | SATMON019 | g1184773 | BLASTN | 550 | 1e−37 | 97 |
| 2028 | 325 | 700378460H1 | SATMON020 | g1184771 | BLASTN | 345 | 1e−36 | 100 |

TABLE A*-continued

| Seq No. | Cluster ID | CloneID | Library | NCBI gi | Method | Score | P-value | % Ident |
|---|---|---|---|---|---|---|---|---|
| 2029 | 325 | 700440218H1 | SATMON026 | g22237 | BLASTN | 538 | 1e-36 | 91 |
| 2030 | 325 | 700440230H1 | SATMON026 | g22237 | BLASTN | 364 | 1e-35 | 97 |
| 2031 | 325 | 700072350H1 | SATMON007 | g1184773 | BLASTN | 470 | 1e-35 | 99 |
| 2032 | 325 | 700241920H1 | SATMON010 | g22302 | BLASTN | 528 | 1e-35 | 99 |
| 2033 | 325 | 700347048H1 | SATMON021 | g1184773 | BLASTN | 537 | 1e-35 | 90 |
| 2034 | 325 | 700802555H1 | SATMON036 | g1184773 | BLASTN | 438 | 1e-34 | 88 |
| 2035 | 325 | 700615893H1 | SATMON033 | g1184773 | BLASTN | 372 | 1e-33 | 92 |
| 2036 | 325 | 700257073H1 | SATMON017 | g1184771 | BLASTN | 430 | 1e-32 | 90 |
| 2037 | 325 | 700220433H1 | SATMON011 | g1184773 | BLASTN | 490 | 1e-32 | 91 |
| 2038 | 325 | 700073453H1 | SATMON011 | g1184773 | BLASTN | 497 | 1e-32 | 92 |
| 2039 | 325 | 700086779H1 | SATMON011 | g1184771 | BLASTN | 480 | 1e-31 | 96 |
| 2040 | 325 | 700621224H1 | SATMON034 | g1184771 | BLASTN | 278 | 1e-30 | 98 |
| 2041 | 325 | 700344636H1 | SATMON021 | g22237 | BLASTN | 461 | 1e-29 | 98 |
| 2042 | 325 | 700240570H1 | SATMON010 | g1184771 | BLASTN | 463 | 1e-29 | 95 |
| 2043 | 325 | 700349592H1 | SATMON023 | g1184773 | BLASTN | 325 | 1e-28 | 90 |
| 2044 | 325 | 700454979H1 | SATMON029 | g22237 | BLASTN | 412 | 1e-25 | 92 |
| 2045 | 325 | 700206008H1 | SATMON003 | g22237 | BLASTN | 191 | 1e-23 | 99 |
| 2046 | 325 | 700263545H1 | SATMON017 | g22237 | BLASTN | 300 | 1e-23 | 95 |
| 2047 | 325 | 700802094H1 | SATMON036 | g1184773 | BLASTN | 382 | 1e-23 | 79 |
| 2048 | 325 | 700206976H1 | SATMON003 | g1184773 | BLASTN | 388 | 1e-23 | 87 |
| 2049 | 325 | 700799153H1 | SATMON036 | g293886 | BLASTN | 232 | 1e-22 | 92 |
| 2050 | 325 | 700456230H1 | SATMON029 | g1184771 | BLASTN | 333 | 1e-22 | 71 |
| 2051 | 325 | 700354919H1 | SATMON024 | g1184771 | BLASTN | 230 | 1e-20 | 100 |
| 2052 | 325 | 700614147H1 | SATMON033 | g22237 | BLASTN | 256 | 1e-18 | 91 |
| 2053 | 325 | 701181137H1 | SATMONN06 | g22237 | BLASTN | 322 | 1e-18 | 97 |
| 2054 | 325 | 700458047H1 | SATMON029 | g1184771 | BLASTN | 275 | 1e-14 | 100 |
| 2055 | 325 | 700807468H1 | SATMON036 | g1184773 | BLASTN | 179 | 1e-13 | 92 |
| 2056 | 3520 | 700212510H1 | SATMON016 | g168478 | BLASTN | 1590 | 1e-123 | 99 |
| 2057 | 3520 | 700097780H1 | SATMON009 | g168520 | BLASTN | 637 | 1e-122 | 97 |
| 2058 | 3520 | 700101968H1 | SATMON009 | g168520 | BLASTN | 1002 | 1e-117 | 98 |
| 2059 | 3520 | 700099736H1 | SATMON009 | g168520 | BLASTN | 1030 | 1e-116 | 97 |
| 2060 | 3520 | 700096850H1 | SATMON008 | g168520 | BLASTN | 938 | 1e-115 | 97 |
| 2061 | 3520 | 700101454H1 | SATMON009 | g168520 | BLASTN | 977 | 1e-115 | 97 |
| 2062 | 3520 | 700092378H1 | SATMON008 | g168520 | BLASTN | 651 | 1e-114 | 98 |
| 2063 | 3520 | 700099257H1 | SATMON009 | g22239 | BLASTN | 1478 | 1e-114 | 99 |
| 2064 | 3520 | 700209837H1 | SATMON016 | g168520 | BLASTN | 1012 | 1e-112 | 99 |
| 2065 | 3520 | 700097148H1 | SATMON009 | g168520 | BLASTN | 1030 | 1e-112 | 97 |
| 2066 | 3520 | 700100043H1 | SATMON009 | g168520 | BLASTN | 888 | 1e-111 | 96 |
| 2067 | 3520 | 700099516H1 | SATMON009 | g168520 | BLASTN | 991 | 1e-111 | 95 |
| 2068 | 3520 | 700097454H1 | SATMON009 | g168520 | BLASTN | 1028 | 1e-111 | 98 |
| 2069 | 3520 | 700099582H1 | SATMON009 | g168520 | BLASTN | 873 | 1e-109 | 98 |
| 2070 | 3520 | 700101028H1 | SATMON009 | g168520 | BLASTN | 963 | 1e-109 | 97 |
| 2071 | 3520 | 700101288H1 | SATMON009 | g168520 | BLASTN | 967 | 1e-109 | 98 |
| 2072 | 3520 | 700098981H1 | SATMON009 | g168520 | BLASTN | 1023 | 1e-109 | 98 |
| 2073 | 3520 | 700053377H1 | SATMON009 | g168478 | BLASTN | 1420 | 1e-109 | 100 |
| 2074 | 3520 | 700101538H1 | SATMON009 | g168520 | BLASTN | 958 | 1e-108 | 98 |
| 2075 | 3520 | 700093413H1 | SATMON008 | g168520 | BLASTN | 1037 | 1e-108 | 99 |
| 2076 | 3520 | 700098960H1 | SATMON009 | g168478 | BLASTN | 1004 | 1e-106 | 96 |
| 2077 | 3520 | 700212674H1 | SATMON016 | g168520 | BLASTN | 977 | 1e-105 | 98 |
| 2078 | 3520 | 700098986H1 | SATMON009 | g168478 | BLASTN | 1033 | 1e-105 | 98 |
| 2079 | 3520 | 700099244H1 | SATMON009 | g168520 | BLASTN | 976 | 1e-104 | 98 |
| 2080 | 3520 | 700100392H1 | SATMON009 | g168520 | BLASTN | 1002 | 1e-104 | 96 |
| 2081 | 3520 | 700044021H1 | SATMON004 | g168478 | BLASTN | 1350 | 1e-103 | 98 |
| 2082 | 3520 | 700043432H1 | SATMON004 | g168520 | BLASTN | 950 | 1e-102 | 97 |
| 2083 | 3520 | 700045175H1 | SATMON004 | g168520 | BLASTN | 963 | 1e-102 | 99 |
| 2084 | 3520 | 700099592H1 | SATMON009 | g168520 | BLASTN | 972 | 1e-102 | 94 |
| 2085 | 3520 | 700101559H1 | SATMON009 | g168478 | BLASTN | 1236 | 1e-102 | 94 |
| 2086 | 3520 | 700045717H1 | SATMON004 | g168478 | BLASTN | 1337 | 1e-102 | 96 |
| 2087 | 3520 | 700100711H1 | SATMON009 | g168520 | BLASTN | 996 | 1e-101 | 96 |
| 2088 | 3520 | 700098021H1 | SATMON009 | g168478 | BLASTN | 1189 | 1e-101 | 99 |
| 2089 | 3520 | 700044254H1 | SATMON004 | g22239 | BLASTN | 1327 | 1e-101 | 98 |
| 2090 | 3520 | 700041717H1 | SATMON004 | g168520 | BLASTN | 1010 | 1e-100 | 97 |
| 2091 | 3520 | 700044347H1 | SATMON004 | g168520 | BLASTN | 1028 | 1e-99 | 98 |
| 2092 | 3520 | 700097318H1 | SATMON009 | g168478 | BLASTN | 1121 | 1e-99 | 97 |
| 2093 | 3520 | 700045244H1 | SATMON004 | g22239 | BLASTN | 1295 | 1e-99 | 98 |
| 2094 | 3520 | 700041539H1 | SATMON004 | g168478 | BLASTN | 1300 | 1e-99 | 100 |
| 2095 | 3520 | 700100339H1 | SATMON009 | g168520 | BLASTN | 1014 | 1e-98 | 97 |
| 2096 | 3520 | 700099768H1 | SATMON009 | g168520 | BLASTN | 519 | 1e-97 | 96 |
| 2097 | 3520 | 700043795H1 | SATMON004 | g168520 | BLASTN | 973 | 1e-97 | 97 |
| 2098 | 3520 | 700043117H1 | SATMON004 | g168520 | BLASTN | 1007 | 1e-97 | 97 |
| 2099 | 3520 | 700211227H1 | SATMON016 | g168520 | BLASTN | 694 | 1e-96 | 92 |
| 2100 | 3520 | 700044187H1 | SATMON004 | g168520 | BLASTN | 958 | 1e-96 | 98 |
| 2101 | 3520 | 700025676H1 | SATMON004 | g168478 | BLASTN | 1259 | 1e-95 | 98 |
| 2102 | 3520 | 700094879H1 | SATMON008 | g168478 | BLASTN | 843 | 1e-94 | 95 |
| 2103 | 3520 | 700217617H1 | SATMON016 | g168520 | BLASTN | 898 | 1e-94 | 93 |
| 2104 | 3520 | 700404848H1 | SATMON026 | g168520 | BLASTN | 1039 | 1e-94 | 88 |
| 2105 | 3520 | 700044959H1 | SATMON004 | g168520 | BLASTN | 1000 | 1e-93 | 95 |

TABLE A*-continued

| Seq No. | Cluster ID | CloneID | Library | NCBI gi | Method | Score | P-value | % Ident |
|---|---|---|---|---|---|---|---|---|
| 2106 | 3520 | 700213689H1 | SATMON016 | g168520 | BLASTN | 1007 | 1e−93 | 97 |
| 2107 | 3520 | 700210347H1 | SATMON016 | g168520 | BLASTN | 1191 | 1e−92 | 90 |
| 2108 | 3520 | 700045145H1 | SATMON004 | g168520 | BLASTN | 988 | 1e−91 | 98 |
| 2109 | 3520 | 700217745H1 | SATMON016 | g168520 | BLASTN | 1037 | 1e−91 | 98 |
| 2110 | 3520 | 700099288H1 | SATMON009 | g168478 | BLASTN | 1120 | 1e−91 | 93 |
| 2111 | 3520 | 700099630H1 | SATMON009 | g168520 | BLASTN | 445 | 1e−88 | 92 |
| 2112 | 3520 | 700214977H1 | SATMON016 | g22239 | BLASTN | 1084 | 1e−88 | 96 |
| 2113 | 3520 | 700045545H1 | SATMON004 | g22239 | BLASTN | 1161 | 1e−88 | 95 |
| 2114 | 3520 | 700198007H1 | SATMON016 | g22239 | BLASTN | 1167 | 1e−88 | 99 |
| 2115 | 3520 | 700216050H1 | SATMON016 | g168520 | BLASTN | 681 | 1e−85 | 88 |
| 2116 | 3520 | 700214595H1 | SATMON016 | g168478 | BLASTN | 975 | 1e−84 | 98 |
| 2117 | 3520 | 700215383H1 | SATMON016 | g168478 | BLASTN | 1021 | 1e−84 | 98 |
| 2118 | 3520 | 700098015H1 | SATMON009 | g168478 | BLASTN | 1080 | 1e−81 | 79 |
| 2119 | 3520 | 700210596H1 | SATMON016 | g168520 | BLASTN | 575 | 1e−79 | 92 |
| 2120 | 3520 | 700440284H1 | SATMON026 | g168478 | BLASTN | 914 | 1e−76 | 93 |
| 2121 | 3520 | 700215096H1 | SATMON016 | g168478 | BLASTN | 866 | 1e−75 | 95 |
| 2122 | 3520 | 700207885H1 | SATMON016 | g168520 | BLASTN | 408 | 1e−70 | 97 |
| 2123 | 3520 | 700044936H1 | SATMON004 | g168520 | BLASTN | 414 | 1e−68 | 89 |
| 2124 | 3520 | 700042261H1 | SATMON004 | g22239 | BLASTN | 579 | 1e−67 | 97 |
| 2125 | 3520 | 700213316H1 | SATMON016 | g22239 | BLASTN | 742 | 1e−53 | 98 |
| 2126 | 3520 | 700101372H1 | SATMON009 | g22239 | BLASTN | 625 | 1e−43 | 100 |
| 2127 | 3520 | 700053328H1 | SATMON009 | g168478 | BLASTN | 628 | 1e−43 | 99 |
| 2128 | 3520 | 700100601H1 | SATMON009 | g168478 | BLASTN | 610 | 1e−41 | 97 |
| 2129 | 3520 | 700101784H1 | SATMON009 | g168520 | BLASTN | 495 | 1e−40 | 99 |
| 2130 | 3520 | 700100849H1 | SATMON009 | g168520 | BLASTN | 505 | 1e−33 | 100 |
| 2131 | 3520 | 700098705H1 | SATMON009 | g168520 | BLASTN | 445 | 1e−32 | 99 |
| 2132 | 3520 | 700098336H1 | SATMON009 | g168478 | BLASTN | 450 | 1e−28 | 90 |
| 2133 | 3520 | 700404788H1 | SATMON026 | g22239 | BLASTN | 413 | 1e−25 | 96 |
| 2134 | 3520 | 700097106H1 | SATMON009 | g168520 | BLASTN | 300 | 1e−16 | 100 |
| 2135 | 4750 | 700267791H1 | SATMON017 | g1100222 | BLASTN | 685 | 1e−48 | 69 |
| 2136 | 4750 | 700346835H1 | SATMON021 | g1100222 | BLASTN | 689 | 1e−48 | 71 |
| 2137 | 4750 | 700205354H1 | SATMON003 | g1100222 | BLASTN | 576 | 1e−39 | 66 |
| 2138 | 4750 | 700213067H1 | SATMON016 | g1100222 | BLASTN | 558 | 1e−37 | 69 |
| 2139 | 4750 | 700073493H1 | SATMON007 | g1100222 | BLASTN | 513 | 1e−32 | 68 |
| 2140 | 482 | 700281924H2 | SATMON021 | g1100224 | BLASTN | 835 | 1e−60 | 79 |
| 2141 | 482 | 700076167H1 | SATMON007 | g1100224 | BLASTN | 765 | 1e−54 | 78 |
| 2142 | 482 | 700106880H1 | SATMON010 | g1100222 | BLASTN | 713 | 1e−50 | 79 |
| 2143 | 482 | 700343834H1 | SATMON021 | g1100224 | BLASTN | 650 | 1e−45 | 79 |
| 2144 | 482 | 700612539H1 | SATMON033 | g1100224 | BLASTN | 584 | 1e−39 | 80 |
| 2145 | 482 | 700017623H1 | SATMON001 | g1100224 | BLASTN | 535 | 1e−35 | 81 |
| 2146 | 5054 | 700043423H1 | SATMON004 | g1185553 | BLASTN | 241 | 1e−9 | 90 |
| 2147 | 5609 | 700098586H1 | SATMON009 | g2331136 | BLASTN | 1069 | 1e−80 | 80 |
| 2148 | 5609 | 700101965H1 | SATMON009 | g2331136 | BLASTN | 973 | 1e−72 | 78 |
| 2149 | 5609 | 700097652H1 | SATMON009 | g22239 | BLASTN | 530 | 1e−70 | 77 |
| 2150 | 5609 | 700045073H1 | SATMON004 | g2331136 | BLASTN | 908 | 1e−67 | 83 |
| 2151 | 5609 | 700100461H1 | SATMON009 | g2331136 | BLASTN | 896 | 1e−66 | 84 |
| 2152 | 5609 | 700100784H1 | SATMON009 | g22239 | BLASTN | 306 | 1e−65 | 79 |
| 2153 | 5609 | 700041674H1 | SATMON004 | g22239 | BLASTN | 893 | 1e−65 | 81 |
| 2154 | 5609 | 700101071H1 | SATMON009 | g22239 | BLASTN | 867 | 1e−63 | 79 |
| 2155 | 5609 | 700099485H1 | SATMON009 | g168478 | BLASTN | 462 | 1e−61 | 83 |
| 2156 | 5609 | 700101345H1 | SATMON009 | g2331136 | BLASTN | 744 | 1e−61 | 78 |
| 2157 | 5609 | 700043784H1 | SATMON004 | g22239 | BLASTN | 842 | 1e−61 | 80 |
| 2158 | 5609 | 700099589H1 | SATMON009 | g2331136 | BLASTN | 707 | 1e−60 | 76 |
| 2159 | 5609 | 700099264H1 | SATMON009 | g168478 | BLASTN | 568 | 1e−58 | 78 |
| 2160 | 5609 | 700041766H1 | SATMON004 | g168478 | BLASTN | 615 | 1e−58 | 86 |
| 2161 | 5609 | 700098403H1 | SATMON009 | g168521 | BLASTN | 798 | 1e−58 | 80 |
| 2162 | 5609 | 700042111H1 | SATMON004 | g21251 | BLASTN | 791 | 1e−57 | 75 |
| 2163 | 5609 | 700042979H1 | SATMON004 | g21251 | BLASTN | 783 | 1e−56 | 75 |
| 2164 | 5609 | 700579708H1 | SATMON031 | g21251 | BLASTN | 770 | 1e−55 | 76 |
| 2165 | 5609 | 700097230H1 | SATMON009 | g1181547 | BLASTN | 677 | 1e−47 | 75 |
| 2166 | 5609 | 700097983H1 | SATMON009 | g1181547 | BLASTN | 644 | 1e−44 | 76 |
| 2167 | 5609 | 700099990H1 | SATMON009 | g22239 | BLASTN | 633 | 1e−43 | 78 |
| 2168 | 5609 | 700404886H1 | SATMON026 | g22239 | BLASTN | 621 | 1e−42 | 79 |
| 2169 | 5609 | 700101261H1 | SATMON009 | g22239 | BLASTN | 306 | 1e−41 | 78 |
| 2170 | 5609 | 700025513H1 | SATMON004 | g21251 | BLASTN | 592 | 1e−40 | 72 |
| 2171 | 5609 | 700042534H1 | SATMON004 | g1181547 | BLASTN | 575 | 1e−39 | 73 |
| 2172 | 5609 | 700404890H1 | SATMON026 | g168520 | BLASTN | 324 | 1e−27 | 81 |
| 2173 | 5609 | 700100028H1 | SATMON009 | g1181547 | BLASTN | 435 | 1e−25 | 77 |
| 2174 | 5609 | 700097683H1 | SATMON009 | g170239 | BLASTX | 211 | 1e−22 | 92 |
| 2175 | 5609 | 700045480H1 | SATMON004 | g170239 | BLASTX | 202 | 1e−20 | 92 |
| 2176 | 5609 | 700101596H1 | SATMON009 | g21252 | BLASTX | 129 | 1e−17 | 80 |
| 2177 | 5609 | 700434377H1 | SATMONN01 | g168524 | BLASTX | 70 | 1e−16 | 94 |
| 2178 | 5609 | 700043206H1 | SATMON004 | g170239 | BLASTX | 150 | 1e−16 | 87 |
| 2179 | 5609 | 700025514H1 | SATMON004 | g21251 | BLASTN | 276 | 1e−14 | 69 |
| 2180 | 5609 | 700198075H1 | SATMON016 | g170239 | BLASTX | 138 | 1e−13 | 79 |
| 2181 | 5609 | 700100768H1 | SATMON009 | g21252 | BLASTX | 50 | 1e−10 | 78 |
| 2182 | 5609 | 700043373H1 | SATMON004 | g21252 | BLASTX | 67 | 1e−10 | 86 |

TABLE A*-continued

| Seq No. | Cluster ID | CloneID | Library | NCBI gi | Method | Score | P-value | % Ident |
|---|---|---|---|---|---|---|---|---|
| 2183 | 5609 | 700097375H1 | SATMON009 | g21252 | BLASTX | 70 | 1e-9 | 77 |
| 2184 | 5609 | 700208045H1 | SATMON016 | g256965 | BLASTX | 72 | 1e-9 | 61 |
| 2185 | 7791 | 7004267211H | SATMONN01 | g1185553 | BLASTN | 273 | 1e-12 | 83 |
| 2186 | 9845 | 7005730461H | SATMON030 | g1185555 | BLASTN | 283 | 1e-23 | 70 |
| 2187 | -L1431834 | LIB143-029-Q1-E1-H1 | LIB143 | g22237 | BLASTN | 369 | 1e-65 | 94 |
| 2188 | -L1433328 | LIB143-020-Q1-E1-F2 | LIB143 | g22237 | BLASTN | 269 | 1e-11 | 82 |
| 2189 | -L1435669 | LIB143-049-Q1-E1-H3 | LIB143 | g1184773 | BLASTN | 409 | 1e-48 | 82 |
| 2190 | -L1435747 | LIB143-049-Q1-E1-H4 | LIB143 | g1184775 | BLASTN | 161 | 1e-13 | 85 |
| 2191 | -L1482841 | LIB148-009-Q1-E1-G2 | LIB148 | g717080 | BLASTN | 683 | 1e-46 | 75 |
| 2192 | -L1891511 | LIB189-007-Q1-E1-B4 | LIB189 | g168478 | BLASTN | 186 | 1e-12 | 85 |
| 2193 | -L1893431 | LIB189-023-Q1-E1-B8 | LIB189 | g168520 | BLASTN | 780 | 1e-58 | 80 |
| 2194 | -L30591771 | LIB3059-004-Q1-K1-C3 | LIB3059 | g1184773 | BLASTN | 253 | 1e-10 | 79 |
| 2195 | -L30592823 | LIB3059-013-Q1-K1-B4 | LIB3059 | g1184775 | BLASTN | 876 | 1e-64 | 94 |
| 2196 | -L30595676 | LIB3059-059-Q1-K1-D6 | LIB3059 | g1912310 | BLASTX | 138 | 1e-27 | 82 |
| 2197 | -L30596448 | LIB3059-052-Q1-K1-E5 | LIB3059 | g22302 | BLASTN | 207 | 1e-13 | 70 |
| 2198 | -L30596730 | LIB3059-055-Q1-K1-C8 | LIB3059 | g717080 | BLASTN | 234 | 1e-10 | 78 |
| 2199 | -L30601281 | LIB3060-001-Q1-K1-A9 | LIB3060 | g168520 | BLASTN | 762 | 1e-77 | 84 |
| 2200 | -L30601466 | LIB3060-002-Q1-K2-G3 | LIB3060 | g22239 | BLASTN | 153 | 1e-9 | 76 |
| 2201 | -L30602361 | LIB3060-004-Q1-K1-E12 | LIB3060 | g168521 | BLASTN | 935 | 1e-71 | 93 |
| 2202 | -L30603772 | LIB3060-040-Q1-K1-H9 | LIB3060 | g168520 | BLASTN | 766 | 1e-78 | 87 |
| 2203 | -L30604121 | LIB3060-037-Q1-K1-B8 | LIB3060 | g168478 | BLASTN | 238 | 1e-9 | 70 |
| 2204 | -L30604680 | LIB3060-024-Q1-K1-C10 | LIB3060 | g168520 | BLASTN | 490 | 1e-57 | 81 |
| 2205 | -L30604772 | LIB3060-020-Q1-K1-B1 | LIB3060 | g22237 | BLASTN | 344 | 1e-19 | 75 |
| 2206 | -L30605068 | LIB3060-023-Q1-K1-D10 | LIB3060 | g21252 | BLASTX | 77 | 1e-25 | 55 |
| 2207 | -L30614406 | LIB3061-034-Q1-K1-H4 | LIB3061 | g1184773 | BLASTN | 138 | 1e-20 | 95 |
| 2208 | -L30621659 | LIB3062-004-Q1-K1-D3 | LIB3062 | g1185553 | BLASTN | 263 | 1e-10 | 73 |
| 2209 | -L30624091 | LIB3062-022-Q1-K1-G4 | LIB3062 | g1184771 | BLASTN | 457 | 1e-29 | 61 |
| 2210 | -L30625111 | LIB3062-047-Q1-K1-F4 | LIB3062 | g168478 | BLASTN | 268 | 1e-13 | 77 |
| 2211 | -L30625390 | LIB3062-045-Q1-K1-B5 | LIB3062 | g3059121 | BLASTN | 246 | 1e-9 | 71 |
| 2212 | -L30625502 | LIB3062-045-Q1-K1-H6 | LIB3062 | g1184771 | BLASTN | 749 | 1e-93 | 78 |
| 2213 | -L30626082 | LIB3062-057-Q1-K1-A6 | LIB3062 | g22237 | BLASTN | 344 | 1e-19 | 80 |
| 2214 | -L30661786 | LIB3066-011-Q1-K1-G4 | LIB3066 | g1185553 | BLASTN | 410 | 1e-25 | 84 |
| 2215 | -L30662411 | LIB3066-035-Q1-K1-C8 | LIB3066 | g1184773 | BLASTN | 270 | 1e-13 | 93 |
| 2216 | -L30664919 | LIB3066-021-Q1-K1-B3 | LIB3066 | g1185553 | BLASTN | 346 | 1e-30 | 87 |
| 2217 | -L30672802 | LIB3067-016-Q1-K1-F10 | LIB3067 | g1184771 | BLASTN | 681 | 1e-53 | 70 |
| 2218 | -L30673570 | LIB3067-005-Q1-K1-A12 | LIB3067 | g1185553 | BLASTN | 466 | 1e-29 | 92 |
| 2219 | -L30675145 | LIB3067-055-Q1-K1-H11 | LIB3067 | g22237 | BLASTN | 438 | 1e-27 | 79 |
| 2220 | -L30681335 | LIB3068-001-Q1-K1-F4 | LIB3068 | g169851 | BLASTN | 540 | 1e-34 | 68 |
| 2221 | -L30683415 | LIB3068-036-Q1-K1-F4 | LIB3068 | g1628381 | BLASTX | 78 | 1e-30 | 55 |
| 2222 | -L30692589 | LIB3069-019-Q1-K1-H1 | LIB3069 | g22238 | BLASTX | 132 | 1e-26 | 40 |

TABLE A*-continued

| Seq No. | Cluster ID | CloneID | Library | NCBI gi | Method | Score | P-value | % Ident |
|---|---|---|---|---|---|---|---|---|
| 2223 | -L30693586 | LIB3069-025-Q1-K1-F9 | LIB3069 | g1185553 | BLASTN | 327 | 1e-15 | 86 |
| 2224 | -L30784053 | LIB3078-029-Q1-K1-F12 | LIB3078 | g168479 | BLASTX | 130 | 1e-32 | 47 |
| 2225 | -L30784418 | LIB3078-039-Q1-K1-A2 | LIB3078 | g2331136 | BLASTN | 566 | 1e-38 | 74 |
| 2226 | -L30791369 | LIB3079-001-Q1-K1-G1 | LIB3079 | g1184771 | BLASTN | 1199 | 1e-96 | 84 |
| 2227 | -L361450 | LIB36-002-Q1-E1-C8 | LIB36 | g168478 | BLASTN | 698 | 1e-48 | 77 |
| 2228 | -L362980 | LIB36-019-Q1-E1-H2 | LIB36 | g22239 | BLASTN | 409 | 1e-25 | 83 |
| 2229 | -L363043 | LIB36-015-Q1-E1-G8 | LIB36 | g1184771 | BLASTN | 312 | 1e-58 | 83 |
| 2230 | -L831348 | LIB83-003-Q1-E1-A11 | LIB83 | g168478 | BLASTN | 286 | 1e-12 | 98 |
| 2231 | -L832266 | LIB83-007-Q1-E1-C2 | LIB83 | g1185555 | BLASTN | 381 | 1e-22 | 68 |
| 2232 | -L841577 | LIB84-027-Q1-E1-H4 | LIB84 | g168478 | BLASTN | 457 | 1e-29 | 95 |
| 2233 | -L841855 | LIB84-030-Q1-E1-C10 | LIB84 | g1185555 | BLASTN | 231 | 1e-10 | 75 |
| 2234 | -L84758 | LIB84-016-Q1-E1-E5 | LIB84 | g474407 | BLASTN | 1346 | 1e-133 | 97 |
| 2235 | 12126 | LIB3062-056-Q1-K1-C9 | LIB3062 | g169851 | BLASTN | 890 | 1e-65 | 71 |
| 2236 | 1334 | LIB143-061-Q1-E1-G2 | LIB143 | g717080 | BLASTN | 310 | 1e-14 | 83 |
| 2237 | 1334 | LIB84-012-Q1-E12-B5 | LIB84 | g717080 | BLASTN | 289 | 1e-12 | 79 |
| 2238 | 13427 | LIB3067-056-Q1-K1-B4 | LIB3067 | g1185553 | BLASTN | 489 | 1e-30 | 88 |
| 2239 | 13947 | LIB3061-037-Q1-K1-C8 | LIB3061 | g1185553 | BLASTN | 334 | 1e-16 | 83 |
| 2240 | 17968 | LIB3059-042-Q1-K1-G12 | LIB3059 | g1184775 | BLASTN | 1641 | 1e-128 | 98 |
| 2241 | 2468 | LIB84-002-Q1-E1-A7 | LIB84 | g168478 | BLASTN | 1251 | 1e-95 | 99 |
| 2242 | 2468 | LIB83-001-Q1-E1-E4 | LIB83 | g22239 | BLASTN | 860 | 1e-62 | 100 |
| 2243 | 26686 | LIB3069-013-Q1-K1-H10 | LIB3069 | g1184772 | BLASTX | 155 | 1e-29 | 42 |
| 2244 | 27323 | LIB3078-024-Q1-K1-G1 | LIB3078 | g474407 | BLASTN | 1386 | 1e-106 | 99 |
| 2245 | 27323 | LIB3069-038-Q1-K1-F4 | LIB3069 | g474407 | BLASTN | 1025 | 1e-93 | 99 |
| 2246 | 27785 | LIB148-039-Q1-E1-A11 | LIB148 | g1185553 | BLASTN | 495 | 1e-30 | 83 |
| 2247 | 27785 | LIB148-006-Q1-E1-B8 | LIB148 | g1185553 | BLASTN | 267 | 1e-10 | 79 |
| 2248 | 29041 | LIB148-017-Q1-E1-D6 | LIB148 | g1185553 | BLASTN | 410 | 1e-27 | 86 |
| 2249 | 29041 | LIB148-024-Q1-E1-C10 | LIB148 | g1185553 | BLASTN | 441 | 1e-27 | 86 |
| 2250 | 29041 | LIB148-058-Q1-E1-D8 | LIB148 | g1185553 | BLASTN | 441 | 1e-27 | 86 |
| 2251 | 29041 | LIB143-040-Q1-E1-H8 | LIB143 | g1185553 | BLASTN | 441 | 1e-26 | 86 |
| 2252 | 30017 | LIB148-057-Q1-E1-H7 | LIB148 | g717080 | BLASTN | 264 | 1e-10 | 65 |
| 2253 | 30327 | LIB36-012-Q1-E1-B4 | LIB36 | g22302 | BLASTN | 266 | 1e-30 | 83 |
| 2254 | 31280 | LIB36-002-Q1-E1-A4 | LIB36 | g1185553 | BLASTN | 337 | 1e-16 | 79 |
| 2255 | 32165 | LIB36-013-Q1-E1-F8 | LIB36 | g474407 | BLASTN | 1417 | 1e-109 | 91 |
| 2256 | 325 | LIB3062-009-Q1-K1-B6 | LIB3062 | g22237 | BLASTN | 2130 | 1e-169 | 100 |
| 2257 | 325 | LIB3059-029-Q1-K1-E5 | LIB3059 | g1184771 | BLASTN | 2098 | 1e-166 | 98 |
| 2258 | 325 | LIB3066-001-Q1-K1-C3 | LIB3066 | g1184773 | BLASTN | 2063 | 1e-163 | 95 |
| 2259 | 325 | LIB3067-029-Q1-K1-F10 | LIB3067 | g1184775 | BLASTN | 1334 | 1e-162 | 96 |
| 2260 | 325 | LIB3062-012-Q1-K1-C5 | LIB3062 | g22237 | BLASTN | 1952 | 1e-162 | 99 |

TABLE A*-continued

| Seq No. | Cluster ID | CloneID | Library | NCBI gi | Method | Score | P-value | % Ident |
|---|---|---|---|---|---|---|---|---|
| 2261 | 325 | LIB3061-011-Q1-K1-H1 | LIB3061 | g1184773 | BLASTN | 1973 | 1e−160 | 99 |
| 2262 | 325 | LIB3061-034-Q1-K1-H6 | LIB3061 | g1184773 | BLASTN | 2027 | 1e−160 | 98 |
| 2263 | 325 | LIB3061-011-Q1-K1-D5 | LIB3061 | g22237 | BLASTN | 1691 | 1e−159 | 98 |
| 2264 | 325 | LIB3068-026-Q1-K1-E3 | LIB3068 | g22237 | BLASTN | 1899 | 1e−159 | 98 |
| 2265 | 325 | LIB3061-034-Q1-K1-A7 | LIB3061 | g1184773 | BLASTN | 1890 | 1e−158 | 98 |
| 2266 | 325 | LIB143-006-Q1-E1-E5 | LIB143 | g1184773 | BLASTN | 1454 | 1e−157 | 95 |
| 2267 | 325 | LIB3068-008-Q1-K1-H2 | LIB3068 | g1184771 | BLASTN | 1673 | 1e−157 | 94 |
| 2268 | 325 | LIB3060-001-Q1-K2-C11 | LIB3060 | g1184771 | BLASTN | 1673 | 1e−155 | 96 |
| 2269 | 325 | LIB3059-042-Q1-K1-G11 | LIB3059 | g1184773 | BLASTN | 1751 | 1e−154 | 97 |
| 2270 | 325 | LIB3060-053-Q1-K1-H6 | LIB3060 | g1184771 | BLASTN | 1954 | 1e−154 | 99 |
| 2271 | 325 | LIB3062-001-Q1-K2-B9 | LIB3062 | g22237 | BLASTN | 1836 | 1e−152 | 93 |
| 2272 | 325 | LIB143-050-Q1-E1-C2 | LIB143 | g1184773 | BLASTN | 1837 | 1e−152 | 94 |
| 2273 | 325 | LIB3059-002-Q1-K2-D10 | LIB3059 | g1184773 | BLASTN | 1933 | 1e−152 | 94 |
| 2274 | 325 | LIB3066-021-Q1-K1-G1 | LIB3066 | g1184773 | BLASTN | 1482 | 1e−151 | 92 |
| 2275 | 325 | LIB36-006-Q1-E1-G10 | LIB36 | g1184771 | BLASTN | 1915 | 1e−151 | 96 |
| 2276 | 325 | LIB3061-013-Q1-K1-D10 | LIB3061 | g1184773 | BLASTN | 1918 | 1e−151 | 96 |
| 2277 | 325 | LIB3062-035-Q1-K1-B9 | LIB3062 | g22237 | BLASTN | 849 | 1e−150 | 94 |
| 2278 | 325 | LIB3068-002-Q1-K1-D3 | LIB3068 | g1184771 | BLASTN | 1056 | 1e−150 | 97 |
| 2279 | 325 | LIB3059-030-Q1-K1-E12 | LIB3059 | g1184773 | BLASTN | 1912 | 1e−150 | 99 |
| 2280 | 325 | LIB3059-048-Q1-K1-D4 | LIB3059 | g1184773 | BLASTN | 1649 | 1e−148 | 90 |
| 2281 | 325 | LIB143-025-Q1-E1-E8 | LIB143 | g22237 | BLASTN | 1887 | 1e−148 | 94 |
| 2282 | 325 | LIB143-057-Q1-E1-E6 | LIB143 | g1184773 | BLASTN | 1496 | 1e−146 | 95 |
| 2283 | 325 | LIB143-015-Q1-E1-F12 | LIB143 | g1184771 | BLASTN | 1855 | 1e−146 | 100 |
| 2284 | 325 | LIB3060-049-Q1-K1-H7 | LIB3060 | g1184771 | BLASTN | 1858 | 1e−146 | 99 |
| 2285 | 325 | LIB143-025-Q1-E1-H7 | LIB143 | g1184771 | BLASTN | 1413 | 1e−142 | 95 |
| 2286 | 325 | LIB84-027-Q1-E1-F5 | LIB84 | g22237 | BLASTN | 1654 | 1e−142 | 97 |
| 2287 | 325 | LIB36-003-Q1-E1-C2 | LIB36 | g1184771 | BLASTN | 1536 | 1e−141 | 96 |
| 2288 | 325 | LIB3067-032-Q1-K1-B12 | LIB3067 | g1184773 | BLASTN | 1121 | 1e−139 | 94 |
| 2289 | 325 | LIB3069-038-Q1-K1-F9 | LIB3069 | g22237 | BLASTN | 1372 | 1e−137 | 90 |
| 2290 | 325 | LIB3066-021-Q1-K1-G2 | LIB3066 | g1184773 | BLASTN | 1535 | 1e−136 | 94 |
| 2291 | 325 | LIB3069-043-Q1-K1-A1 | LIB3069 | g22237 | BLASTN | 1483 | 1e−134 | 93 |
| 2292 | 325 | LIB3060-020-Q1-K1-A12 | LIB3060 | g1184771 | BLASTN | 1110 | 1e−132 | 95 |
| 2293 | 325 | LIB143-014-Q1-E1-F8 | LIB143 | g1184773 | BLASTN | 1625 | 1e−130 | 93 |
| 2294 | 325 | LIB3066-021-Q1-K1-G3 | LIB3066 | g1184773 | BLASTN | 1221 | 1e−127 | 86 |
| 2295 | 325 | LIB3066-004-Q1-K1-G9 | LIB3066 | g1184771 | BLASTN | 1482 | 1e−125 | 91 |
| 2296 | 325 | LIB143-055-Q1-E1-B3 | LIB143 | g1184771 | BLASTN | 1503 | 1e−125 | 87 |
| 2297 | 325 | LIB3060-046-Q1-K1-C4 | LIB3060 | g1184771 | BLASTN | 1315 | 1e−124 | 95 |
| 2298 | 325 | LIB3060-012-Q1-K1-E9 | LIB3060 | g22237 | BLASTN | 1432 | 1e−123 | 94 |

TABLE A*-continued

| Seq No. | Cluster ID | CloneID | Library | NCBI gi | Method | Score | P-value | % Ident |
|---|---|---|---|---|---|---|---|---|
| 2299 | 325 | LIB3066-037-Q1-K1-A2 | LIB3066 | g1184771 | BLASTN | 837 | 1e−121 | 90 |
| 2300 | 325 | LIB3067-031-Q1-K1-G12 | LIB3067 | g1184773 | BLASTN | 923 | 1e−121 | 90 |
| 2301 | 325 | LIB143-049-Q1-E1-D6 | LIB143 | g1184771 | BLASTN | 1497 | 1e−119 | 99 |
| 2302 | 325 | LIB3060-022-Q1-K1-E7 | LIB3060 | g22237 | BLASTN | 1168 | 1e−117 | 89 |
| 2303 | 325 | LIB143-012-Q1-E1-C2 | LIB143 | g1184773 | BLASTN | 1501 | 1e−116 | 95 |
| 2304 | 325 | LIB36-006-Q1-E1-D9 | LIB36 | g22237 | BLASTN | 1464 | 1e−113 | 95 |
| 2305 | 325 | LIB3060-001-Q1-K2-C12 | LIB3060 | g1184771 | BLASTN | 981 | 1e−112 | 88 |
| 2306 | 325 | LIB143-063-Q1-E1-G8 | LIB143 | g1184773 | BLASTN | 1354 | 1e−110 | 87 |
| 2307 | 325 | LIB3060-028-Q1-K1-E1 | LIB3060 | g22237 | BLASTN | 613 | 1e−109 | 93 |
| 2308 | 325 | LIB3061-001-Q1-K2-H1 | LIB3061 | g1184771 | BLASTN | 743 | 1e−107 | 86 |
| 2309 | 325 | LIB143-017-Q1-E1-G4 | LIB143 | g1184773 | BLASTN | 1217 | 1e−107 | 92 |
| 2310 | 325 | 30-LIB84-007-Q1-E1-H5 | LIB84 | g1184771 | BLASTN | 988 | 1e−106 | 95 |
| 2311 | 325 | LIB3061-056-Q1-K1-F11 | LIB3061 | g1184773 | BLASTN | 1382 | 1e−106 | 89 |
| 2312 | 325 | LIB3062-023-Q1-K1-F7 | LIB3062 | g22237 | BLASTN | 1373 | 1e−105 | 79 |
| 2313 | 325 | LIB3068-055-Q1-K1-G2 | LIB3068 | g1184771 | BLASTN | 566 | 1e−101 | 90 |
| 2314 | 325 | LIB143-050-Q1-E1-C3 | LIB143 | g1184773 | BLASTN | 980 | 1e−100 | 87 |
| 2315 | 325 | LIB3061-005-Q1-K1-B3 | LIB3061 | g1184773 | BLASTN | 816 | 1e−99 | 92 |
| 2316 | 325 | LIB3068-051-Q1-K1-C5 | LIB3068 | g1184771 | BLASTN | 658 | 1e−95 | 96 |
| 2317 | 325 | LIB3068-021-Q1-K1-C5 | LIB3068 | g22237 | BLASTN | 1074 | 1e−92 | 94 |
| 2318 | 325 | LIB3059-002-Q1-K2-D11 | LIB3059 | g1184773 | BLASTN | 905 | 1e−91 | 86 |
| 2319 | 325 | LIB143-029-Q1-E1-E1 | LIB143 | g22237 | BLASTN | 979 | 1e−91 | 96 |
| 2320 | 325 | LIB3062-016-Q1-K1-E1 | LIB3062 | g1184775 | BLASTN | 1164 | 1e−91 | 98 |
| 2321 | 325 | LIB3062-035-Q1-K1-H4 | LIB3062 | g1184771 | BLASTN | 1058 | 1e−89 | 90 |
| 2322 | 325 | LIB189-023-Q1-E1-F1 | LIB189 | g22237 | BLASTN | 589 | 1e−88 | 87 |
| 2323 | 325 | LIB143-067-Q1-E1-H11 | LIB143 | g1184771 | BLASTN | 777 | 1e−84 | 88 |
| 2324 | 325 | LIB3061-024-Q1-K1-C11 | LIB3061 | g1184773 | BLASTN | 838 | 1e−78 | 94 |
| 2325 | 325 | LIB3068-041-Q1-K1-B11 | LIB3068 | g1184771 | BLASTN | 680 | 1e−77 | 95 |
| 2326 | 325 | LIB3068-026-Q1-K1-D5 | LIB3068 | g1184771 | BLASTN | 680 | 1e−69 | 94 |
| 2327 | 325 | LIB3061-012-Q1-K1-C11 | LIB3061 | g1184773 | BLASTN | 744 | 1e−66 | 87 |
| 2328 | 325 | LIB143-066-Q1-E1-H11 | LIB143 | g1184771 | BLASTN | 634 | 1e−64 | 93 |
| 2329 | 325 | LIB3059-004-Q1-K1-G1 | LIB3059 | g1184771 | BLASTN | 818 | 1e−59 | 93 |
| 2330 | 325 | LIB3069-053-Q1-K1-D10 | LIB3069 | g1184771 | BLASTN | 347 | 1e−46 | 89 |
| 2331 | 325 | LIB143-021-Q1-E1-E2 | LIB143 | g1184773 | BLASTN | 367 | 1e−35 | 90 |
| 2332 | 325 | LIB3062-057-Q1-K1-A8 | LIB3062 | g22237 | BLASTN | 536 | 1e−35 | 99 |
| 2333 | 325 | LIB189-019-Q1-E1-C5 | LIB189 | g1184773 | BLASTN | 485 | 1e−31 | 91 |
| 2334 | 325 | LIB143-037-Q1-E1-C8 | LIB143 | g22237 | BLASTN | 486 | 1e−31 | 98 |
| 2335 | 325 | LIB3059-012-Q1-K1-F6 | LIB3059 | g1184773 | BLASTN | 253 | 1e−12 | 98 |
| 2336 | 3520 | LIB3078-050-Q1-K1-G8 | LIB3078 | g168478 | BLASTN | 2101 | 1e−166 | 94 |

TABLE A*-continued

| Seq No. | Cluster ID | CloneID | Library | NCBI gi | Method | Score | P-value | % Ident |
|---|---|---|---|---|---|---|---|---|
| 2337 | 3520 | LIB3060-041-Q1-K1-E8 | LIB3060 | g22239 | BLASTN | 2038 | 1e−161 | 95 |
| 2338 | 3520 | LIB3078-055-Q1-K1-H5 | LIB3078 | g168478 | BLASTN | 1903 | 1e−149 | 92 |
| 2339 | 3520 | LIB3060-001-Q1-K2-A9 | LIB3060 | g168520 | BLASTN | 1862 | 1e−148 | 98 |
| 2340 | 3520 | LIB3060-043-Q1-K1-C11 | LIB3060 | g168520 | BLASTN | 1848 | 1e−147 | 97 |
| 2341 | 3520 | LIB3060-003-Q1-K1-D9 | LIB3060 | g168520 | BLASTN | 1853 | 1e−147 | 97 |
| 2342 | 3520 | LIB3060-041-Q1-K1-F6 | LIB3060 | g168520 | BLASTN | 1830 | 1e−145 | 97 |
| 2343 | 3520 | LIB3060-043-Q1-K1-F2 | LIB3060 | g168520 | BLASTN | 1327 | 1e−144 | 96 |
| 2344 | 3520 | LIB3060-047-Q1-K1-C9 | LIB3060 | g168520 | BLASTN | 1797 | 1e−143 | 97 |
| 2345 | 3520 | LIB84-017-Q1-E1-D3 | LIB84 | g168520 | BLASTN | 1536 | 1e−142 | 97 |
| 2346 | 3520 | LIB36-002-Q1-E1-B8 | LIB36 | g168520 | BLASTN | 1573 | 1e−142 | 97 |
| 2347 | 3520 | LIB3060-029-Q1-K1-B7 | LIB3060 | g168520 | BLASTN | 1675 | 1e−140 | 97 |
| 2348 | 3520 | LIB36-010-Q1-E1-C7 | LIB36 | g168520 | BLASTN | 1550 | 1e−139 | 96 |
| 2349 | 3520 | LIB3060-042-Q1-K1-A10 | LIB3060 | g168520 | BLASTN | 1601 | 1e−139 | 97 |
| 2350 | 3520 | LIB3060-018-Q1-K1-F11 | LIB3060 | g22239 | BLASTN | 1773 | 1e−139 | 95 |
| 2351 | 3520 | LIB36-003-Q1-E1-H7 | LIB36 | g22239 | BLASTN | 1523 | 1e−137 | 98 |
| 2352 | 3520 | LIB189-029-Q1-E1-F9 | LIB189 | g168520 | BLASTN | 1531 | 1e−136 | 96 |
| 2353 | 3520 | LIB36-006-Q1-E1-B1 | LIB36 | g168478 | BLASTN | 1118 | 1e−130 | 96 |
| 2354 | 3520 | LIB3060-021-Q1-K1-F4 | LIB3060 | g168520 | BLASTN | 1627 | 1e−129 | 96 |
| 2355 | 3520 | LIB3060-037-Q1-K1-B6 | LIB3060 | g168520 | BLASTN | 1625 | 1e−128 | 95 |
| 2356 | 3520 | LIB84-003-Q1-E1-C1 | LIB84 | g168520 | BLASTN | 726 | 1e−121 | 92 |
| 2357 | 3520 | LIB36-021-Q1-E1-H3 | LIB36 | g168520 | BLASTN | 1537 | 1e−121 | 97 |
| 2358 | 3520 | LIB3078-056-Q1-K1-G1 | LIB3078 | g22239 | BLASTN | 1539 | 1e−119 | 96 |
| 2359 | 3520 | LIB3060-025-Q1-K1-B12 | LIB3060 | g168520 | BLASTN | 1416 | 1e−118 | 96 |
| 2360 | 3520 | LIB189-004-Q1-E1-F9 | LIB189 | g168520 | BLASTN | 1499 | 1e−118 | 88 |
| 2361 | 3520 | LIB3060-035-Q1-K1-A11 | LIB3060 | g168520 | BLASTN | 1339 | 1e−117 | 96 |
| 2362 | 3520 | LIB3078-004-Q1-K1-D8 | LIB3078 | g22239 | BLASTN | 1256 | 1e−116 | 91 |
| 2363 | 3520 | LIB36-009-Q1-E1-H1 | LIB36 | g168478 | BLASTN | 1318 | 1e−115 | 98 |
| 2364 | 3520 | LIB3060-013-Q1-K1-F8 | LIB3060 | g168478 | BLASTN | 1205 | 1e−112 | 92 |
| 2365 | 3520 | LIB3060-041-Q1-K1-G11 | LIB3060 | g168520 | BLASTN | 1332 | 1e−104 | 84 |
| 2366 | 3520 | LIB3060-018-Q1-K1-F10 | LIB3060 | g22239 | BLASTN | 718 | 1e−100 | 90 |
| 2367 | 3520 | LIB3060-008-Q1-K1-F1 | LIB3060 | g168520 | BLASTN | 532 | 1e−36 | 83 |
| 2368 | 3520 | LIB3060-039-Q1-K1-E4 | LIB3060 | g168520 | BLASTN | 441 | 1e−35 | 88 |
| 2369 | 5609 | LIB3060-016-Q1-K1-F3 | LIB3060 | g22239 | BLASTN | 787 | 1e−99 | 78 |
| 2370 | 5609 | LIB36-020-Q1-E1-A6 | LIB36 | g168478 | BLASTN | 756 | 1e−91 | 81 |
| 2371 | 5609 | LIB189-011-Q1-E1-H7 | LIB189 | g2331136 | BLASTN | 945 | 1e−90 | 77 |
| 2372 | 5609 | LIB36-019-Q1-E1-B10 | LIB36 | g168478 | BLASTN | 950 | 1e−90 | 77 |
| 2373 | 5609 | LIB3060-049-Q1-K1-A12 | LIB3060 | g336389 | BLASTN | 1076 | 1e−80 | 73 |
| 2374 | 5609 | LIB36-021-Q1-E1-H8 | LIB36 | g168478 | BLASTN | 926 | 1e−76 | 79 |

TABLE A*-continued

| Seq No. | Cluster ID | CloneID | Library | NCBI gi | Method | Score | P-value | % Ident |
|---|---|---|---|---|---|---|---|---|
| 2375 | 5609 | LIB84-028-Q1-E1-H5 | LIB84 | g21251 | BLASTN | 866 | 1e−66 | 77 |
| 2376 | 5609 | LIB3060-036-Q1-K1-B9 | LIB3060 | g21251 | BLASTN | 827 | 1e−60 | 70 |
| 2377 | 5609 | LIB36-001-Q1-E1-A3 | LIB36 | g168478 | BLASTN | 680 | 1e−58 | 86 |
| 2378 | 5609 | LIB189-017-Q1-E1-C6 | LIB189 | g21252 | BLASTX | 228 | 1e−52 | 68 |
| 2379 | 5609 | LIB189-015-Q1-E1-C5 | LIB189 | g168478 | BLASTN | 430 | 1e−51 | 75 |
| 2380 | 5609 | LIB3060-035-Q1-K1-F2 | LIB3060 | g21252 | BLASTX | 215 | 1e−49 | 72 |
| 2381 | 5609 | LIB36-003-Q1-E1-D2 | LIB36 | g21252 | BLASTX | 222 | 1e−43 | 76 |
| 2382 | 5609 | LIB3060-023-Q1-K1-D9 | LIB3060 | g21252 | BLASTX | 105 | 1e−41 | 68 |
| 2383 | 5609 | LIB3060-018-Q1-K1-E11 | LIB3060 | g168520 | BLASTN | 254 | 1e−26 | 75 |
| MAIZE PUTATIVE GLYCERALDEHYDE 3-PHOSPHATE DEHYDROGENASE | | | | | | | | |
| 2384 | 5609 | 700043392H1 | SATMON004 | g168567 | BLASTN | 926 | 1e−70 | 98 |
| 2385 | 5609 | 700041871H1 | SATMON004 | g168567 | BLASTN | 738 | 1e−54 | 99 |
| 2386 | 5609 | 700426511H1 | SATMONN01 | g168567 | BLASTN | 625 | 1e−45 | 100 |
| 2387 | 5609 | 700044710H1 | SATMON004 | g168567 | BLASTN | 570 | 1e−40 | 100 |
| 2388 | 5609 | 700216320H1 | SATMON016 | g168567 | BLASTN | 571 | 1e−40 | 99 |
| 2389 | 5609 | 700216328H1 | SATMON016 | g168567 | BLASTN | 413 | 1e−26 | 98 |
| 2390 | 5609 | LIB36-006-Q1-E1-A7 | LIB36 | g168567 | BLASTN | 931 | 1e−70 | 99 |
| 2391 | 5609 | LIB189-010-Q1-E1-F11 | LIB189 | g168567 | BLASTN | 915 | 1e−69 | 98 |
| 2392 | 5609 | LIB83-006-Q1-E1-H8 | LIB83 | g168567 | BLASTN | 917 | 1e−69 | 98 |
| 2393 | 5609 | LIB36-017-Q1-E1-A1 | LIB36 | g168567 | BLASTN | 486 | 1e−68 | 96 |
| 2394 | 5609 | LIB3078-014-Q1-K1-H3 | LIB3078 | g168567 | BLASTN | 906 | 1e−68 | 97 |
| 2395 | 5609 | LIB189-022-Q1-E1-H11 | LIB189 | g168567 | BLASTN | 931 | 1e−70 | 99 |
| 2396 | 5609 | LIB3078-002-Q1-K1-B8 | LIB3078 | g168567 | BLASTN | 880 | 1e−66 | 97 |
| SOYBEAN GLYCERALDEHYDE 3-PHOSPHATE DEHYDROGENASE | | | | | | | | |
| 2397 | -700556687 | 700556687H1 | SOYMON001 | g2905771 | BLASTN | 315 | 1e−27 | 91 |
| 2398 | -700652993 | 700652993H1 | SOYMON003 | g20732 | BLASTN | 538 | 1e−34 | 84 |
| 2399 | -700669859 | 700669859H1 | SOYMON006 | g19565 | BLASTN | 404 | 1e−24 | 78 |
| 2400 | -700682023 | 700682023H1 | SOYMON008 | g1184775 | BLASTN | 659 | 1e−89 | 95 |
| 2401 | -700739645 | 700739645H1 | SOYMON012 | g20732 | BLASTN | 906 | 1e−70 | 91 |
| 2402 | -700744137 | 700744137H1 | SOYMON013 | g12158 | BLASTN | 344 | 1e−32 | 77 |
| 2403 | -700749096 | 700749096H1 | SOYMON013 | g425795 | BLASTN | 337 | 1e−17 | 75 |
| 2404 | -700763386 | 700763386H1 | SOYMON015 | g20550 | BLASTN | 560 | 1e−37 | 80 |
| 2405 | -700854894 | 700854894H1 | SOYMON023 | g1184771 | BLASTN | 300 | 1e−19 | 79 |
| 2406 | -700870634 | 700870634H1 | SOYMON018 | g20728 | BLASTN | 374 | 1e−21 | 68 |
| 2407 | -700871731 | 700871731H1 | SOYMON018 | g309671 | BLASTX | 76 | 1e−8 | 49 |
| 2408 | -700891638 | 700891638H1 | SOYMON024 | g496493 | BLASTN | 771 | 1e−55 | 82 |
| 2409 | -700954983 | 700954983H1 | SOYMON022 | g1185556 | BLASTX | 131 | 1e−17 | 86 |
| 2410 | -700961364 | 700961364H1 | SOYMON022 | g20732 | BLASTN | 267 | 1e−11 | 88 |
| 2411 | -700961396 | 700961396H1 | SOYMON022 | g20732 | BLASTN | 330 | 1e−17 | 87 |
| 2412 | -700963442 | 700963442H1 | SOYMON022 | g169090 | BLASTN | 485 | 1e−31 | 77 |
| 2413 | -700984474 | 700984474H1 | SOYMON009 | g167293 | BLASTN | 432 | 1e−51 | 81 |
| 2414 | -700989533 | 700989533H1 | SOYMON011 | g496493 | BLASTN | 1057 | 1e−79 | 90 |
| 2415 | -700990284 | 700990284H1 | SOYMON011 | g2331137 | BLASTX | 177 | 1e−17 | 88 |
| 2416 | -700991120 | 700991120H1 | SOYMON011 | g2905771 | BLASTX | 262 | 1e−11 | 96 |
| 2417 | -700991826 | 700991826H1 | SOYMON011 | g20732 | BLASTN | 344 | 1e−29 | 71 |
| 2418 | -700993359 | 700993359H1 | SOYMON011 | g19565 | BLASTN | 620 | 1e−42 | 76 |
| 2419 | -701000288 | 701000288H1 | SOYMON018 | g20728 | BLASTN | 550 | 1e−43 | 77 |
| 2420 | -701049142 | 701049142H1 | SOYMON032 | g3059121 | BLASTN | 612 | 1e−42 | 67 |
| 2421 | -701049262 | 701049262H1 | SOYMON032 | g1100222 | BLASTN | 781 | 1e−56 | 77 |
| 2422 | -701064532 | 701064532H1 | SOYMON034 | g19565 | BLASTN | 345 | 1e−19 | 87 |
| 2423 | -701107753 | 701107753H1 | SOYMON036 | g496493 | BLASTN | 773 | 1e−55 | 77 |
| 2424 | -701128594 | 701128594H1 | SOYMON037 | g19565 | BLASTN | 489 | 1e−31 | 83 |
| 2425 | -701140262 | 701140262H1 | SOYMON038 | g169090 | BLASTN | 449 | 1e−28 | 85 |
| 2426 | -701146678 | 701146678H1 | SOYMON031 | g2078298 | BLASTN | 52 | 1e−10 | 66 |
| 2427 | -701151833 | 701151833H1 | SOYMON031 | g1931618 | BLASTN | 567 | 1e−38 | 81 |
| 2428 | -701203691 | 701203691H2 | SOYMON035 | g169090 | BLASTN | 264 | 1e−11 | 87 |
| 2429 | -701208478 | 701208478H1 | SOYMON035 | g169090 | BLASTN | 262 | 1e−22 | 69 |
| 2430 | 1061 | 700763870H1 | SOYMON018 | g20728 | BLASTN | 1054 | 1e−91 | 88 |
| 2431 | 1061 | 700556966H1 | SOYMON001 | g20728 | BLASTN | 1199 | 1e−91 | 91 |

TABLE A*-continued

| Seq No. | Cluster ID | CloneID | Library | NCBI gi | Method | Score | P-value | % Ident |
|---|---|---|---|---|---|---|---|---|
| 2432 | 1061 | 700980735H1 | SOYMON009 | g20728 | BLASTN | 1140 | 1e−86 | 89 |
| 2433 | 1061 | 700983864H1 | SOYMON009 | g20728 | BLASTN | 1147 | 1e−86 | 88 |
| 2434 | 1061 | 700786535H1 | SOYMON011 | g12158 | BLASTN | 1086 | 1e−81 | 86 |
| 2435 | 1061 | 700728027H1 | SOYMON009 | g20728 | BLASTN | 767 | 1e−79 | 89 |
| 2436 | 1061 | 700684426H1 | SOYMON008 | g20728 | BLASTN | 1045 | 1e−78 | 90 |
| 2437 | 1061 | 700559635H1 | SOYMON001 | g20728 | BLASTN | 799 | 1e−77 | 85 |
| 2438 | 1061 | 700555476H1 | SOYMON001 | g20728 | BLASTN | 891 | 1e−77 | 87 |
| 2439 | 1061 | 700876005H1 | SOYMON018 | g20728 | BLASTN | 595 | 1e−76 | 88 |
| 2440 | 1061 | 700646201H1 | SOYMON012 | g12158 | BLASTN | 784 | 1e−75 | 88 |
| 2441 | 1061 | 700873429H1 | SOYMON018 | g20728 | BLASTN | 853 | 1e−75 | 88 |
| 2442 | 1061 | 700685875H1 | SOYMON008 | g20728 | BLASTN | 894 | 1e−75 | 89 |
| 2443 | 1061 | 700554131H1 | SOYMON001 | g20728 | BLASTN | 925 | 1e−75 | 88 |
| 2444 | 1061 | 700686559H1 | SOYMON008 | g20728 | BLASTN | 1012 | 1e−75 | 86 |
| 2445 | 1061 | 700873329H1 | SOYMON018 | g20728 | BLASTN | 1013 | 1e−75 | 89 |
| 2446 | 1061 | 701061532H1 | SOYMON033 | g20728 | BLASTN | 1017 | 1e−75 | 88 |
| 2447 | 1061 | 700876258H1 | SOYMON018 | g20728 | BLASTN | 562 | 1e−73 | 91 |
| 2448 | 1061 | 700991748H1 | SOYMON011 | g20728 | BLASTN | 646 | 1e−73 | 85 |
| 2449 | 1061 | 700752804H1 | SOYMON014 | g20728 | BLASTN | 984 | 1e−73 | 86 |
| 2450 | 1061 | 700873301H1 | SOYMON018 | g20728 | BLASTN | 988 | 1e−73 | 87 |
| 2451 | 1061 | 700977867H1 | SOYMON009 | g20728 | BLASTN | 974 | 1e−72 | 86 |
| 2452 | 1061 | 700558508H1 | SOYMON001 | g12158 | BLASTN | 562 | 1e−71 | 85 |
| 2453 | 1061 | 700558346H1 | SOYMON001 | g12158 | BLASTN | 800 | 1e−71 | 89 |
| 2454 | 1061 | 701104595H1 | SOYMON036 | g20728 | BLASTN | 958 | 1e−71 | 85 |
| 2455 | 1061 | 701107372H1 | SOYMON036 | g20728 | BLASTN | 959 | 1e−71 | 83 |
| 2456 | 1061 | 700877182H1 | SOYMON018 | g20728 | BLASTN | 963 | 1e−71 | 85 |
| 2457 | 1061 | 700682345H2 | SOYMON008 | g20728 | BLASTN | 965 | 1e−71 | 87 |
| 2458 | 1061 | 700999844H1 | SOYMON018 | g20728 | BLASTN | 965 | 1e−71 | 85 |
| 2459 | 1061 | 700962204H1 | SOYMON022 | g12158 | BLASTN | 968 | 1e−71 | 85 |
| 2460 | 1061 | 700962351H1 | SOYMON022 | g20728 | BLASTN | 525 | 1e−69 | 86 |
| 2461 | 1061 | 700743037H1 | SOYMON012 | g20728 | BLASTN | 563 | 1e−69 | 85 |
| 2462 | 1061 | 700975367H1 | SOYMON009 | g20728 | BLASTN | 938 | 1e−69 | 84 |
| 2463 | 1061 | 700844411H1 | SOYMON021 | g20728 | BLASTN | 944 | 1e−69 | 92 |
| 2464 | 1061 | 700891407H1 | SOYMON024 | g12158 | BLASTN | 946 | 1e−69 | 87 |
| 2465 | 1061 | 700556475H1 | SOYMON001 | g20728 | BLASTN | 743 | 1e−68 | 85 |
| 2466 | 1061 | 700739632H1 | SOYMON012 | g20728 | BLASTN | 849 | 1e−68 | 83 |
| 2467 | 1061 | 700752141H1 | SOYMON014 | g12158 | BLASTN | 928 | 1e−68 | 85 |
| 2468 | 1061 | 700654954H1 | SOYMON004 | g20728 | BLASTN | 932 | 1e−68 | 83 |
| 2469 | 1061 | 700874388H1 | SOYMON018 | g12158 | BLASTN | 932 | 1e−68 | 88 |
| 2470 | 1061 | 701156507H1 | SOYMON031 | g20728 | BLASTN | 485 | 1e−67 | 88 |
| 2471 | 1061 | 700646112H1 | SOYMON012 | g20728 | BLASTN | 715 | 1e−67 | 86 |
| 2472 | 1061 | 700873965H1 | SOYMON018 | g20728 | BLASTN | 911 | 1e−67 | 85 |
| 2473 | 1061 | 700741948H1 | SOYMON012 | g20728 | BLASTN | 898 | 1e−66 | 86 |
| 2474 | 1061 | 700875513H1 | SOYMON018 | g20728 | BLASTN | 900 | 1e−66 | 87 |
| 2475 | 1061 | 700874967H1 | SOYMON018 | g20728 | BLASTN | 546 | 1e−65 | 86 |
| 2476 | 1061 | 700559242H1 | SOYMON001 | g20728 | BLASTN | 743 | 1e−65 | 84 |
| 2477 | 1061 | 700559801H1 | SOYMON001 | g20728 | BLASTN | 743 | 1e−65 | 84 |
| 2478 | 1061 | 700659588H1 | SOYMON004 | g12158 | BLASTN | 888 | 1e−65 | 84 |
| 2479 | 1061 | 700725516H1 | SOYMON009 | g12158 | BLASTN | 495 | 1e−64 | 87 |
| 2480 | 1061 | 700901411H1 | SOYMON027 | g20728 | BLASTN | 793 | 1e−64 | 87 |
| 2481 | 1061 | 700790272H2 | SOYMON011 | g12158 | BLASTN | 883 | 1e−64 | 84 |
| 2482 | 1061 | 700942783H1 | SOYMON024 | g12158 | BLASTN | 507 | 1e−63 | 86 |
| 2483 | 1061 | 700876055H1 | SOYMON018 | g20728 | BLASTN | 535 | 1e−63 | 85 |
| 2484 | 1061 | 700554719H1 | SOYMON001 | g20728 | BLASTN | 726 | 1e−63 | 85 |
| 2485 | 1061 | 700993112H1 | SOYMON011 | g20728 | BLASTN | 402 | 1e−62 | 85 |
| 2486 | 1061 | 700684688H1 | SOYMON008 | g12158 | BLASTN | 519 | 1e−62 | 84 |
| 2487 | 1061 | 700890177H1 | SOYMON024 | g20728 | BLASTN | 579 | 1e−62 | 85 |
| 2488 | 1061 | 700554380H1 | SOYMON001 | g20728 | BLASTN | 712 | 1e−62 | 84 |
| 2489 | 1061 | 700876338H1 | SOYMON018 | g12158 | BLASTN | 856 | 1e−62 | 86 |
| 2490 | 1061 | 700993901H1 | SOYMON011 | g20728 | BLASTN | 583 | 1e−61 | 88 |
| 2491 | 1061 | 701103760H1 | SOYMON036 | g20728 | BLASTN | 843 | 1e−61 | 80 |
| 2492 | 1061 | 700684581H1 | SOYMON008 | g12158 | BLASTN | 850 | 1e−61 | 83 |
| 2493 | 1061 | 701049681H1 | SOYMON032 | g20728 | BLASTN | 545 | 1e−60 | 84 |
| 2494 | 1061 | 700681925H1 | SOYMON008 | g20728 | BLASTN | 355 | 1e−59 | 81 |
| 2495 | 1061 | 700680184H2 | SOYMON008 | g20728 | BLASTN | 478 | 1e−59 | 85 |
| 2496 | 1061 | 701108645H1 | SOYMON036 | g12158 | BLASTN | 775 | 1e−55 | 85 |
| 2497 | 1061 | 701106940H1 | SOYMON036 | g12158 | BLASTN | 775 | 1e−55 | 85 |
| 2498 | 1061 | 700984503H1 | SOYMON009 | g20728 | BLASTN | 516 | 1e−54 | 83 |
| 2499 | 1061 | 700738754H1 | SOYMON012 | g166701 | BLASTN | 759 | 1e−54 | 78 |
| 2500 | 1061 | 700685581H1 | SOYMON008 | g12158 | BLASTN | 375 | 1e−53 | 85 |
| 2501 | 1061 | 700977296H1 | SOYMON009 | g12158 | BLASTN | 470 | 1e−53 | 82 |
| 2502 | 1061 | 700999412H1 | SOYMON018 | g166701 | BLASTN | 617 | 1e−53 | 80 |
| 2503 | 1061 | 700898819H1 | SOYMON027 | g12158 | BLASTN | 722 | 1e−53 | 81 |
| 2504 | 1061 | 700994354H1 | SOYMON011 | g20728 | BLASTN | 743 | 1e−53 | 85 |
| 2505 | 1061 | 700685709H1 | SOYMON008 | g20728 | BLASTN | 743 | 1e−53 | 85 |
| 2506 | 1061 | 700738315H1 | SOYMON012 | g20728 | BLASTN | 743 | 1e−53 | 85 |
| 2507 | 1061 | 700873275H1 | SOYMON018 | g20728 | BLASTN | 743 | 1e−53 | 85 |
| 2508 | 1061 | 700555226H1 | SOYMON001 | g20728 | BLASTN | 743 | 1e−53 | 85 |

TABLE A*-continued

| Seq No. | Cluster ID | CloneID | Library | NCBI gi | Method | Score | P-value | % Ident |
|---|---|---|---|---|---|---|---|---|
| 2509 | 1061 | 700892169H1 | SOYMON024 | g20728 | BLASTN | 743 | 1e−53 | 85 |
| 2510 | 1061 | 701107458H1 | SOYMON036 | g20728 | BLASTN | 743 | 1e−53 | 85 |
| 2511 | 1061 | 701047451H1 | SOYMON032 | g20728 | BLASTN | 743 | 1e−53 | 85 |
| 2512 | 1061 | 700994065H1 | SOYMON011 | g20728 | BLASTN | 744 | 1e−53 | 86 |
| 2513 | 1061 | 700968347H1 | SOYMON036 | g20728 | BLASTN | 746 | 1e−53 | 85 |
| 2514 | 1061 | 700740108H1 | SOYMON012 | g20728 | BLASTN | 732 | 1e−52 | 88 |
| 2515 | 1061 | 700556578H1 | SOYMON001 | g20728 | BLASTN | 735 | 1e−52 | 86 |
| 2516 | 1061 | 700646223H1 | SOYMON012 | g20728 | BLASTN | 735 | 1e−52 | 86 |
| 2517 | 1061 | 700686442H1 | SOYMON008 | g20728 | BLASTN | 735 | 1e−52 | 86 |
| 2518 | 1061 | 700995540H1 | SOYMON011 | g20728 | BLASTN | 735 | 1e−52 | 86 |
| 2519 | 1061 | 700997359H1 | SOYMON018 | g20728 | BLASTN | 735 | 1e−52 | 86 |
| 2520 | 1061 | 700863529H1 | SOYMON027 | g20728 | BLASTN | 735 | 1e−52 | 86 |
| 2521 | 1061 | 700874946H1 | SOYMON018 | g20728 | BLASTN | 735 | 1e−52 | 86 |
| 2522 | 1061 | 700789664H2 | SOYMON011 | g20728 | BLASTN | 735 | 1e−52 | 86 |
| 2523 | 1061 | 700559731H1 | SOYMON001 | g20728 | BLASTN | 735 | 1e−52 | 86 |
| 2524 | 1061 | 701141680H1 | SOYMON038 | g20728 | BLASTN | 735 | 1e−52 | 86 |
| 2525 | 1061 | 700555668H1 | SOYMON001 | g20728 | BLASTN | 735 | 1e−52 | 86 |
| 2526 | 1061 | 700553965H1 | SOYMON001 | g20728 | BLASTN | 735 | 1e−52 | 86 |
| 2527 | 1061 | 700989276H1 | SOYMON011 | g20728 | BLASTN | 735 | 1e−52 | 86 |
| 2528 | 1061 | 701213488H1 | SOYMON035 | g20728 | BLASTN | 735 | 1e−52 | 86 |
| 2529 | 1061 | 701120382H1 | SOYMON037 | g20728 | BLASTN | 735 | 1e−52 | 86 |
| 2530 | 1061 | 700740875H1 | SOYMON012 | g20728 | BLASTN | 735 | 1e−52 | 86 |
| 2531 | 1061 | 700741835H1 | SOYMON012 | g20728 | BLASTN | 736 | 1e−52 | 85 |
| 2532 | 1061 | 700995653H1 | SOYMON011 | g20728 | BLASTN | 736 | 1e−52 | 85 |
| 2533 | 1061 | 700906218H1 | SOYMON022 | g20728 | BLASTN | 736 | 1e−52 | 85 |
| 2534 | 1061 | 700684347H1 | SOYMON008 | g20728 | BLASTN | 736 | 1e−52 | 85 |
| 2535 | 1061 | 700728605H1 | SOYMON009 | g20728 | BLASTN | 737 | 1e−52 | 86 |
| 2536 | 1061 | 700789578H2 | SOYMON011 | g20728 | BLASTN | 740 | 1e−52 | 87 |
| 2537 | 1061 | 700787421H2 | SOYMON011 | g20728 | BLASTN | 718 | 1e−51 | 84 |
| 2538 | 1061 | 700560934H1 | SOYMON001 | g20728 | BLASTN | 719 | 1e−51 | 84 |
| 2539 | 1061 | 700876650H1 | SOYMON018 | g20728 | BLASTN | 722 | 1e−51 | 84 |
| 2540 | 1061 | 700740868H1 | SOYMON012 | g20728 | BLASTN | 722 | 1e−51 | 84 |
| 2541 | 1061 | 700741374H1 | SOYMON012 | g20728 | BLASTN | 722 | 1e−51 | 84 |
| 2542 | 1061 | 700994074H1 | SOYMON011 | g20728 | BLASTN | 723 | 1e−51 | 86 |
| 2543 | 1061 | 701109502H1 | SOYMON036 | g20728 | BLASTN | 728 | 1e−51 | 86 |
| 2544 | 1061 | 700875104H1 | SOYMON018 | g20728 | BLASTN | 728 | 1e−51 | 86 |
| 2545 | 1061 | 700786270H2 | SOYMON011 | g20728 | BLASTN | 728 | 1e−51 | 86 |
| 2546 | 1061 | 700556484H1 | SOYMON001 | g20728 | BLASTN | 729 | 1e−51 | 84 |
| 2547 | 1061 | 700998979H1 | SOYMON018 | g20728 | BLASTN | 729 | 1e−51 | 84 |
| 2548 | 1061 | 701109358H1 | SOYMON036 | g20728 | BLASTN | 729 | 1e−51 | 84 |
| 2549 | 1061 | 700763760H1 | SOYMON018 | g12158 | BLASTN | 730 | 1e−51 | 83 |
| 2550 | 1061 | 701001681H1 | SOYMON018 | g20728 | BLASTN | 422 | 1e−50 | 85 |
| 2551 | 1061 | 700991945H1 | SOYMON011 | g20728 | BLASTN | 706 | 1e−50 | 83 |
| 2552 | 1061 | 700789781H1 | SOYMON011 | g20728 | BLASTN | 709 | 1e−50 | 87 |
| 2553 | 1061 | 700554372H1 | SOYMON001 | g20728 | BLASTN | 709 | 1e−50 | 83 |
| 2554 | 1061 | 700993753H1 | SOYMON011 | g12158 | BLASTN | 709 | 1e−50 | 87 |
| 2555 | 1061 | 700876992H1 | SOYMON018 | g20728 | BLASTN | 714 | 1e−50 | 85 |
| 2556 | 1061 | 700960223H1 | SOYMON022 | g20728 | BLASTN | 714 | 1e−50 | 85 |
| 2557 | 1061 | 700686495H1 | SOYMON008 | g20728 | BLASTN | 717 | 1e−50 | 85 |
| 2558 | 1061 | 700557711H1 | SOYMON001 | g20728 | BLASTN | 469 | 1e−49 | 83 |
| 2559 | 1061 | 700984028H1 | SOYMON009 | g20728 | BLASTN | 560 | 1e−49 | 82 |
| 2560 | 1061 | 700556584H1 | SOYMON001 | g20728 | BLASTN | 563 | 1e−49 | 86 |
| 2561 | 1061 | 700870942H1 | SOYMON018 | g20728 | BLASTN | 576 | 1e−49 | 78 |
| 2562 | 1061 | 700871710H1 | SOYMON018 | g166701 | BLASTN | 695 | 1e−49 | 79 |
| 2563 | 1061 | 700738589H1 | SOYMON012 | g20728 | BLASTN | 697 | 1e−49 | 86 |
| 2564 | 1061 | 700738856H1 | SOYMON012 | g20728 | BLASTN | 704 | 1e−49 | 86 |
| 2565 | 1061 | 701002335H1 | SOYMON018 | g20728 | BLASTN | 704 | 1e−49 | 85 |
| 2566 | 1061 | 701001628H1 | SOYMON018 | g20728 | BLASTN | 704 | 1e−49 | 85 |
| 2567 | 1061 | 700787485H2 | SOYMON011 | g20728 | BLASTN | 415 | 1e−48 | 83 |
| 2568 | 1061 | 700683818H1 | SOYMON008 | g12158 | BLASTN | 442 | 1e−48 | 82 |
| 2569 | 1061 | 700554247H1 | SOYMON001 | g20728 | BLASTN | 480 | 1e−48 | 84 |
| 2570 | 1061 | 700744021H1 | SOYMON012 | g20728 | BLASTN | 554 | 1e−48 | 84 |
| 2571 | 1061 | 700787533H1 | SOYMON011 | g20728 | BLASTN | 573 | 1e−48 | 84 |
| 2572 | 1061 | 700985942H1 | SOYMON009 | g20728 | BLASTN | 598 | 1e−48 | 85 |
| 2573 | 1061 | 701104728H1 | SOYMON036 | g20728 | BLASTN | 609 | 1e−48 | 83 |
| 2574 | 1061 | 700988933H1 | SOYMON011 | g20728 | BLASTN | 637 | 1e−48 | 85 |
| 2575 | 1061 | 701109795H1 | SOYMON036 | g20728 | BLASTN | 644 | 1e−48 | 87 |
| 2576 | 1061 | 700984329H1 | SOYMON009 | g20728 | BLASTN | 655 | 1e−48 | 86 |
| 2577 | 1061 | 701000601H1 | SOYMON018 | g20728 | BLASTN | 682 | 1e−48 | 86 |
| 2578 | 1061 | 700686572H1 | SOYMON008 | g20728 | BLASTN | 684 | 1e−48 | 86 |
| 2579 | 1061 | 700791971H1 | SOYMON011 | g20728 | BLASTN | 692 | 1e−48 | 86 |
| 2580 | 1061 | 700740621H1 | SOYMON012 | g20728 | BLASTN | 343 | 1e−47 | 84 |
| 2581 | 1061 | 700994492H1 | SOYMON011 | g20728 | BLASTN | 413 | 1e−47 | 86 |
| 2582 | 1061 | 701108677H1 | SOYMON036 | g20728 | BLASTN | 553 | 1e−47 | 85 |
| 2583 | 1061 | 700740371H1 | SOYMON012 | g12158 | BLASTN | 640 | 1e−47 | 84 |
| 2584 | 1061 | 700737944H1 | SOYMON012 | g20728 | BLASTN | 670 | 1e−47 | 81 |
| 2585 | 1061 | 700788840H2 | SOYMON011 | g20728 | BLASTN | 676 | 1e−47 | 87 |

TABLE A*-continued

| Seq No. | Cluster ID | CloneID | Library | NCBI gi | Method | Score | P-value | % Ident |
|---|---|---|---|---|---|---|---|---|
| 2586 | 1061 | 700741626H1 | SOYMON012 | g20728 | BLASTN | 676 | 1e-47 | 87 |
| 2587 | 1061 | 700789225H2 | SOYMON011 | g20728 | BLASTN | 339 | 1e-46 | 87 |
| 2588 | 1061 | 700548027H1 | SOYMON001 | g20728 | BLASTN | 368 | 1e-46 | 88 |
| 2589 | 1061 | 701070385H1 | SOYMON034 | g20728 | BLASTN | 370 | 1e-46 | 87 |
| 2590 | 1061 | 700681469H2 | SOYMON008 | g20728 | BLASTN | 411 | 1e-46 | 85 |
| 2591 | 1061 | 700548037H1 | SOYMON001 | g20728 | BLASTN | 526 | 1e-46 | 87 |
| 2592 | 1061 | 700646084H1 | SOYMON011 | g12158 | BLASTN | 564 | 1e-46 | 79 |
| 2593 | 1061 | 700752275H1 | SOYMON014 | g20728 | BLASTN | 629 | 1e-46 | 85 |
| 2594 | 1061 | 700683806H1 | SOYMON008 | g20728 | BLASTN | 660 | 1e-46 | 88 |
| 2595 | 1061 | 700654909H1 | SOYMON004 | g12158 | BLASTN | 666 | 1e-46 | 80 |
| 2596 | 1061 | 700986823H1 | SOYMON009 | g20728 | BLASTN | 667 | 1e-46 | 81 |
| 2597 | 1061 | 700741156H1 | SOYMON012 | g20728 | BLASTN | 304 | 1e-45 | 87 |
| 2598 | 1061 | 700906879H1 | SOYMON022 | g20728 | BLASTN | 398 | 1e-45 | 85 |
| 2599 | 1061 | 700875004H1 | SOYMON018 | g12158 | BLASTN | 647 | 1e-45 | 86 |
| 2600 | 1061 | 700996131H1 | SOYMON018 | g20728 | BLASTN | 648 | 1e-45 | 86 |
| 2601 | 1061 | 700873575H1 | SOYMON018 | g20728 | BLASTN | 648 | 1e-45 | 81 |
| 2602 | 1061 | 700990142H1 | SOYMON011 | g20728 | BLASTN | 648 | 1e-45 | 86 |
| 2603 | 1061 | 700981885H1 | SOYMON009 | g12158 | BLASTN | 651 | 1e-45 | 80 |
| 2604 | 1061 | 700874783H1 | SOYMON018 | g20728 | BLASTN | 653 | 1e-45 | 86 |
| 2605 | 1061 | 701110202H1 | SOYMON036 | g20728 | BLASTN | 656 | 1e-45 | 81 |
| 2606 | 1061 | 700683388H1 | SOYMON008 | g20728 | BLASTN | 640 | 1e-44 | 84 |
| 2607 | 1061 | 700875643H1 | SOYMON018 | g20728 | BLASTN | 643 | 1e-44 | 85 |
| 2608 | 1061 | 701001467H1 | SOYMON018 | g20728 | BLASTN | 414 | 1e-43 | 83 |
| 2609 | 1061 | 700787152H2 | SOYMON011 | g20728 | BLASTN | 428 | 1e-43 | 82 |
| 2610 | 1061 | 700683930H1 | SOYMON008 | g20728 | BLASTN | 339 | 1e-42 | 86 |
| 2611 | 1061 | 700740930H1 | SOYMON012 | g20728 | BLASTN | 367 | 1e-42 | 85 |
| 2612 | 1061 | 700787113H2 | SOYMON011 | g20728 | BLASTN | 394 | 1e-42 | 78 |
| 2613 | 1061 | 700739178H1 | SOYMON012 | g20728 | BLASTN | 415 | 1e-42 | 86 |
| 2614 | 1061 | 700986609H1 | SOYMON009 | g20728 | BLASTN | 529 | 1e-42 | 85 |
| 2615 | 1061 | 700683409H1 | SOYMON008 | g12158 | BLASTN | 582 | 1e-42 | 81 |
| 2616 | 1061 | 700743479H1 | SOYMON012 | g20728 | BLASTN | 545 | 1e-41 | 87 |
| 2617 | 1061 | 700681635H1 | SOYMON008 | g20728 | BLASTN | 553 | 1e-41 | 80 |
| 2618 | 1061 | 701109104H1 | SOYMON036 | g12158 | BLASTN | 596 | 1e-40 | 81 |
| 2619 | 1061 | 700871765H1 | SOYMON018 | g20728 | BLASTN | 578 | 1e-39 | 84 |
| 2620 | 1061 | 700992456H1 | SOYMON011 | g20728 | BLASTN | 403 | 1e-38 | 84 |
| 2621 | 1061 | 700554130H1 | SOYMON001 | g20728 | BLASTN | 563 | 1e-38 | 87 |
| 2622 | 1061 | 700742575H1 | SOYMON012 | g20728 | BLASTN | 564 | 1e-38 | 89 |
| 2623 | 1061 | 700875165H1 | SOYMON018 | g12158 | BLASTN | 568 | 1e-38 | 90 |
| 2624 | 1061 | 700686144H1 | SOYMON008 | g20728 | BLASTN | 569 | 1e-38 | 87 |
| 2625 | 1061 | 700990232H1 | SOYMON011 | g20728 | BLASTN | 572 | 1e-38 | 83 |
| 2626 | 1061 | 700657137H1 | SOYMON004 | g12158 | BLASTN | 574 | 1e-38 | 82 |
| 2627 | 1061 | 700731288H1 | SOYMON009 | g20728 | BLASTN | 339 | 1e-36 | 85 |
| 2628 | 1061 | 700741126H1 | SOYMON012 | g166703 | BLASTN | 465 | 1e-35 | 82 |
| 2629 | 1061 | 700975280H1 | SOYMON009 | g20728 | BLASTN | 517 | 1e-34 | 75 |
| 2630 | 1061 | 700788092H1 | SOYMON011 | g20728 | BLASTN | 264 | 1e-33 | 78 |
| 2631 | 1061 | 700683952H1 | SOYMON008 | g20728 | BLASTN | 364 | 1e-33 | 88 |
| 2632 | 1061 | 700992834H1 | SOYMON011 | g20728 | BLASTN | 380 | 1e-33 | 89 |
| 2633 | 1061 | 700991505H1 | SOYMON011 | g20728 | BLASTN | 460 | 1e-33 | 77 |
| 2634 | 1061 | 701110056H1 | SOYMON036 | g20728 | BLASTN | 490 | 1e-32 | 88 |
| 2635 | 1061 | 700679803H1 | SOYMON007 | g20728 | BLASTN | 490 | 1e-32 | 88 |
| 2636 | 1061 | 700686648H1 | SOYMON008 | g20728 | BLASTN | 483 | 1e-31 | 87 |
| 2637 | 1061 | 701000893H1 | SOYMON018 | g12158 | BLASTN | 253 | 1e-30 | 90 |
| 2638 | 1061 | 700729743H1 | SOYMON009 | g12158 | BLASTN | 362 | 1e-30 | 82 |
| 2639 | 1061 | 700656983H1 | SOYMON004 | g12158 | BLASTN | 379 | 1e-30 | 81 |
| 2640 | 1061 | 700742961H1 | SOYMON012 | g166701 | BLASTN | 469 | 1e-30 | 80 |
| 2641 | 1061 | 700995207H1 | SOYMON011 | g20728 | BLASTN | 322 | 1e-28 | 86 |
| 2642 | 1061 | 700960745H1 | SOYMON022 | g20728 | BLASTN | 444 | 1e-28 | 73 |
| 2643 | 1061 | 700873668H1 | SOYMON018 | g12158 | BLASTN | 337 | 1e-27 | 76 |
| 2644 | 1061 | 700991519H1 | SOYMON011 | g166701 | BLASTN | 435 | 1e-27 | 88 |
| 2645 | 1061 | 700743185H1 | SOYMON012 | g20728 | BLASTN | 427 | 1e-26 | 88 |
| 2646 | 1061 | 700554408H1 | SOYMON001 | g12158 | BLASTN | 221 | 1e-25 | 77 |
| 2647 | 1061 | 700686096H1 | SOYMON008 | g12158 | BLASTN | 326 | 1e-24 | 78 |
| 2648 | 1061 | 700739363H1 | SOYMON012 | g20728 | BLASTN | 401 | 1e-24 | 89 |
| 2649 | 1061 | 700996585H1 | SOYMON018 | g20728 | BLASTN | 416 | 1e-24 | 84 |
| 2650 | 1061 | 700991823H1 | SOYMON011 | g20728 | BLASTN | 422 | 1e-24 | 78 |
| 2651 | 1061 | 701000661H1 | SOYMON018 | g166702 | BLASTX | 130 | 1e-23 | 74 |
| 2652 | 1061 | 700606165H2 | SOYMON008 | g20728 | BLASTN | 389 | 1e-23 | 90 |
| 2653 | 1061 | 700999082H1 | SOYMON018 | g12158 | BLASTN | 364 | 1e-22 | 81 |
| 2654 | 1061 | 700738051H1 | SOYMON012 | g20728 | BLASTN | 376 | 1e-22 | 93 |
| 2655 | 1061 | 700740881H1 | SOYMON012 | g20728 | BLASTN | 377 | 1e-22 | 92 |
| 2656 | 1061 | 700987548H1 | SOYMON009 | g20728 | BLASTN | 347 | 1e-21 | 91 |
| 2657 | 1061 | 700739359H1 | SOYMON012 | g20728 | BLASTN | 357 | 1e-20 | 90 |
| 2658 | 1061 | 700979451H1 | SOYMON009 | g20728 | BLASTN | 357 | 1e-20 | 88 |
| 2659 | 1061 | 700991851H1 | SOYMON011 | g20728 | BLASTN | 351 | 1e-18 | 84 |
| 2660 | 1061 | 700989348H1 | SOYMON011 | g20728 | BLASTN | 295 | 1e-14 | 85 |
| 2661 | 1061 | 700558380H1 | SOYMON001 | g12159 | BLASTX | 80 | 1e-12 | 81 |
| 2662 | 1061 | 700738070H1 | SOYMON012 | g12158 | BLASTN | 160 | 1e-10 | 85 |

TABLE A*-continued

| Seq No. | Cluster ID | CloneID | Library | NCBI gi | Method | Score | P-value | % Ident |
|---|---|---|---|---|---|---|---|---|
| 2663 | 1061 | 700992942H1 | SOYMON011 | g20728 | BLASTN | 243 | 1e-9 | 94 |
| 2664 | 1061 | 700986029H1 | SOYMON009 | g20728 | BLASTN | 208 | 1e-8 | 76 |
| 2665 | 1061 | 700743737H1 | SOYMON012 | g20728 | BLASTN | 231 | 1e-8 | 84 |
| 2666 | 12847 | 700680701H1 | SOYMON008 | g20732 | BLASTN | 547 | 1e-35 | 87 |
| 2667 | 12847 | 700874711H1 | SOYMON018 | g20732 | BLASTN | 486 | 1e-31 | 87 |
| 2668 | 1392 | 701051645H1 | SOYMON032 | g2078297 | BLASTN | 1065 | 1e-80 | 86 |
| 2669 | 1392 | 700563915H1 | SOYMON002 | g2078297 | BLASTN | 1072 | 1e-80 | 88 |
| 2670 | 1392 | 701204320H2 | SOYMON035 | g2078297 | BLASTN | 1005 | 1e-75 | 88 |
| 2671 | 1392 | 700652968H1 | SOYMON003 | g19565 | BLASTN | 1012 | 1e-75 | 83 |
| 2672 | 1392 | 700748683H1 | SOYMON013 | g169090 | BLASTN | 968 | 1e-71 | 86 |
| 2673 | 1392 | 700981771H1 | SOYMON009 | g2078297 | BLASTN | 552 | 1e-70 | 88 |
| 2674 | 1392 | 700605826H2 | SOYMON006 | g21142 | BLASTN | 618 | 1e-68 | 85 |
| 2675 | 1392 | 700666839H1 | SOYMON005 | g2078297 | BLASTN | 809 | 1e-68 | 88 |
| 2676 | 1392 | 700944037H1 | SOYMON024 | g19565 | BLASTN | 899 | 1e-66 | 83 |
| 2677 | 1392 | 700969575H1 | SOYMON005 | g19565 | BLASTN | 854 | 1e-62 | 83 |
| 2678 | 1392 | 701118935H1 | SOYMON037 | g19565 | BLASTN | 838 | 1e-61 | 83 |
| 2679 | 1392 | 700725758H1 | SOYMON009 | g19565 | BLASTN | 846 | 1e-61 | 81 |
| 2680 | 1392 | 701054027H1 | SOYMON032 | g19565 | BLASTN | 818 | 1e-59 | 83 |
| 2681 | 1392 | 700954591H1 | SOYMON022 | g19565 | BLASTN | 825 | 1e-59 | 83 |
| 2682 | 1392 | 700653724H1 | SOYMON003 | g19565 | BLASTN | 781 | 1e-56 | 83 |
| 2683 | 1392 | 701052969H1 | SOYMON032 | g19565 | BLASTN | 788 | 1e-56 | 82 |
| 2684 | 1392 | 700836192H1 | SOYMON019 | g19565 | BLASTN | 769 | 1e-55 | 84 |
| 2685 | 1392 | 701014006H1 | SOYMON019 | g19565 | BLASTN | 769 | 1e-55 | 84 |
| 2686 | 1392 | 700849014H1 | SOYMON021 | g19565 | BLASTN | 770 | 1e-55 | 83 |
| 2687 | 1392 | 700747177H1 | SOYMON013 | g19565 | BLASTN | 770 | 1e-55 | 83 |
| 2688 | 1392 | 700733933H1 | SOYMON010 | g19565 | BLASTN | 775 | 1e-55 | 83 |
| 2689 | 1392 | 701045883H1 | SOYMON032 | g19565 | BLASTN | 754 | 1e-54 | 83 |
| 2690 | 1392 | 700561161H1 | SOYMON002 | g19565 | BLASTN | 760 | 1e-54 | 83 |
| 2691 | 1392 | 701002757H2 | SOYMON019 | g19565 | BLASTN | 764 | 1e-54 | 84 |
| 2692 | 1392 | 701150827H1 | SOYMON031 | g21142 | BLASTN | 428 | 1e-53 | 88 |
| 2693 | 1392 | 701043855H1 | SOYMON032 | g19565 | BLASTN | 432 | 1e-53 | 84 |
| 2694 | 1392 | 701138753H1 | SOYMON038 | g166705 | BLASTN | 395 | 1e-52 | 80 |
| 2695 | 1392 | 700746913H1 | SOYMON013 | g19565 | BLASTN | 596 | 1e-52 | 84 |
| 2696 | 1392 | 701004953H1 | SOYMON019 | g19565 | BLASTN | 734 | 1e-52 | 83 |
| 2697 | 1392 | 700900882H1 | SOYMON027 | g19565 | BLASTN | 740 | 1e-52 | 83 |
| 2698 | 1392 | 700987148H1 | SOYMON009 | g19565 | BLASTN | 691 | 1e-51 | 83 |
| 2699 | 1392 | 701054872H1 | SOYMON032 | g19565 | BLASTN | 719 | 1e-51 | 81 |
| 2700 | 1392 | 701056763H1 | SOYMON032 | g166705 | BLASTN | 632 | 1e-50 | 83 |
| 2701 | 1392 | 700748607H1 | SOYMON013 | g19565 | BLASTN | 707 | 1e-50 | 82 |
| 2702 | 1392 | 700830473H1 | SOYMON019 | g19565 | BLASTN | 694 | 1e-49 | 83 |
| 2703 | 1392 | 700762033H1 | SOYMON015 | g19565 | BLASTN | 696 | 1e-49 | 82 |
| 2704 | 1392 | 700987949H1 | SOYMON009 | g19565 | BLASTN | 700 | 1e-49 | 83 |
| 2705 | 1392 | 701135194H1 | SOYMON038 | g19565 | BLASTN | 705 | 1e-49 | 82 |
| 2706 | 1392 | 700748676H1 | SOYMON013 | g19565 | BLASTN | 379 | 1e-48 | 83 |
| 2707 | 1392 | 701046095H1 | SOYMON032 | g166705 | BLASTN | 386 | 1e-48 | 83 |
| 2708 | 1392 | 701045383H1 | SOYMON032 | g21142 | BLASTN | 623 | 1e-48 | 82 |
| 2709 | 1392 | 701052575H1 | SOYMON032 | g19565 | BLASTN | 683 | 1e-48 | 83 |
| 2710 | 1392 | 700667935H1 | SOYMON006 | g19565 | BLASTN | 690 | 1e-48 | 82 |
| 2711 | 1392 | 701055287H1 | SOYMON032 | g19565 | BLASTN | 690 | 1e-48 | 80 |
| 2712 | 1392 | 700660946H1 | SOYMON005 | g19565 | BLASTN | 691 | 1e-48 | 82 |
| 2713 | 1392 | 700891889H1 | SOYMON024 | g19565 | BLASTN | 670 | 1e-47 | 82 |
| 2714 | 1392 | 700670279H1 | SOYMON006 | g19565 | BLASTN | 672 | 1e-47 | 83 |
| 2715 | 1392 | 700865105H1 | SOYMON016 | g21142 | BLASTN | 674 | 1e-47 | 82 |
| 2716 | 1392 | 700664974H1 | SOYMON005 | g19565 | BLASTN | 677 | 1e-47 | 83 |
| 2717 | 1392 | 700727084H1 | SOYMON009 | g19565 | BLASTN | 680 | 1e-47 | 82 |
| 2718 | 1392 | 700748807H1 | SOYMON013 | g19565 | BLASTN | 628 | 1e-46 | 80 |
| 2719 | 1392 | 700749971H1 | SOYMON013 | g21142 | BLASTN | 662 | 1e-46 | 81 |
| 2720 | 1392 | 700664177H1 | SOYMON005 | g19565 | BLASTN | 657 | 1e-45 | 83 |
| 2721 | 1392 | 700969206H1 | SOYMON005 | g166705 | BLASTN | 634 | 1e-44 | 84 |
| 2722 | 1392 | 700668696H1 | SOYMON006 | g19565 | BLASTN | 636 | 1e-44 | 83 |
| 2723 | 1392 | 700677777H1 | SOYMON007 | g19565 | BLASTN | 640 | 1e-44 | 83 |
| 2724 | 1392 | 700969506H1 | SOYMON005 | g21142 | BLASTN | 642 | 1e-44 | 81 |
| 2725 | 1392 | 700667829H1 | SOYMON006 | g166705 | BLASTN | 643 | 1e-44 | 82 |
| 2726 | 1392 | 700730321H1 | SOYMON005 | g21142 | BLASTN | 643 | 1e-44 | 82 |
| 2727 | 1392 | 700972412H1 | SOYMON005 | g166705 | BLASTN | 644 | 1e-44 | 82 |
| 2728 | 1392 | 701043160H1 | SOYMON029 | g21142 | BLASTN | 623 | 1e-43 | 84 |
| 2729 | 1392 | 700896562H1 | SOYMON027 | g21142 | BLASTN | 623 | 1e-43 | 84 |
| 2730 | 1392 | 700678284H1 | SOYMON007 | g21142 | BLASTN | 623 | 1e-43 | 84 |
| 2731 | 1392 | 700674379H1 | SOYMON007 | g21142 | BLASTN | 623 | 1e-43 | 84 |
| 2732 | 1392 | 700973321H1 | SOYMON005 | g21142 | BLASTN | 626 | 1e-43 | 82 |
| 2733 | 1392 | 700848568H1 | SOYMON021 | g166705 | BLASTN | 632 | 1e-43 | 84 |
| 2734 | 1392 | 700973272H1 | SOYMON005 | g19565 | BLASTN | 429 | 1e-42 | 83 |
| 2735 | 1392 | 700735988H1 | SOYMON010 | g21142 | BLASTN | 615 | 1e-42 | 80 |
| 2736 | 1392 | 701002533H1 | SOYMON018 | g19565 | BLASTN | 402 | 1e-41 | 83 |
| 2737 | 1392 | 700726201H1 | SOYMON009 | g19565 | BLASTN | 454 | 1e-41 | 81 |
| 2738 | 1392 | 701004758H1 | SOYMON019 | g166705 | BLASTN | 544 | 1e-41 | 83 |
| 2739 | 1392 | 701047055H1 | SOYMON032 | g166705 | BLASTN | 599 | 1e-41 | 85 |

TABLE A*-continued

| Seq No. | Cluster ID | CloneID | Library | NCBI gi | Method | Score | P-value | % Ident |
|---|---|---|---|---|---|---|---|---|
| 2740 | 1392 | 700970781H1 | SOYMON005 | g166705 | BLASTN | 604 | 1e-41 | 83 |
| 2741 | 1392 | 700726274H1 | SOYMON009 | g19565 | BLASTN | 442 | 1e-40 | 82 |
| 2742 | 1392 | 701011762H1 | SOYMON019 | g166705 | BLASTN | 287 | 1e-39 | 79 |
| 2743 | 1392 | 700669086H1 | SOYMON006 | g21142 | BLASTN | 460 | 1e-39 | 83 |
| 2744 | 1392 | 700833089H1 | SOYMON019 | g166705 | BLASTN | 472 | 1e-39 | 82 |
| 2745 | 1392 | 700745795H1 | SOYMON013 | g19565 | BLASTN | 576 | 1e-39 | 76 |
| 2746 | 1392 | 700651350H1 | SOYMON003 | g166705 | BLASTN | 567 | 1e-38 | 83 |
| 2747 | 1392 | 700748761H1 | SOYMON013 | g166705 | BLASTN | 556 | 1e-37 | 83 |
| 2748 | 1392 | 701012075H1 | SOYMON019 | g166705 | BLASTN | 558 | 1e-37 | 84 |
| 2749 | 1392 | 700564585H1 | SOYMON002 | g21065 | BLASTN | 309 | 1e-36 | 85 |
| 2750 | 1392 | 701051053H1 | SOYMON032 | g166705 | BLASTN | 543 | 1e-36 | 84 |
| 2751 | 1392 | 700661104H1 | SOYMON005 | g166705 | BLASTN | 544 | 1e-35 | 85 |
| 2752 | 1392 | 701051845H1 | SOYMON032 | g19565 | BLASTN | 501 | 1e-32 | 84 |
| 2753 | 1392 | 700748992H1 | SOYMON013 | g21142 | BLASTN | 374 | 1e-22 | 82 |
| 2754 | 1392 | 700845656H1 | SOYMON021 | g166705 | BLASTN | 391 | 1e-22 | 83 |
| 2755 | 1392 | 700988562H1 | SOYMON009 | g1184773 | BLASTN | 397 | 1e-22 | 83 |
| 2756 | 1392 | 701003233H1 | SOYMON019 | g166705 | BLASTN | 249 | 1e-20 | 83 |
| 2757 | 1392 | 701048025H1 | SOYMON032 | g166705 | BLASTN | 335 | 1e-19 | 84 |
| 2758 | 14902 | 700977778H1 | SOYMON009 | g496493 | BLASTN | 1158 | 1e-87 | 90 |
| 2759 | 14902 | 700742004H1 | SOYMON012 | g496493 | BLASTN | 618 | 1e-51 | 90 |
| 2760 | 14902 | 700962586H1 | SOYMON022 | g496493 | BLASTN | 1023 | 1e-76 | 90 |
| 2761 | 14902 | 700994796H1 | SOYMON011 | g496493 | BLASTN | 480 | 1e-59 | 86 |
| 2762 | 16 | 700680820H1 | SOYMON008 | g169090 | BLASTN | 1392 | 1e-107 | 90 |
| 2763 | 16 | 700651027H1 | SOYMON003 | g169090 | BLASTN | 782 | 1e-101 | 87 |
| 2764 | 16 | 700661720H1 | SOYMON005 | g169090 | BLASTN | 1280 | 1e-98 | 84 |
| 2765 | 16 | 700653620H1 | SOYMON003 | g169090 | BLASTN | 783 | 1e-92 | 86 |
| 2766 | 16 | 701212010H1 | SOYMON035 | g169090 | BLASTN | 1193 | 1e-90 | 90 |
| 2767 | 16 | 700653624H1 | SOYMON003 | g169090 | BLASTN | 711 | 1e-86 | 86 |
| 2768 | 16 | 700684013H1 | SOYMON008 | g20732 | BLASTN | 1139 | 1e-86 | 89 |
| 2769 | 16 | 701130927H1 | SOYMON038 | g169090 | BLASTN | 1135 | 1e-85 | 90 |
| 2770 | 16 | 701118656H1 | SOYMON037 | g169090 | BLASTN | 927 | 1e-83 | 90 |
| 2771 | 16 | 701050807H1 | SOYMON032 | g169090 | BLASTN | 1101 | 1e-83 | 90 |
| 2772 | 16 | 700900304H1 | SOYMON027 | g169090 | BLASTN | 1108 | 1e-83 | 91 |
| 2773 | 16 | 700560856H1 | SOYMON001 | g20732 | BLASTN | 594 | 1e-82 | 88 |
| 2774 | 16 | 701127846H1 | SOYMON037 | g169090 | BLASTN | 1093 | 1e-82 | 90 |
| 2775 | 16 | 700746107H1 | SOYMON013 | g169090 | BLASTN | 1093 | 1e-82 | 91 |
| 2776 | 16 | 700957321H1 | SOYMON022 | g169090 | BLASTN | 1094 | 1e-82 | 90 |
| 2777 | 16 | 700556167H1 | SOYMON001 | g20732 | BLASTN | 1094 | 1e-82 | 87 |
| 2778 | 16 | 700685605H1 | SOYMON008 | g20732 | BLASTN | 1095 | 1e-82 | 89 |
| 2779 | 16 | 700982024H1 | SOYMON009 | g169090 | BLASTN | 1097 | 1e-82 | 87 |
| 2780 | 16 | 701136318H1 | SOYMON038 | g169090 | BLASTN | 912 | 1e-81 | 90 |
| 2781 | 16 | 701045985H1 | SOYMON032 | g169090 | BLASTN | 1083 | 1e-81 | 91 |
| 2782 | 16 | 700896756H1 | SOYMON027 | g169090 | BLASTN | 1083 | 1e-81 | 89 |
| 2783 | 16 | 700738664H1 | SOYMON012 | g20732 | BLASTN | 1087 | 1e-81 | 89 |
| 2784 | 16 | 700982290H1 | SOYMON009 | g169090 | BLASTN | 1088 | 1e-81 | 88 |
| 2785 | 16 | 701039411H1 | SOYMON029 | g169090 | BLASTN | 1068 | 1e-80 | 88 |
| 2786 | 16 | 700760151H1 | SOYMON015 | g169090 | BLASTN | 1076 | 1e-80 | 87 |
| 2787 | 16 | 701037105H1 | SOYMON029 | g169090 | BLASTN | 706 | 1e-79 | 90 |
| 2788 | 16 | 700653646H1 | SOYMON003 | g169090 | BLASTN | 723 | 1e-79 | 83 |
| 2789 | 16 | 701003361H1 | SOYMON019 | g169090 | BLASTN | 913 | 1e-79 | 88 |
| 2790 | 16 | 700684871H1 | SOYMON008 | g169090 | BLASTN | 1058 | 1e-79 | 90 |
| 2791 | 16 | 700972333H1 | SOYMON005 | g169090 | BLASTN | 1059 | 1e-79 | 89 |
| 2792 | 16 | 700660117H1 | SOYMON004 | g20732 | BLASTN | 1060 | 1e-79 | 91 |
| 2793 | 16 | 700681841H1 | SOYMON008 | g169090 | BLASTN | 1060 | 1e-79 | 89 |
| 2794 | 16 | 701063487H1 | SOYMON033 | g169090 | BLASTN | 1063 | 1e-79 | 87 |
| 2795 | 16 | 701118518H1 | SOYMON037 | g169090 | BLASTN | 1064 | 1e-79 | 92 |
| 2796 | 16 | 700998228H1 | SOYMON018 | g169090 | BLASTN | 599 | 1e-78 | 91 |
| 2797 | 16 | 700667222H1 | SOYMON006 | g169090 | BLASTN | 1042 | 1e-78 | 87 |
| 2798 | 16 | 701205378H1 | SOYMON035 | g169090 | BLASTN | 1047 | 1e-78 | 89 |
| 2799 | 16 | 701109009H1 | SOYMON036 | g169090 | BLASTN | 1050 | 1e-78 | 85 |
| 2800 | 16 | 700902080H1 | SOYMON027 | g20732 | BLASTN | 1051 | 1e-78 | 88 |
| 2801 | 16 | 701065402H1 | SOYMON034 | g20732 | BLASTN | 1051 | 1e-78 | 85 |
| 2802 | 16 | 700905151H1 | SOYMON022 | g169090 | BLASTN | 1052 | 1e-78 | 89 |
| 2803 | 16 | 700660104H1 | SOYMON004 | g20732 | BLASTN | 1053 | 1e-78 | 91 |
| 2804 | 16 | 701122747H1 | SOYMON037 | g169090 | BLASTN | 1029 | 1e-77 | 85 |
| 2805 | 16 | 700681958H1 | SOYMON008 | g20732 | BLASTN | 1033 | 1e-77 | 87 |
| 2806 | 16 | 701045633H1 | SOYMON032 | g169090 | BLASTN | 1036 | 1e-77 | 86 |
| 2807 | 16 | 700870706H1 | SOYMON018 | g169090 | BLASTN | 1038 | 1e-77 | 89 |
| 2808 | 16 | 700957310H1 | SOYMON022 | g169090 | BLASTN | 1040 | 1e-77 | 91 |
| 2809 | 16 | 700981914H1 | SOYMON009 | g169090 | BLASTN | 455 | 1e-76 | 83 |
| 2810 | 16 | 700873416H1 | SOYMON018 | g20732 | BLASTN | 544 | 1e-76 | 88 |
| 2811 | 16 | 700562964H1 | SOYMON002 | g169090 | BLASTN | 824 | 1e-76 | 88 |
| 2812 | 16 | 700829678H1 | SOYMON019 | g169090 | BLASTN | 1021 | 1e-76 | 88 |
| 2813 | 16 | 700668218H1 | SOYMON006 | g20732 | BLASTN | 1023 | 1e-76 | 87 |
| 2814 | 16 | 701206845H1 | SOYMON035 | g169090 | BLASTN | 1024 | 1e-76 | 90 |
| 2815 | 16 | 700835082H1 | SOYMON019 | g169090 | BLASTN | 1024 | 1e-76 | 88 |
| 2816 | 16 | 701011483H1 | SOYMON019 | g169090 | BLASTN | 1024 | 1e-76 | 90 |

TABLE A*-continued

| Seq No. | Cluster ID | CloneID | Library | NCBI gi | Method | Score | P-value | % Ident |
|---|---|---|---|---|---|---|---|---|
| 2817 | 16 | 700605436H2 | SOYMON004 | g20732 | BLASTN | 1027 | 1e−76 | 86 |
| 2818 | 16 | 700963428H1 | SOYMON022 | g20732 | BLASTN | 1027 | 1e−76 | 89 |
| 2819 | 16 | 700975672H1 | SOYMON009 | g20732 | BLASTN | 852 | 1e−75 | 90 |
| 2820 | 16 | 700907957H1 | SOYMON022 | g169090 | BLASTN | 1005 | 1e−75 | 91 |
| 2821 | 16 | 700960608H1 | SOYMON022 | g169090 | BLASTN | 1005 | 1e−75 | 88 |
| 2822 | 16 | 700837794H1 | SOYMON020 | g169090 | BLASTN | 1006 | 1e−75 | 91 |
| 2823 | 16 | 701138460H1 | SOYMON038 | g169090 | BLASTN | 1006 | 1e−75 | 88 |
| 2824 | 16 | 700646202H1 | SOYMON012 | g20732 | BLASTN | 1007 | 1e−75 | 88 |
| 2825 | 16 | 700874447H1 | SOYMON018 | g20732 | BLASTN | 1007 | 1e−75 | 90 |
| 2826 | 16 | 700667967H1 | SOYMON006 | g20732 | BLASTN | 1007 | 1e−75 | 89 |
| 2827 | 16 | 701131790H1 | SOYMON038 | g169090 | BLASTN | 1011 | 1e−75 | 91 |
| 2828 | 16 | 700970954H1 | SOYMON005 | g169090 | BLASTN | 1012 | 1e−75 | 87 |
| 2829 | 16 | 701120441H1 | SOYMON037 | g169090 | BLASTN | 1013 | 1e−75 | 87 |
| 2830 | 16 | 701120055H1 | SOYMON037 | g169090 | BLASTN | 1015 | 1e−75 | 83 |
| 2831 | 16 | 701001031H1 | SOYMON018 | g20732 | BLASTN | 1017 | 1e−75 | 83 |
| 2832 | 16 | 700652931H1 | SOYMON003 | g169090 | BLASTN | 853 | 1e−74 | 79 |
| 2833 | 16 | 700981202H1 | SOYMON009 | g169090 | BLASTN | 955 | 1e−74 | 87 |
| 2834 | 16 | 701142183H1 | SOYMON038 | g169090 | BLASTN | 1000 | 1e−74 | 85 |
| 2835 | 16 | 700978682H1 | SOYMON009 | g169090 | BLASTN | 1000 | 1e−74 | 85 |
| 2836 | 16 | 701122065H1 | SOYMON037 | g169090 | BLASTN | 1004 | 1e−74 | 87 |
| 2837 | 16 | 700558895H1 | SOYMON001 | g20732 | BLASTN | 566 | 1e−73 | 86 |
| 2838 | 16 | 700686234H1 | SOYMON008 | g20732 | BLASTN | 573 | 1e−73 | 89 |
| 2839 | 16 | 700566271H1 | SOYMON002 | g169090 | BLASTN | 863 | 1e−73 | 84 |
| 2840 | 16 | 700558604H1 | SOYMON001 | g20732 | BLASTN | 982 | 1e−73 | 82 |
| 2841 | 16 | 700684166H1 | SOYMON008 | g169090 | BLASTN | 984 | 1e−73 | 86 |
| 2842 | 16 | 700873924H1 | SOYMON018 | g169090 | BLASTN | 986 | 1e−73 | 88 |
| 2843 | 16 | 700738880H1 | SOYMON012 | g20732 | BLASTN | 987 | 1e−73 | 89 |
| 2844 | 16 | 700741816H1 | SOYMON012 | g20732 | BLASTN | 992 | 1e−73 | 86 |
| 2845 | 16 | 700892371H1 | SOYMON024 | g169090 | BLASTN | 992 | 1e−73 | 88 |
| 2846 | 16 | 700560702H1 | SOYMON001 | g20732 | BLASTN | 993 | 1e−73 | 82 |
| 2847 | 16 | 700968331H1 | SOYMON036 | g20732 | BLASTN | 993 | 1e−73 | 88 |
| 2848 | 16 | 701063318H1 | SOYMON033 | g169090 | BLASTN | 787 | 1e−72 | 88 |
| 2849 | 16 | 700996472H1 | SOYMON018 | g20732 | BLASTN | 821 | 1e−72 | 86 |
| 2850 | 16 | 701065057H1 | SOYMON034 | g169090 | BLASTN | 924 | 1e−72 | 84 |
| 2851 | 16 | 700863670H1 | SOYMON027 | g169090 | BLASTN | 943 | 1e−72 | 90 |
| 2852 | 16 | 701212013H1 | SOYMON035 | g169090 | BLASTN | 969 | 1e−72 | 85 |
| 2853 | 16 | 701012801H1 | SOYMON019 | g169090 | BLASTN | 969 | 1e−72 | 85 |
| 2854 | 16 | 701004406H1 | SOYMON019 | g169090 | BLASTN | 969 | 1e−72 | 85 |
| 2855 | 16 | 700751116H1 | SOYMON014 | g169090 | BLASTN | 970 | 1e−72 | 90 |
| 2856 | 16 | 700675491H1 | SOYMON007 | g169090 | BLASTN | 972 | 1e−72 | 92 |
| 2857 | 16 | 701131360H1 | SOYMON038 | g169090 | BLASTN | 972 | 1e−72 | 84 |
| 2858 | 16 | 700562740H1 | SOYMON002 | g169090 | BLASTN | 976 | 1e−72 | 83 |
| 2859 | 16 | 701099556H1 | SOYMON028 | g169090 | BLASTN | 979 | 1e−72 | 88 |
| 2860 | 16 | 700558534H1 | SOYMON001 | g20732 | BLASTN | 469 | 1e−71 | 84 |
| 2861 | 16 | 700565245H1 | SOYMON002 | g169090 | BLASTN | 715 | 1e−71 | 90 |
| 2862 | 16 | 700944452H1 | SOYMON024 | g169090 | BLASTN | 780 | 1e−71 | 86 |
| 2863 | 16 | 701009629H1 | SOYMON019 | g169090 | BLASTN | 828 | 1e−71 | 84 |
| 2864 | 16 | 700725661H1 | SOYMON009 | g169090 | BLASTN | 838 | 1e−71 | 87 |
| 2865 | 16 | 701066885H1 | SOYMON034 | g169090 | BLASTN | 856 | 1e−71 | 86 |
| 2866 | 16 | 701009856H1 | SOYMON019 | g169090 | BLASTN | 958 | 1e−71 | 83 |
| 2867 | 16 | 700560569H1 | SOYMON001 | g169090 | BLASTN | 963 | 1e−71 | 84 |
| 2868 | 16 | 700867802H1 | SOYMON016 | g169090 | BLASTN | 964 | 1e−71 | 85 |
| 2869 | 16 | 701117421H1 | SOYMON037 | g169090 | BLASTN | 967 | 1e−71 | 83 |
| 2870 | 16 | 700963317H1 | SOYMON022 | g20732 | BLASTN | 830 | 1e−70 | 85 |
| 2871 | 16 | 700646149H1 | SOYMON012 | g20732 | BLASTN | 864 | 1e−70 | 87 |
| 2872 | 16 | 701002213H1 | SOYMON018 | g20732 | BLASTN | 946 | 1e−70 | 88 |
| 2873 | 16 | 700999509H1 | SOYMON018 | g20732 | BLASTN | 948 | 1e−70 | 83 |
| 2874 | 16 | 701003210H1 | SOYMON019 | g169090 | BLASTN | 949 | 1e−70 | 83 |
| 2875 | 16 | 700738832H1 | SOYMON012 | g20732 | BLASTN | 952 | 1e−70 | 86 |
| 2876 | 16 | 701212329H1 | SOYMON035 | g169090 | BLASTN | 952 | 1e−70 | 85 |
| 2877 | 16 | 700683783H1 | SOYMON008 | g169090 | BLASTN | 953 | 1e−70 | 83 |
| 2878 | 16 | 700874828H1 | SOYMON018 | g20732 | BLASTN | 953 | 1e−70 | 85 |
| 2879 | 16 | 700839986H1 | SOYMON020 | g169090 | BLASTN | 954 | 1e−70 | 89 |
| 2880 | 16 | 700661155H1 | SOYMON005 | g169090 | BLASTN | 955 | 1e−70 | 84 |
| 2881 | 16 | 700686453H1 | SOYMON008 | g20732 | BLASTN | 956 | 1e−70 | 85 |
| 2882 | 16 | 701104636H1 | SOYMON036 | g169090 | BLASTN | 956 | 1e−70 | 84 |
| 2883 | 16 | 700682277H1 | SOYMON008 | g20732 | BLASTN | 444 | 1e−69 | 88 |
| 2884 | 16 | 700556648H1 | SOYMON001 | g20732 | BLASTN | 526 | 1e−69 | 83 |
| 2885 | 16 | 701133126H1 | SOYMON038 | g169090 | BLASTN | 526 | 1e−69 | 86 |
| 2886 | 16 | 700659056H1 | SOYMON004 | g169090 | BLASTN | 655 | 1e−69 | 91 |
| 2887 | 16 | 701009405H1 | SOYMON019 | g169090 | BLASTN | 665 | 1e−69 | 91 |
| 2888 | 16 | 700554721H1 | SOYMON001 | g169090 | BLASTN | 743 | 1e−69 | 81 |
| 2889 | 16 | 700833925H1 | SOYMON019 | g169090 | BLASTN | 938 | 1e−69 | 85 |
| 2890 | 16 | 700848119H1 | SOYMON021 | g20550 | BLASTN | 942 | 1e−69 | 85 |
| 2891 | 16 | 700559336H1 | SOYMON001 | g169090 | BLASTN | 943 | 1e−69 | 80 |
| 2892 | 16 | 701207095H1 | SOYMON035 | g169090 | BLASTN | 944 | 1e−69 | 83 |
| 2893 | 16 | 701125617H1 | SOYMON037 | g169090 | BLASTN | 944 | 1e−69 | 84 |

TABLE A*-continued

| Seq No. | Cluster ID | CloneID | Library | NCBI gi | Method | Score | P-value | % Ident |
|---|---|---|---|---|---|---|---|---|
| 2894 | 16 | 700756418H1 | SOYMON014 | g169090 | BLASTN | 944 | 1e-69 | 84 |
| 2895 | 16 | 700738263H1 | SOYMON012 | g20732 | BLASTN | 945 | 1e-69 | 89 |
| 2896 | 16 | 700743026H1 | SOYMON012 | g169090 | BLASTN | 497 | 1e-68 | 85 |
| 2897 | 16 | 700978803H1 | SOYMON009 | g169090 | BLASTN | 931 | 1e-68 | 80 |
| 2898 | 16 | 700852390H1 | SOYMON023 | g20732 | BLASTN | 489 | 1e-67 | 87 |
| 2899 | 16 | 700681390H2 | SOYMON008 | g20732 | BLASTN | 506 | 1e-67 | 88 |
| 2900 | 16 | 700554330H1 | SOYMON001 | g20732 | BLASTN | 794 | 1e-67 | 83 |
| 2901 | 16 | 700746738H1 | SOYMON013 | g169090 | BLASTN | 910 | 1e-67 | 86 |
| 2902 | 16 | 700962884H1 | SOYMON022 | g169090 | BLASTN | 919 | 1e-67 | 85 |
| 2903 | 16 | 700683756H1 | SOYMON008 | g20732 | BLASTN | 919 | 1e-67 | 83 |
| 2904 | 16 | 700898676H1 | SOYMON027 | g169090 | BLASTN | 919 | 1e-67 | 91 |
| 2905 | 16 | 700685076H1 | SOYMON008 | g20732 | BLASTN | 921 | 1e-67 | 85 |
| 2906 | 16 | 700836262H1 | SOYMON019 | g169090 | BLASTN | 898 | 1e-66 | 84 |
| 2907 | 16 | 700674865H1 | SOYMON007 | g169090 | BLASTN | 902 | 1e-66 | 90 |
| 2908 | 16 | 700967318H1 | SOYMON031 | g20732 | BLASTN | 906 | 1e-66 | 85 |
| 2909 | 16 | 700955044H1 | SOYMON022 | g169090 | BLASTN | 907 | 1e-66 | 85 |
| 2910 | 16 | 700755131H1 | SOYMON014 | g20732 | BLASTN | 908 | 1e-66 | 85 |
| 2911 | 16 | 700743643H1 | SOYMON012 | g20732 | BLASTN | 909 | 1e-66 | 84 |
| 2912 | 16 | 700979861H2 | SOYMON009 | g169090 | BLASTN | 293 | 1e-65 | 88 |
| 2913 | 16 | 700907981H1 | SOYMON022 | g20550 | BLASTN | 681 | 1e-65 | 85 |
| 2914 | 16 | 701001058H1 | SOYMON018 | g20732 | BLASTN | 690 | 1e-65 | 81 |
| 2915 | 16 | 700547949H1 | SOYMON001 | g20732 | BLASTN | 835 | 1e-65 | 88 |
| 2916 | 16 | 700678780H1 | SOYMON007 | g169090 | BLASTN | 854 | 1e-65 | 92 |
| 2917 | 16 | 700851960H1 | SOYMON023 | g20550 | BLASTN | 890 | 1e-65 | 85 |
| 2918 | 16 | 701099668H1 | SOYMON028 | g169090 | BLASTN | 493 | 1e-64 | 83 |
| 2919 | 16 | 701103733H1 | SOYMON036 | g169090 | BLASTN | 684 | 1e-64 | 80 |
| 2920 | 16 | 700985604H1 | SOYMON009 | g169090 | BLASTN | 873 | 1e-64 | 79 |
| 2921 | 16 | 700849622H1 | SOYMON021 | g169090 | BLASTN | 877 | 1e-64 | 84 |
| 2922 | 16 | 700752648H1 | SOYMON014 | g169090 | BLASTN | 879 | 1e-64 | 85 |
| 2923 | 16 | 700952882H1 | SOYMON022 | g20732 | BLASTN | 884 | 1e-64 | 85 |
| 2924 | 16 | 701006721H1 | SOYMON019 | g169090 | BLASTN | 884 | 1e-64 | 86 |
| 2925 | 16 | 700895879H1 | SOYMON027 | g169090 | BLASTN | 884 | 1e-64 | 84 |
| 2926 | 16 | 700740632H1 | SOYMON012 | g20732 | BLASTN | 375 | 1e-63 | 84 |
| 2927 | 16 | 700981723H1 | SOYMON009 | g20732 | BLASTN | 690 | 1e-63 | 81 |
| 2928 | 16 | 700657114H1 | SOYMON004 | g169090 | BLASTN | 861 | 1e-63 | 87 |
| 2929 | 16 | 700661319H1 | SOYMON005 | g169090 | BLASTN | 862 | 1e-63 | 82 |
| 2930 | 16 | 700987848H1 | SOYMON009 | g169090 | BLASTN | 862 | 1e-63 | 79 |
| 2931 | 16 | 700664376H1 | SOYMON005 | g169090 | BLASTN | 865 | 1e-63 | 83 |
| 2932 | 16 | 700848760H1 | SOYMON021 | g169090 | BLASTN | 868 | 1e-63 | 82 |
| 2933 | 16 | 700734932H1 | SOYMON010 | g169090 | BLASTN | 871 | 1e-63 | 90 |
| 2934 | 16 | 700894550H1 | SOYMON024 | g169090 | BLASTN | 872 | 1e-63 | 86 |
| 2935 | 16 | 700754237H1 | SOYMON014 | g169090 | BLASTN | 443 | 1e-62 | 83 |
| 2936 | 16 | 700654194H1 | SOYMON003 | g169090 | BLASTN | 449 | 1e-62 | 83 |
| 2937 | 16 | 701002119H1 | SOYMON018 | g20732 | BLASTN | 459 | 1e-62 | 89 |
| 2938 | 16 | 700899445H1 | SOYMON027 | g20732 | BLASTN | 473 | 1e-62 | 86 |
| 2939 | 16 | 700648324H1 | SOYMON003 | g169090 | BLASTN | 531 | 1e-62 | 80 |
| 2940 | 16 | 700897837H1 | SOYMON027 | g169090 | BLASTN | 582 | 1e-62 | 82 |
| 2941 | 16 | 701056234H1 | SOYMON032 | g169090 | BLASTN | 737 | 1e-62 | 79 |
| 2942 | 16 | 700906196H1 | SOYMON022 | g169090 | BLASTN | 852 | 1e-62 | 83 |
| 2943 | 16 | 701002126H1 | SOYMON018 | g20732 | BLASTN | 853 | 1e-62 | 82 |
| 2944 | 16 | 700853304H1 | SOYMON023 | g169090 | BLASTN | 857 | 1e-62 | 84 |
| 2945 | 16 | 701015618H1 | SOYMON037 | g169090 | BLASTN | 857 | 1e-62 | 81 |
| 2946 | 16 | 700875928H1 | SOYMON018 | g20732 | BLASTN | 861 | 1e-62 | 86 |
| 2947 | 16 | 700676860H1 | SOYMON007 | g169090 | BLASTN | 461 | 1e-61 | 84 |
| 2948 | 16 | 700983517H1 | SOYMON009 | g409574 | BLASTN | 615 | 1e-61 | 86 |
| 2949 | 16 | 700841881H1 | SOYMON020 | g20550 | BLASTN | 717 | 1e-61 | 86 |
| 2950 | 16 | 700853082H1 | SOYMON023 | g169090 | BLASTN | 842 | 1e-61 | 84 |
| 2951 | 16 | 701106263H1 | SOYMON036 | g20732 | BLASTN | 844 | 1e-61 | 90 |
| 2952 | 16 | 700678241H1 | SOYMON007 | g169090 | BLASTN | 845 | 1e-61 | 83 |
| 2953 | 16 | 701133107H1 | SOYMON038 | g169090 | BLASTN | 845 | 1e-61 | 79 |
| 2954 | 16 | 700976170H1 | SOYMON009 | g169090 | BLASTN | 848 | 1e-61 | 78 |
| 2955 | 16 | 700646259H1 | SOYMON012 | g20732 | BLASTN | 650 | 1e-60 | 82 |
| 2956 | 16 | 700682750H1 | SOYMON008 | g169090 | BLASTN | 654 | 1e-60 | 83 |
| 2957 | 16 | 700556141H1 | SOYMON001 | g20732 | BLASTN | 690 | 1e-60 | 81 |
| 2958 | 16 | 700870652H1 | SOYMON018 | g20732 | BLASTN | 702 | 1e-60 | 86 |
| 2959 | 16 | 700893834H1 | SOYMON024 | g169090 | BLASTN | 826 | 1e-60 | 82 |
| 2960 | 16 | 700970819H1 | SOYMON005 | g169090 | BLASTN | 828 | 1e-60 | 81 |
| 2961 | 16 | 700890650H1 | SOYMON024 | g169090 | BLASTN | 830 | 1e-60 | 88 |
| 2962 | 16 | 701122211H1 | SOYMON037 | g169090 | BLASTN | 830 | 1e-60 | 83 |
| 2963 | 16 | 700980742H1 | SOYMON009 | g169090 | BLASTN | 830 | 1e-60 | 84 |
| 2964 | 16 | 701137606H1 | SOYMON038 | g169090 | BLASTN | 832 | 1e-60 | 83 |
| 2965 | 16 | 700682612H2 | SOYMON008 | g20732 | BLASTN | 834 | 1e-60 | 81 |
| 2966 | 16 | 700971830H1 | SOYMON005 | g169090 | BLASTN | 835 | 1e-60 | 79 |
| 2967 | 16 | 700909405H1 | SOYMON022 | g169090 | BLASTN | 835 | 1e-60 | 79 |
| 2968 | 16 | 700981291H1 | SOYMON009 | g169090 | BLASTN | 835 | 1e-60 | 79 |
| 2969 | 16 | 700953564H1 | SOYMON022 | g169090 | BLASTN | 836 | 1e-60 | 82 |
| 2970 | 16 | 700747612H1 | SOYMON013 | g409574 | BLASTN | 836 | 1e-60 | 83 |

TABLE A*-continued

| Seq No. | Cluster ID | CloneID | Library | NCBI gi | Method | Score | P-value | % Ident |
|---|---|---|---|---|---|---|---|---|
| 2971 | 16 | 700975021H1 | SOYMON005 | g169090 | BLASTN | 439 | 1e-59 | 82 |
| 2972 | 16 | 700729321H1 | SOYMON009 | g309670 | BLASTN | 485 | 1e-59 | 81 |
| 2973 | 16 | 701001137H1 | SOYMON018 | g20732 | BLASTN | 578 | 1e-59 | 79 |
| 2974 | 16 | 700554280H1 | SOYMON001 | g20732 | BLASTN | 596 | 1e-59 | 88 |
| 2975 | 16 | 701135387H1 | SOYMON038 | g169090 | BLASTN | 609 | 1e-59 | 80 |
| 2976 | 16 | 700655905H1 | SOYMON004 | g169090 | BLASTN | 646 | 1e-59 | 82 |
| 2977 | 16 | 701048613H1 | SOYMON032 | g169090 | BLASTN | 814 | 1e-59 | 79 |
| 2978 | 16 | 701062603H1 | SOYMON033 | g166705 | BLASTN | 814 | 1e-59 | 83 |
| 2979 | 16 | 700741884H1 | SOYMON012 | g169090 | BLASTN | 815 | 1e-59 | 83 |
| 2980 | 16 | 701014048H1 | SOYMON019 | g169090 | BLASTN | 815 | 1e-59 | 84 |
| 2981 | 16 | 700556774H1 | SOYMON001 | g20732 | BLASTN | 817 | 1e-59 | 82 |
| 2982 | 16 | 701212143H1 | SOYMON035 | g169090 | BLASTN | 819 | 1e-59 | 79 |
| 2983 | 16 | 700977724H1 | SOYMON009 | g169090 | BLASTN | 819 | 1e-59 | 83 |
| 2984 | 16 | 701052505H1 | SOYMON032 | g169090 | BLASTN | 821 | 1e-59 | 84 |
| 2985 | 16 | 701048090H1 | SOYMON032 | g169090 | BLASTN | 823 | 1e-59 | 85 |
| 2986 | 16 | 700850111H1 | SOYMON023 | g169090 | BLASTN | 802 | 1e-58 | 80 |
| 2987 | 16 | 700748768H1 | SOYMON013 | g169090 | BLASTN | 804 | 1e-58 | 85 |
| 2988 | 16 | 701215404H1 | SOYMON035 | g169090 | BLASTN | 806 | 1e-58 | 84 |
| 2989 | 16 | 700686206H1 | SOYMON008 | g20732 | BLASTN | 807 | 1e-58 | 82 |
| 2990 | 16 | 701137704H1 | SOYMON038 | g409574 | BLASTN | 808 | 1e-58 | 82 |
| 2991 | 16 | 700876594H1 | SOYMON018 | g169090 | BLASTN | 809 | 1e-58 | 83 |
| 2992 | 16 | 700743816H1 | SOYMON012 | g20732 | BLASTN | 809 | 1e-58 | 90 |
| 2993 | 16 | 701037342H1 | SOYMON029 | g409574 | BLASTN | 812 | 1e-58 | 82 |
| 2994 | 16 | 700853152H1 | SOYMON023 | g169090 | BLASTN | 576 | 1e-57 | 87 |
| 2995 | 16 | 700905876H1 | SOYMON022 | g169090 | BLASTN | 606 | 1e-57 | 84 |
| 2996 | 16 | 700790719H1 | SOYMON011 | g409574 | BLASTN | 710 | 1e-57 | 82 |
| 2997 | 16 | 701106994H1 | SOYMON036 | g169090 | BLASTN | 790 | 1e-57 | 79 |
| 2998 | 16 | 700752366H1 | SOYMON014 | g169090 | BLASTN | 790 | 1e-57 | 81 |
| 2999 | 16 | 700952951H1 | SOYMON022 | g169090 | BLASTN | 791 | 1e-57 | 84 |
| 3000 | 16 | 700998563H1 | SOYMON018 | g20732 | BLASTN | 792 | 1e-57 | 88 |
| 3001 | 16 | 700840245H1 | SOYMON020 | g169090 | BLASTN | 792 | 1e-57 | 79 |
| 3002 | 16 | 700556140H1 | SOYMON001 | g166705 | BLASTN | 794 | 1e-57 | 82 |
| 3003 | 16 | 701056981H1 | SOYMON033 | g169090 | BLASTN | 795 | 1e-57 | 83 |
| 3004 | 16 | 700953045H1 | SOYMON022 | g169090 | BLASTN | 796 | 1e-57 | 83 |
| 3005 | 16 | 701137408H1 | SOYMON038 | g169090 | BLASTN | 797 | 1e-57 | 82 |
| 3006 | 16 | 700972258H1 | SOYMON005 | g169090 | BLASTN | 797 | 1e-57 | 79 |
| 3007 | 16 | 700980774H1 | SOYMON009 | g169090 | BLASTN | 797 | 1e-57 | 88 |
| 3008 | 16 | 700972064H1 | SOYMON005 | g169090 | BLASTN | 797 | 1e-57 | 79 |
| 3009 | 16 | 700685812H1 | SOYMON008 | g169090 | BLASTN | 798 | 1e-57 | 79 |
| 3010 | 16 | 700740477H1 | SOYMON012 | g409574 | BLASTN | 801 | 1e-57 | 84 |
| 3011 | 16 | 701062012H1 | SOYMON033 | g409574 | BLASTN | 451 | 1e-56 | 82 |
| 3012 | 16 | 701108736H1 | SOYMON036 | g20732 | BLASTN | 529 | 1e-56 | 80 |
| 3013 | 16 | 701104521H1 | SOYMON036 | g169090 | BLASTN | 680 | 1e-56 | 84 |
| 3014 | 16 | 700659833H1 | SOYMON004 | g2905771 | BLASTN | 754 | 1e-56 | 97 |
| 3015 | 16 | 700786076H2 | SOYMON011 | g2905771 | BLASTN | 754 | 1e-56 | 97 |
| 3016 | 16 | 700666231H1 | SOYMON005 | g2905771 | BLASTN | 754 | 1e-56 | 97 |
| 3017 | 16 | 700556330H1 | SOYMON001 | g20732 | BLASTN | 779 | 1e-56 | 81 |
| 3018 | 16 | 700964614H1 | SOYMON022 | g19565 | BLASTN | 780 | 1e-56 | 84 |
| 3019 | 16 | 700985844H1 | SOYMON009 | g19565 | BLASTN | 780 | 1e-56 | 84 |
| 3020 | 16 | 701126134H1 | SOYMON037 | g409574 | BLASTN | 781 | 1e-56 | 83 |
| 3021 | 16 | 700968036H1 | SOYMON034 | g169090 | BLASTN | 786 | 1e-56 | 85 |
| 3022 | 16 | 701110182H1 | SOYMON036 | g169090 | BLASTN | 786 | 1e-56 | 85 |
| 3023 | 16 | 700995174H1 | SOYMON011 | g169090 | BLASTN | 787 | 1e-56 | 85 |
| 3024 | 16 | 701044955H1 | SOYMON032 | g2905771 | BLASTN | 404 | 1e-55 | 96 |
| 3025 | 16 | 701203714H2 | SOYMON035 | g2905771 | BLASTN | 413 | 1e-55 | 97 |
| 3026 | 16 | 700847062H1 | SOYMON021 | g169090 | BLASTN | 528 | 1e-55 | 83 |
| 3027 | 16 | 700876923H1 | SOYMON018 | g20732 | BLASTN | 568 | 1e-55 | 81 |
| 3028 | 16 | 700738183H1 | SOYMON012 | g20732 | BLASTN | 586 | 1e-55 | 81 |
| 3029 | 16 | 701001383H1 | SOYMON018 | g20732 | BLASTN | 590 | 1e-55 | 81 |
| 3030 | 16 | 700877113H1 | SOYMON018 | g20732 | BLASTN | 681 | 1e-55 | 80 |
| 3031 | 16 | 700562672H1 | SOYMON002 | g169090 | BLASTN | 693 | 1e-55 | 83 |
| 3032 | 16 | 700956242H1 | SOYMON022 | g2905771 | BLASTN | 740 | 1e-55 | 96 |
| 3033 | 16 | 701058012H1 | SOYMON033 | g2905771 | BLASTN | 747 | 1e-55 | 96 |
| 3034 | 16 | 701070207H1 | SOYMON034 | g2905771 | BLASTN | 747 | 1e-55 | 96 |
| 3035 | 16 | 700901724H1 | SOYMON027 | g2905771 | BLASTN | 747 | 1e-55 | 96 |
| 3036 | 16 | 700792920H1 | SOYMON017 | g169090 | BLASTN | 767 | 1e-55 | 83 |
| 3037 | 16 | 700964732H1 | SOYMON022 | g169090 | BLASTN | 768 | 1e-55 | 84 |
| 3038 | 16 | 700994809H1 | SOYMON011 | g409574 | BLASTN | 768 | 1e-55 | 83 |
| 3039 | 16 | 700987118H1 | SOYMON009 | g19565 | BLASTN | 769 | 1e-55 | 84 |
| 3040 | 16 | 701007268H2 | SOYMON019 | g169090 | BLASTN | 769 | 1e-55 | 83 |
| 3041 | 16 | 700650971H1 | SOYMON003 | g169090 | BLASTN | 770 | 1e-55 | 91 |
| 3042 | 16 | 700964742H1 | SOYMON022 | g169090 | BLASTN | 771 | 1e-55 | 85 |
| 3043 | 16 | 700662524H1 | SOYMON005 | g169090 | BLASTN | 772 | 1e-55 | 79 |
| 3044 | 16 | 700895349H1 | SOYMON027 | g20732 | BLASTN | 772 | 1e-55 | 89 |
| 3045 | 16 | 701008593H1 | SOYMON019 | g169090 | BLASTN | 776 | 1e-55 | 82 |
| 3046 | 16 | 701004062H1 | SOYMON019 | g169090 | BLASTN | 326 | 1e-54 | 81 |
| 3047 | 16 | 700731710H1 | SOYMON010 | g169090 | BLASTN | 456 | 1e-54 | 84 |

TABLE A*-continued

| Seq No. | Cluster ID | CloneID | Library | NCBI gi | Method | Score | P-value | % Ident |
|---|---|---|---|---|---|---|---|---|
| 3048 | 16 | 700742019H1 | SOYMON012 | g409574 | BLASTN | 483 | 1e−54 | 83 |
| 3049 | 16 | 700944396H1 | SOYMON024 | g169090 | BLASTN | 610 | 1e−54 | 84 |
| 3050 | 16 | 701139717H1 | SOYMON038 | g169090 | BLASTN | 639 | 1e−54 | 81 |
| 3051 | 16 | 700555467H1 | SOYMON001 | g20732 | BLASTN | 688 | 1e−54 | 81 |
| 3052 | 16 | 701041622H1 | SOYMON029 | g2905771 | BLASTN | 738 | 1e−54 | 96 |
| 3053 | 16 | 700736350H1 | SOYMON010 | g409574 | BLASTN | 754 | 1e−54 | 83 |
| 3054 | 16 | 700996720H1 | SOYMON018 | g409574 | BLASTN | 755 | 1e−54 | 82 |
| 3055 | 16 | 700987832H1 | SOYMON009 | g169090 | BLASTN | 759 | 1e−54 | 79 |
| 3056 | 16 | 700841935H1 | SOYMON020 | g20732 | BLASTN | 763 | 1e−54 | 81 |
| 3057 | 16 | 700808443H1 | SOYMON024 | g169090 | BLASTN | 765 | 1e−54 | 84 |
| 3058 | 16 | 700959733H1 | SOYMON022 | g409574 | BLASTN | 435 | 1e−53 | 81 |
| 3059 | 16 | 700646537H1 | SOYMON014 | g169090 | BLASTN | 445 | 1e−53 | 85 |
| 3060 | 16 | 701006244H2 | SOYMON019 | g169090 | BLASTN | 541 | 1e−53 | 85 |
| 3061 | 16 | 701059852H1 | SOYMON033 | g2905771 | BLASTN | 661 | 1e−53 | 92 |
| 3062 | 16 | 700876815H1 | SOYMON018 | g169090 | BLASTN | 668 | 1e−53 | 81 |
| 3063 | 16 | 700749752H1 | SOYMON013 | g19565 | BLASTN | 742 | 1e−53 | 84 |
| 3064 | 16 | 700736445H1 | SOYMON010 | g169090 | BLASTN | 746 | 1e−53 | 84 |
| 3065 | 16 | 700990431H1 | SOYMON011 | g20732 | BLASTN | 747 | 1e−53 | 86 |
| 3066 | 16 | 700990414H1 | SOYMON011 | g20732 | BLASTN | 749 | 1e−53 | 86 |
| 3067 | 16 | 700740171H1 | SOYMON012 | g169090 | BLASTN | 749 | 1e−53 | 83 |
| 3068 | 16 | 700875936H1 | SOYMON018 | g20732 | BLASTN | 400 | 1e−52 | 84 |
| 3069 | 16 | 701132471H1 | SOYMON038 | g409574 | BLASTN | 479 | 1e−52 | 82 |
| 3070 | 16 | 701064163H1 | SOYMON034 | g169090 | BLASTN | 519 | 1e−52 | 85 |
| 3071 | 16 | 701120529H1 | SOYMON037 | g169090 | BLASTN | 602 | 1e−52 | 80 |
| 3072 | 16 | 700787014H2 | SOYMON011 | g169090 | BLASTN | 622 | 1e−52 | 84 |
| 3073 | 16 | 701214833H1 | SOYMON035 | g169090 | BLASTN | 677 | 1e−52 | 82 |
| 3074 | 16 | 700741593H1 | SOYMON012 | g409574 | BLASTN | 707 | 1e−52 | 83 |
| 3075 | 16 | 700792328H1 | SOYMON017 | g2905771 | BLASTN | 715 | 1e−52 | 100 |
| 3076 | 16 | 700838427H1 | SOYMON020 | g169090 | BLASTN | 730 | 1e−52 | 79 |
| 3077 | 16 | 700985453H1 | SOYMON009 | g169090 | BLASTN | 731 | 1e−52 | 84 |
| 3078 | 16 | 700732002H1 | SOYMON010 | g169090 | BLASTN | 732 | 1e−52 | 77 |
| 3079 | 16 | 700906172H1 | SOYMON022 | g169090 | BLASTN | 732 | 1e−52 | 79 |
| 3080 | 16 | 701137118H1 | SOYMON038 | g19565 | BLASTN | 734 | 1e−52 | 84 |
| 3081 | 16 | 701013823H1 | SOYMON019 | g169090 | BLASTN | 736 | 1e−52 | 84 |
| 3082 | 16 | 700686616H1 | SOYMON008 | g309670 | BLASTN | 736 | 1e−52 | 88 |
| 3083 | 16 | 700962944H1 | SOYMON022 | g169090 | BLASTN | 737 | 1e−52 | 79 |
| 3084 | 16 | 700945903H1 | SOYMON024 | g169090 | BLASTN | 737 | 1e−52 | 79 |
| 3085 | 16 | 700863880H1 | SOYMON016 | g169090 | BLASTN | 737 | 1e−52 | 79 |
| 3086 | 16 | 700754937H1 | SOYMON014 | g169090 | BLASTN | 737 | 1e−52 | 79 |
| 3087 | 16 | 701059066H1 | SOYMON033 | g169090 | BLASTN | 737 | 1e−52 | 79 |
| 3088 | 16 | 700757083H1 | SOYMON015 | g169090 | BLASTN | 737 | 1e−52 | 81 |
| 3089 | 16 | 701043292H1 | SOYMON029 | g409574 | BLASTN | 739 | 1e−52 | 83 |
| 3090 | 16 | 700839971H1 | SOYMON020 | g169090 | BLASTN | 740 | 1e−52 | 78 |
| 3091 | 16 | 700897536H1 | SOYMON027 | g20732 | BLASTN | 740 | 1e−52 | 85 |
| 3092 | 16 | 700748758H1 | SOYMON013 | g169090 | BLASTN | 741 | 1e−52 | 80 |
| 3093 | 16 | 700737167H1 | SOYMON010 | g20550 | BLASTN | 474 | 1e−51 | 83 |
| 3094 | 16 | 700792472H1 | SOYMON017 | g409574 | BLASTN | 489 | 1e−51 | 84 |
| 3095 | 16 | 701002831H1 | SOYMON019 | g409574 | BLASTN | 495 | 1e−51 | 83 |
| 3096 | 16 | 701147120H1 | SOYMON031 | g169090 | BLASTN | 592 | 1e−51 | 86 |
| 3097 | 16 | 700993103H1 | SOYMON011 | g409574 | BLASTN | 679 | 1e−51 | 81 |
| 3098 | 16 | 700681212H1 | SOYMON008 | g20732 | BLASTN | 684 | 1e−51 | 82 |
| 3099 | 16 | 700787050H2 | SOYMON011 | g20732 | BLASTN | 722 | 1e−51 | 82 |
| 3100 | 16 | 700964087H1 | SOYMON022 | g169090 | BLASTN | 723 | 1e−51 | 83 |
| 3101 | 16 | 701131690H1 | SOYMON038 | g169090 | BLASTN | 724 | 1e−51 | 80 |
| 3102 | 16 | 701013216H1 | SOYMON019 | g169090 | BLASTN | 724 | 1e−51 | 84 |
| 3103 | 16 | 700752307H1 | SOYMON014 | g169090 | BLASTN | 727 | 1e−51 | 79 |
| 3104 | 16 | 700963986H1 | SOYMON022 | g169090 | BLASTN | 727 | 1e−51 | 79 |
| 3105 | 16 | 700945596H1 | SOYMON024 | g19565 | BLASTN | 728 | 1e−51 | 83 |
| 3106 | 16 | 700786782H2 | SOYMON011 | g169090 | BLASTN | 728 | 1e−51 | 79 |
| 3107 | 16 | 700686279H1 | SOYMON008 | g20732 | BLASTN | 415 | 1e−50 | 82 |
| 3108 | 16 | 700558939H1 | SOYMON001 | g20732 | BLASTN | 472 | 1e−50 | 78 |
| 3109 | 16 | 701118441H1 | SOYMON037 | g169090 | BLASTN | 495 | 1e−50 | 80 |
| 3110 | 16 | 701046150H1 | SOYMON032 | g169090 | BLASTN | 605 | 1e−50 | 83 |
| 3111 | 16 | 700876929H1 | SOYMON018 | g20732 | BLASTN | 681 | 1e−50 | 82 |
| 3112 | 16 | 700945352H1 | SOYMON024 | g2905771 | BLASTN | 685 | 1e−50 | 91 |
| 3113 | 16 | 700725046H1 | SOYMON009 | g2905771 | BLASTN | 688 | 1e−50 | 94 |
| 3114 | 16 | 700869271H1 | SOYMON016 | g2905771 | BLASTN | 688 | 1e−50 | 94 |
| 3115 | 16 | 700841465H1 | SOYMON020 | g19565 | BLASTN | 707 | 1e−50 | 83 |
| 3116 | 16 | 701213349H1 | SOYMON035 | g169090 | BLASTN | 712 | 1e−50 | 85 |
| 3117 | 16 | 700726069H1 | SOYMON009 | g19565 | BLASTN | 712 | 1e−50 | 84 |
| 3118 | 16 | 701055733H1 | SOYMON032 | g19565 | BLASTN | 712 | 1e−50 | 84 |
| 3119 | 16 | 700663235H1 | SOYMON005 | g169090 | BLASTN | 712 | 1e−50 | 79 |
| 3120 | 16 | 700963289H1 | SOYMON022 | g169090 | BLASTN | 712 | 1e−50 | 85 |
| 3121 | 16 | 700686557H1 | SOYMON008 | g169090 | BLASTN | 712 | 1e−50 | 85 |
| 3122 | 16 | 701127887H1 | SOYMON037 | g169090 | BLASTN | 713 | 1e−50 | 80 |
| 3123 | 16 | 700833351H1 | SOYMON019 | g169090 | BLASTN | 717 | 1e−50 | 85 |
| 3124 | 16 | 700975879H1 | SOYMON009 | g167043 | BLASTN | 379 | 1e−49 | 82 |

TABLE A*-continued

| Seq No. | Cluster ID | CloneID | Library | NCBI gi | Method | Score | P-value | % Ident |
|---|---|---|---|---|---|---|---|---|
| 3125 | 16 | 700731970H1 | SOYMON010 | g2905771 | BLASTN | 675 | 1e-49 | 100 |
| 3126 | 16 | 700750149H1 | SOYMON013 | g169090 | BLASTN | 695 | 1e-49 | 85 |
| 3127 | 16 | 700953068H1 | SOYMON022 | g169090 | BLASTN | 696 | 1e-49 | 79 |
| 3128 | 16 | 700847286H1 | SOYMON021 | g19565 | BLASTN | 696 | 1e-49 | 82 |
| 3129 | 16 | 701043647H1 | SOYMON029 | g19565 | BLASTN | 696 | 1e-49 | 82 |
| 3130 | 16 | 700985440H1 | SOYMON009 | g169090 | BLASTN | 698 | 1e-49 | 84 |
| 3131 | 16 | 701204172H1 | SOYMON035 | g169090 | BLASTN | 698 | 1e-49 | 84 |
| 3132 | 16 | 700944204H1 | SOYMON024 | g169090 | BLASTN | 701 | 1e-49 | 79 |
| 3133 | 16 | 700906132H1 | SOYMON022 | g169090 | BLASTN | 702 | 1e-49 | 85 |
| 3134 | 16 | 701145287H1 | SOYMON031 | g19565 | BLASTN | 702 | 1e-49 | 83 |
| 3135 | 16 | 700748555H1 | SOYMON013 | g19565 | BLASTN | 703 | 1e-49 | 83 |
| 3136 | 16 | 700791357H1 | SOYMON011 | g169090 | BLASTN | 704 | 1e-49 | 85 |
| 3137 | 16 | 701132090H1 | SOYMON038 | g409574 | BLASTN | 704 | 1e-49 | 83 |
| 3138 | 16 | 700998663H1 | SOYMON018 | g20732 | BLASTN | 705 | 1e-49 | 78 |
| 3139 | 16 | 701060890H1 | SOYMON033 | g2078297 | BLASTN | 429 | 1e-48 | 81 |
| 3140 | 16 | 700986781H1 | SOYMON009 | g166705 | BLASTN | 453 | 1e-48 | 83 |
| 3141 | 16 | 700953335H1 | SOYMON022 | g19565 | BLASTN | 623 | 1e-48 | 84 |
| 3142 | 16 | 701014706H1 | SOYMON019 | g19565 | BLASTN | 644 | 1e-48 | 85 |
| 3143 | 16 | 701119782H1 | SOYMON037 | g2905771 | BLASTN | 658 | 1e-48 | 92 |
| 3144 | 16 | 701108783H1 | SOYMON036 | g2905771 | BLASTN | 664 | 1e-48 | 97 |
| 3145 | 16 | 700866439H1 | SOYMON016 | g169090 | BLASTN | 682 | 1e-48 | 77 |
| 3146 | 16 | 700762316H1 | SOYMON015 | g169090 | BLASTN | 682 | 1e-48 | 83 |
| 3147 | 16 | 700901056H1 | SOYMON027 | g169090 | BLASTN | 686 | 1e-48 | 79 |
| 3148 | 16 | 701104412H1 | SOYMON036 | g20732 | BLASTN | 690 | 1e-48 | 79 |
| 3149 | 16 | 700738192H1 | SOYMON012 | g20732 | BLASTN | 690 | 1e-48 | 79 |
| 3150 | 16 | 700752442H1 | SOYMON014 | g20732 | BLASTN | 690 | 1e-48 | 79 |
| 3151 | 16 | 700740385H1 | SOYMON012 | g20732 | BLASTN | 690 | 1e-48 | 79 |
| 3152 | 16 | 701137084H1 | SOYMON038 | g169090 | BLASTN | 691 | 1e-48 | 84 |
| 3153 | 16 | 701010003H2 | SOYMON019 | g169090 | BLASTN | 692 | 1e-48 | 85 |
| 3154 | 16 | 700833047H1 | SOYMON019 | g169090 | BLASTN | 546 | 1e-47 | 86 |
| 3155 | 16 | 700855933H1 | SOYMON023 | g169090 | BLASTN | 550 | 1e-47 | 85 |
| 3156 | 16 | 701014245H1 | SOYMON019 | g19565 | BLASTN | 581 | 1e-47 | 84 |
| 3157 | 16 | 700762962H1 | SOYMON015 | g169090 | BLASTN | 604 | 1e-47 | 86 |
| 3158 | 16 | 700975559H1 | SOYMON009 | g2905771 | BLASTN | 645 | 1e-47 | 100 |
| 3159 | 16 | 701151663H1 | SOYMON031 | g169090 | BLASTN | 671 | 1e-47 | 85 |
| 3160 | 16 | 700840645H1 | SOYMON020 | g169090 | BLASTN | 672 | 1e-47 | 80 |
| 3161 | 16 | 700787505H1 | SOYMON011 | g20732 | BLASTN | 674 | 1e-47 | 80 |
| 3162 | 16 | 700672894H1 | SOYMON006 | g169090 | BLASTN | 675 | 1e-47 | 83 |
| 3163 | 16 | 700678041H1 | SOYMON007 | g20732 | BLASTN | 677 | 1e-47 | 80 |
| 3164 | 16 | 701205624H1 | SOYMON035 | g409574 | BLASTN | 680 | 1e-47 | 82 |
| 3165 | 16 | 701044525H1 | SOYMON032 | g169090 | BLASTN | 681 | 1e-47 | 90 |
| 3166 | 16 | 700998789H1 | SOYMON018 | g169090 | BLASTN | 681 | 1e-47 | 78 |
| 3167 | 16 | 700997577H1 | SOYMON018 | g20732 | BLASTN | 681 | 1e-47 | 79 |
| 3168 | 16 | 700849115H1 | SOYMON021 | g2905771 | BLASTN | 350 | 1e-46 | 95 |
| 3169 | 16 | 700660742H1 | SOYMON005 | g169090 | BLASTN | 351 | 1e-46 | 76 |
| 3170 | 16 | 700752256H1 | SOYMON014 | g309670 | BLASTN | 374 | 1e-46 | 80 |
| 3171 | 16 | 700907488H1 | SOYMON022 | g169090 | BLASTN | 467 | 1e-46 | 82 |
| 3172 | 16 | 701146736H1 | SOYMON031 | g19565 | BLASTN | 568 | 1e-46 | 81 |
| 3173 | 16 | 700872466H1 | SOYMON018 | g20732 | BLASTN | 596 | 1e-46 | 81 |
| 3174 | 16 | 701057780H1 | SOYMON033 | g169090 | BLASTN | 610 | 1e-46 | 87 |
| 3175 | 16 | 701145459H1 | SOYMON031 | g169090 | BLASTN | 660 | 1e-46 | 88 |
| 3176 | 16 | 701210858H1 | SOYMON035 | g19565 | BLASTN | 660 | 1e-46 | 84 |
| 3177 | 16 | 700877001H1 | SOYMON018 | g20732 | BLASTN | 662 | 1e-46 | 77 |
| 3178 | 16 | 700742465H1 | SOYMON012 | g169090 | BLASTN | 664 | 1e-46 | 86 |
| 3179 | 16 | 700763342H1 | SOYMON015 | g169090 | BLASTN | 668 | 1e-46 | 79 |
| 3180 | 16 | 700685380H1 | SOYMON008 | g20732 | BLASTN | 669 | 1e-46 | 78 |
| 3181 | 16 | 701149865H1 | SOYMON031 | g2905771 | BLASTN | 330 | 1e-45 | 100 |
| 3182 | 16 | 700891972H1 | SOYMON024 | g169090 | BLASTN | 434 | 1e-45 | 78 |
| 3183 | 16 | 700750391H1 | SOYMON013 | g169090 | BLASTN | 436 | 1e-45 | 78 |
| 3184 | 16 | 700683883H1 | SOYMON008 | g169090 | BLASTN | 436 | 1e-45 | 84 |
| 3185 | 16 | 700729088H1 | SOYMON009 | g2078297 | BLASTN | 509 | 1e-45 | 85 |
| 3186 | 16 | 700903141H1 | SOYMON022 | g19565 | BLASTN | 577 | 1e-45 | 84 |
| 3187 | 16 | 701202337H1 | SOYMON035 | g169090 | BLASTN | 603 | 1e-45 | 84 |
| 3188 | 16 | 701155013H1 | SOYMON031 | g19565 | BLASTN | 647 | 1e-45 | 86 |
| 3189 | 16 | 700844326H1 | SOYMON021 | g19565 | BLASTN | 651 | 1e-45 | 86 |
| 3190 | 16 | 700741362H1 | SOYMON012 | g169090 | BLASTN | 651 | 1e-45 | 84 |
| 3191 | 16 | 700755283H1 | SOYMON014 | g169090 | BLASTN | 652 | 1e-45 | 87 |
| 3192 | 16 | 700751536H1 | SOYMON014 | g20732 | BLASTN | 652 | 1e-45 | 79 |
| 3193 | 16 | 700684196H1 | SOYMON008 | g20732 | BLASTN | 654 | 1e-45 | 79 |
| 3194 | 16 | 700684881H1 | SOYMON008 | g20732 | BLASTN | 657 | 1e-45 | 92 |
| 3195 | 16 | 700680531H1 | SOYMON008 | g20732 | BLASTN | 429 | 1e-44 | 79 |
| 3196 | 16 | 701106044H1 | SOYMON036 | g20732 | BLASTN | 592 | 1e-44 | 78 |
| 3197 | 16 | 700979630H2 | SOYMON009 | g2905771 | BLASTN | 618 | 1e-44 | 97 |
| 3198 | 16 | 700751095H1 | SOYMON014 | g169090 | BLASTN | 634 | 1e-44 | 82 |
| 3199 | 16 | 701153515H1 | SOYMON031 | g19565 | BLASTN | 639 | 1e-44 | 85 |
| 3200 | 16 | 700741789H1 | SOYMON012 | g20732 | BLASTN | 641 | 1e-44 | 82 |
| 3201 | 16 | 701204330H2 | SOYMON035 | g19565 | BLASTN | 643 | 1e-44 | 86 |

TABLE A*-continued

| Seq No. | Cluster ID | CloneID | Library | NCBI gi | Method | Score | P-value | % Ident |
|---|---|---|---|---|---|---|---|---|
| 3202 | 16 | 700967679H1 | SOYMON032 | g409574 | BLASTN | 643 | 1e−44 | 83 |
| 3203 | 16 | 700972372H1 | SOYMON005 | g169090 | BLASTN | 644 | 1e−44 | 74 |
| 3204 | 16 | 700974446H1 | SOYMON005 | g19565 | BLASTN | 644 | 1e−44 | 85 |
| 3205 | 16 | 701146670H1 | SOYMON031 | g19565 | BLASTN | 341 | 1e−43 | 81 |
| 3206 | 16 | 701102507H1 | SOYMON028 | g169090 | BLASTN | 432 | 1e−43 | 86 |
| 3207 | 16 | 701006744H1 | SOYMON019 | g169090 | BLASTN | 453 | 1e−43 | 85 |
| 3208 | 16 | 700835690H1 | SOYMON019 | g169090 | BLASTN | 479 | 1e−43 | 84 |
| 3209 | 16 | 700983742H1 | SOYMON009 | g169090 | BLASTN | 529 | 1e−43 | 87 |
| 3210 | 16 | 700654457H1 | SOYMON004 | g169090 | BLASTN | 601 | 1e−43 | 80 |
| 3211 | 16 | 700555371H1 | SOYMON001 | g20732 | BLASTN | 623 | 1e−43 | 78 |
| 3212 | 16 | 700991260H1 | SOYMON011 | g19565 | BLASTN | 623 | 1e−43 | 86 |
| 3213 | 16 | 701109867H1 | SOYMON036 | g20732 | BLASTN | 623 | 1e−43 | 78 |
| 3214 | 16 | 701151625H1 | SOYMON031 | g19565 | BLASTN | 626 | 1e−43 | 84 |
| 3215 | 16 | 700748787H1 | SOYMON013 | g169090 | BLASTN | 630 | 1e−43 | 78 |
| 3216 | 16 | 700754611H1 | SOYMON014 | g19565 | BLASTN | 631 | 1e−43 | 85 |
| 3217 | 16 | 700852565H1 | SOYMON023 | g169090 | BLASTN | 611 | 1e−42 | 78 |
| 3218 | 16 | 700791713H1 | SOYMON011 | g20732 | BLASTN | 612 | 1e−42 | 72 |
| 3219 | 16 | 701205047H1 | SOYMON035 | g19565 | BLASTN | 613 | 1e−42 | 85 |
| 3220 | 16 | 700972230H1 | SOYMON005 | g169090 | BLASTN | 614 | 1e−42 | 79 |
| 3221 | 16 | 701157734H1 | SOYMON031 | g19565 | BLASTN | 617 | 1e−42 | 86 |
| 3222 | 16 | 700567308H1 | SOYMON002 | g169090 | BLASTN | 621 | 1e−42 | 81 |
| 3223 | 16 | 700741053H1 | SOYMON012 | g20732 | BLASTN | 454 | 1e−41 | 83 |
| 3224 | 16 | 701124645H1 | SOYMON037 | g19565 | BLASTN | 505 | 1e−41 | 81 |
| 3225 | 16 | 700738430H1 | SOYMON012 | g169090 | BLASTN | 598 | 1e−41 | 83 |
| 3226 | 16 | 700980387H1 | SOYMON009 | g169090 | BLASTN | 607 | 1e−41 | 86 |
| 3227 | 16 | 701109905H1 | SOYMON036 | g169090 | BLASTN | 609 | 1e−41 | 87 |
| 3228 | 16 | 700756857H1 | SOYMON014 | g169090 | BLASTN | 352 | 1e−40 | 80 |
| 3229 | 16 | 700685415H1 | SOYMON008 | g20732 | BLASTN | 373 | 1e−40 | 83 |
| 3230 | 16 | 700999463H1 | SOYMON018 | g20732 | BLASTN | 373 | 1e−40 | 79 |
| 3231 | 16 | 700899494H1 | SOYMON027 | g169090 | BLASTN | 472 | 1e−40 | 88 |
| 3232 | 16 | 701152616H1 | SOYMON031 | g19565 | BLASTN | 587 | 1e−40 | 84 |
| 3233 | 16 | 700682787H1 | SOYMON008 | g20732 | BLASTN | 588 | 1e−40 | 75 |
| 3234 | 16 | 700997526H1 | SOYMON018 | g20732 | BLASTN | 588 | 1e−40 | 88 |
| 3235 | 16 | 701152717H1 | SOYMON031 | g19565 | BLASTN | 589 | 1e−40 | 87 |
| 3236 | 16 | 701156106H1 | SOYMON031 | g19565 | BLASTN | 590 | 1e−40 | 87 |
| 3237 | 16 | 700757283H1 | SOYMON015 | g169090 | BLASTN | 592 | 1e−40 | 75 |
| 3238 | 16 | 701153845H1 | SOYMON031 | g19565 | BLASTN | 595 | 1e−40 | 87 |
| 3239 | 16 | 701152664H1 | SOYMON031 | g19565 | BLASTN | 596 | 1e−40 | 86 |
| 3240 | 16 | 700960557H1 | SOYMON022 | g169090 | BLASTN | 280 | 1e−39 | 82 |
| 3241 | 16 | 701046409H1 | SOYMON032 | g409574 | BLASTN | 371 | 1e−39 | 76 |
| 3242 | 16 | 700648740H1 | SOYMON003 | g409574 | BLASTN | 385 | 1e−39 | 89 |
| 3243 | 16 | 700728066H1 | SOYMON009 | g169090 | BLASTN | 461 | 1e−39 | 73 |
| 3244 | 16 | 700740668H1 | SOYMON012 | g20732 | BLASTN | 575 | 1e−39 | 73 |
| 3245 | 16 | 701149559H1 | SOYMON031 | g19565 | BLASTN | 575 | 1e−39 | 86 |
| 3246 | 16 | 701124058H1 | SOYMON037 | g20732 | BLASTN | 576 | 1e−39 | 80 |
| 3247 | 16 | 701154958H1 | SOYMON031 | g19565 | BLASTN | 577 | 1e−39 | 86 |
| 3248 | 16 | 701149995H1 | SOYMON031 | g19565 | BLASTN | 583 | 1e−39 | 87 |
| 3249 | 16 | 701145383H1 | SOYMON031 | g19565 | BLASTN | 585 | 1e−39 | 84 |
| 3250 | 16 | 701064544H1 | SOYMON034 | g2905771 | BLASTN | 326 | 1e−38 | 93 |
| 3251 | 16 | 700992479H1 | SOYMON011 | g2078297 | BLASTN | 374 | 1e−38 | 80 |
| 3252 | 16 | 700739262H1 | SOYMON012 | g20732 | BLASTN | 441 | 1e−38 | 80 |
| 3253 | 16 | 700999632H1 | SOYMON018 | g20732 | BLASTN | 509 | 1e−38 | 79 |
| 3254 | 16 | 700743974H1 | SOYMON012 | g20732 | BLASTN | 562 | 1e−38 | 80 |
| 3255 | 16 | 700835707H1 | SOYMON019 | g169090 | BLASTN | 562 | 1e−38 | 86 |
| 3256 | 16 | 700844641H1 | SOYMON021 | g19565 | BLASTN | 562 | 1e−38 | 88 |
| 3257 | 16 | 701048040H1 | SOYMON032 | g169090 | BLASTN | 571 | 1e−38 | 87 |
| 3258 | 16 | 700829978H1 | SOYMON019 | g19565 | BLASTN | 573 | 1e−38 | 84 |
| 3259 | 16 | 700875006H1 | SOYMON018 | g20732 | BLASTN | 336 | 1e−37 | 91 |
| 3260 | 16 | 700830281H1 | SOYMON019 | g19565 | BLASTN | 376 | 1e−37 | 83 |
| 3261 | 16 | 700990514H1 | SOYMON011 | g20732 | BLASTN | 550 | 1e−37 | 79 |
| 3262 | 16 | 701153744H1 | SOYMON031 | g19565 | BLASTN | 557 | 1e−37 | 88 |
| 3263 | 16 | 700742768H1 | SOYMON012 | g169090 | BLASTN | 558 | 1e−37 | 90 |
| 3264 | 16 | 701149314H1 | SOYMON031 | g19565 | BLASTN | 559 | 1e−37 | 88 |
| 3265 | 16 | 700961862H1 | SOYMON022 | g169090 | BLASTN | 559 | 1e−37 | 86 |
| 3266 | 16 | 700875647H1 | SOYMON018 | g20732 | BLASTN | 560 | 1e−37 | 81 |
| 3267 | 16 | 700958014H1 | SOYMON022 | g19565 | BLASTN | 465 | 1e−36 | 81 |
| 3268 | 16 | 700854826H1 | SOYMON023 | g2905771 | BLASTN | 517 | 1e−36 | 95 |
| 3269 | 16 | 701106984H1 | SOYMON036 | g20732 | BLASTN | 539 | 1e−36 | 79 |
| 3270 | 16 | 700740352H1 | SOYMON012 | g20732 | BLASTN | 539 | 1e−36 | 79 |
| 3271 | 16 | 700903658H1 | SOYMON022 | g19565 | BLASTN | 542 | 1e−36 | 85 |
| 3272 | 16 | 700756593H1 | SOYMON014 | g19565 | BLASTN | 545 | 1e−36 | 88 |
| 3273 | 16 | 700789341H2 | SOYMON011 | g169090 | BLASTN | 546 | 1e−36 | 86 |
| 3274 | 16 | 700751528H1 | SOYMON014 | g20732 | BLASTN | 549 | 1e−36 | 78 |
| 3275 | 16 | 701046242H1 | SOYMON032 | g169090 | BLASTN | 549 | 1e−36 | 86 |
| 3276 | 16 | 700606131H2 | SOYMON008 | g20732 | BLASTN | 257 | 1e−35 | 80 |
| 3277 | 16 | 701063749H1 | SOYMON034 | g2905771 | BLASTN | 355 | 1e−35 | 97 |
| 3278 | 16 | 701156830H1 | SOYMON031 | g19565 | BLASTN | 401 | 1e−35 | 88 |

TABLE A*-continued

| Seq No. | Cluster ID | CloneID | Library | NCBI gi | Method | Score | P-value | % Ident |
|---|---|---|---|---|---|---|---|---|
| 3279 | 16 | 701123759H1 | SOYMON037 | g20732 | BLASTN | 527 | 1e-35 | 77 |
| 3280 | 16 | 700833470H1 | SOYMON019 | g19565 | BLASTN | 533 | 1e-35 | 86 |
| 3281 | 16 | 701043561H1 | SOYMON029 | g169090 | BLASTN | 307 | 1e-34 | 81 |
| 3282 | 16 | 700685547H1 | SOYMON008 | g20732 | BLASTN | 352 | 1e-34 | 77 |
| 3283 | 16 | 701215104H1 | SOYMON035 | g169090 | BLASTN | 424 | 1e-34 | 87 |
| 3284 | 16 | 701156675H1 | SOYMON031 | g169090 | BLASTN | 439 | 1e-34 | 84 |
| 3285 | 16 | 700650109H1 | SOYMON003 | g169090 | BLASTN | 505 | 1e-34 | 83 |
| 3286 | 16 | 700996816H1 | SOYMON018 | g20732 | BLASTN | 514 | 1e-34 | 89 |
| 3287 | 16 | 700875986H1 | SOYMON018 | g20732 | BLASTN | 517 | 1e-34 | 79 |
| 3288 | 16 | 700875036H1 | SOYMON018 | g20732 | BLASTN | 520 | 1e-34 | 79 |
| 3289 | 16 | 700760859H1 | SOYMON015 | g169090 | BLASTN | 521 | 1e-34 | 85 |
| 3290 | 16 | 701203868H1 | SOYMON035 | g19565 | BLASTN | 522 | 1e-34 | 75 |
| 3291 | 16 | 700684625H1 | SOYMON008 | g20732 | BLASTN | 523 | 1e-34 | 88 |
| 3292 | 16 | 700743827H1 | SOYMON012 | g20550 | BLASTN | 277 | 1e-33 | 84 |
| 3293 | 16 | 700895366H1 | SOYMON027 | g20732 | BLASTN | 509 | 1e-33 | 71 |
| 3294 | 16 | 701155325H1 | SOYMON031 | g169090 | BLASTN | 393 | 1e-32 | 78 |
| 3295 | 16 | 700979884H2 | SOYMON009 | g19565 | BLASTN | 493 | 1e-32 | 87 |
| 3296 | 16 | 700956948H1 | SOYMON022 | g19565 | BLASTN | 497 | 1e-32 | 82 |
| 3297 | 16 | 700983542H1 | SOYMON009 | g19565 | BLASTN | 326 | 1e-31 | 76 |
| 3298 | 16 | 700750157H1 | SOYMON013 | g169090 | BLASTN | 483 | 1e-31 | 79 |
| 3299 | 16 | 700856401H1 | SOYMON023 | g19565 | BLASTN | 485 | 1e-31 | 79 |
| 3300 | 16 | 701153529H1 | SOYMON031 | g19565 | BLASTN | 487 | 1e-31 | 89 |
| 3301 | 16 | 700740510H1 | SOYMON012 | g169090 | BLASTN | 404 | 1e-30 | 84 |
| 3302 | 16 | 700742952H1 | SOYMON012 | g20732 | BLASTN | 472 | 1e-30 | 83 |
| 3303 | 16 | 700754658H1 | SOYMON014 | g2078297 | BLASTN | 385 | 1e-29 | 85 |
| 3304 | 16 | 700876748H1 | SOYMON018 | g20732 | BLASTN | 457 | 1e-29 | 74 |
| 3305 | 16 | 700673094H1 | SOYMON006 | g19565 | BLASTN | 460 | 1e-29 | 78 |
| 3306 | 16 | 700741756H1 | SOYMON012 | g20732 | BLASTN | 462 | 1e-29 | 79 |
| 3307 | 16 | 701209936H1 | SOYMON035 | g169090 | BLASTN | 464 | 1e-29 | 86 |
| 3308 | 16 | 700997818H1 | SOYMON018 | g20732 | BLASTN | 473 | 1e-29 | 78 |
| 3309 | 16 | 701150960H1 | SOYMON031 | g169090 | BLASTN | 447 | 1e-28 | 83 |
| 3310 | 16 | 700685752H1 | SOYMON008 | g20732 | BLASTN | 467 | 1e-28 | 80 |
| 3311 | 16 | 700981608H1 | SOYMON009 | g20732 | BLASTN | 467 | 1e-28 | 80 |
| 3312 | 16 | 700742082H1 | SOYMON012 | g20732 | BLASTN | 322 | 1e-27 | 83 |
| 3313 | 16 | 701146456H1 | SOYMON031 | g169090 | BLASTN | 352 | 1e-27 | 86 |
| 3314 | 16 | 700977936H1 | SOYMON009 | g2905771 | BLASTN | 423 | 1e-27 | 98 |
| 3315 | 16 | 700897772H1 | SOYMON027 | g20732 | BLASTN | 446 | 1e-27 | 83 |
| 3316 | 16 | 701064028H1 | SOYMON034 | g20732 | BLASTN | 454 | 1e-27 | 82 |
| 3317 | 16 | 701044915H1 | SOYMON032 | g19565 | BLASTN | 316 | 1e-26 | 88 |
| 3318 | 16 | 700976839H1 | SOYMON009 | g2905771 | BLASTN | 423 | 1e-26 | 98 |
| 3319 | 16 | 700830091H1 | SOYMON019 | g19565 | BLASTN | 426 | 1e-26 | 86 |
| 3320 | 16 | 700961412H1 | SOYMON022 | g19565 | BLASTN | 427 | 1e-26 | 83 |
| 3321 | 16 | 701104716H1 | SOYMON036 | g20732 | BLASTN | 441 | 1e-26 | 81 |
| 3322 | 16 | 700738003H1 | SOYMON012 | g19565 | BLASTN | 413 | 1e-25 | 87 |
| 3323 | 16 | 700908925H1 | SOYMON022 | g21142 | BLASTN | 262 | 1e-24 | 87 |
| 3324 | 16 | 701130161H1 | SOYMON037 | g19565 | BLASTN | 398 | 1e-24 | 75 |
| 3325 | 16 | 700754740H1 | SOYMON014 | g309670 | BLASTN | 304 | 1e-21 | 76 |
| 3326 | 16 | 700990677H1 | SOYMON011 | g169090 | BLASTN | 361 | 1e-21 | 88 |
| 3327 | 16 | 700662952H1 | SOYMON005 | g19565 | BLASTN | 349 | 1e-20 | 86 |
| 3328 | 16 | 700890971H1 | SOYMON024 | g2905771 | BLASTN | 355 | 1e-20 | 100 |
| 3329 | 16 | 700745113H1 | SOYMON013 | g166705 | BLASTN | 376 | 1e-20 | 86 |
| 3330 | 16 | 700683049H1 | SOYMON008 | g256965 | BLASTX | 95 | 1e-19 | 72 |
| 3331 | 16 | 701043808H1 | SOYMON032 | g2078297 | BLASTN | 192 | 1e-17 | 76 |
| 3332 | 16 | 700563254H1 | SOYMON002 | g2905771 | BLASTN | 326 | 1e-17 | 99 |
| 3333 | 16 | 701068370H1 | SOYMON034 | g2905771 | BLASTN | 329 | 1e-17 | 95 |
| 3334 | 16 | 700840885H1 | SOYMON020 | g21066 | BLASTX | 83 | 1e-16 | 77 |
| 3335 | 16 | 701146974H1 | SOYMON031 | g18978 | BLASTX | 99 | 1e-16 | 79 |
| 3336 | 16 | 700874586H1 | SOYMON018 | g309671 | BLASTX | 171 | 1e-16 | 89 |
| 3337 | 16 | 701156431H1 | SOYMON031 | g309671 | BLASTX | 172 | 1e-16 | 68 |
| 3338 | 16 | 700731566H1 | SOYMON010 | g1185556 | BLASTX | 152 | 1e-15 | 91 |
| 3339 | 16 | 700739659H1 | SOYMON012 | g309671 | BLASTX | 161 | 1e-15 | 71 |
| 3340 | 16 | 700678096H1 | SOYMON007 | g169090 | BLASTN | 177 | 1e-15 | 81 |
| 3341 | 16 | 700957692H1 | SOYMON022 | g1185556 | BLASTX | 147 | 1e-14 | 88 |
| 3342 | 16 | 700554603H1 | SOYMON001 | g20732 | BLASTN | 195 | 1e-14 | 81 |
| 3343 | 16 | 701126861H1 | SOYMON037 | g19565 | BLASTN | 246 | 1e-14 | 85 |
| 3344 | 16 | 700679091H2 | SOYMON007 | g166705 | BLASTN | 266 | 1e-13 | 76 |
| 3345 | 16 | 700737463H1 | SOYMON010 | g1185556 | BLASTX | 130 | 1e-12 | 89 |
| 3346 | 16 | 700870957H1 | SOYMON018 | g309670 | BLASTN | 282 | 1e-12 | 80 |
| 3347 | 16 | 700651065H1 | SOYMON003 | g2905772 | BLASTX | 121 | 1e-11 | 100 |
| 3348 | 16 | 701064564H1 | SOYMON034 | g1185556 | BLASTX | 123 | 1e-11 | 89 |
| 3349 | 16 | 701000079H1 | SOYMON018 | g1185556 | BLASTX | 126 | 1e-11 | 81 |
| 3350 | 16 | 700606257H1 | SOYMON008 | g309671 | BLASTX | 136 | 1e-11 | 72 |
| 3351 | 16 | 700752373H1 | SOYMON014 | g19565 | BLASTN | 270 | 1e-11 | 92 |
| 3352 | 16 | 701130139H1 | SOYMON037 | g2905772 | BLASTX | 86 | 1e-10 | 96 |
| 3353 | 16 | 700646156H1 | SOYMON012 | g1185556 | BLASTX | 110 | 1e-9 | 92 |
| 3354 | 16 | 700743668H1 | SOYMON012 | g20551 | BLASTX | 121 | 1e-9 | 85 |
| 3355 | 16 | 700648908H1 | SOYMON003 | g19565 | BLASTN | 217 | 1e-9 | 90 |

TABLE A*-continued

| Seq No. | Cluster ID | CloneID | Library | NCBI gi | Method | Score | P-value | % Ident |
|---|---|---|---|---|---|---|---|---|
| 3356 | 16 | 700563235H1 | SOYMON002 | g169090 | BLASTN | 220 | 1e−9 | 85 |
| 3357 | 1976 | 700961292H1 | SOYMON022 | g496493 | BLASTN | 1040 | 1e−77 | 90 |
| 3358 | 1976 | 700963585H1 | SOYMON022 | g496493 | BLASTN | 1027 | 1e−76 | 86 |
| 3359 | 1976 | 700683563H1 | SOYMON008 | g496493 | BLASTN | 1007 | 1e−75 | 86 |
| 3360 | 1976 | 700791132H1 | SOYMON011 | g496493 | BLASTN | 949 | 1e−70 | 86 |
| 3361 | 1976 | 700890465H1 | SOYMON024 | g496493 | BLASTN | 529 | 1e−68 | 87 |
| 3362 | 1976 | 700983190H1 | SOYMON009 | g496493 | BLASTN | 904 | 1e−66 | 85 |
| 3363 | 1976 | 700983490H1 | SOYMON009 | g496493 | BLASTN | 887 | 1e−65 | 81 |
| 3364 | 1976 | 700992647H1 | SOYMON011 | g496493 | BLASTN | 460 | 1e−56 | 85 |
| 3365 | 1976 | 701128429H1 | SOYMON037 | g496493 | BLASTN | 718 | 1e−51 | 86 |
| 3366 | 1976 | 700726390H1 | SOYMON009 | g496493 | BLASTN | 694 | 1e−49 | 81 |
| 3367 | 1976 | 700764629H1 | SOYMON022 | g496493 | BLASTN | 529 | 1e−35 | 83 |
| 3368 | 1976 | 700729434H1 | SOYMON009 | g496493 | BLASTN | 382 | 1e−34 | 85 |
| 3369 | 1976 | 700957553H1 | SOYMON022 | g496493 | BLASTN | 520 | 1e−34 | 91 |
| 3370 | 2207 | 700726706H1 | SOYMON009 | g496493 | BLASTN | 1080 | 1e−81 | 88 |
| 3371 | 2207 | 700553529H1 | SOYMON001 | g496493 | BLASTN | 1041 | 1e−77 | 87 |
| 3372 | 2207 | 700739431H1 | SOYMON012 | g496493 | BLASTN | 937 | 1e−69 | 85 |
| 3373 | 2207 | 700875340H1 | SOYMON018 | g496493 | BLASTN | 875 | 1e−64 | 83 |
| 3374 | 2207 | 700962678H1 | SOYMON022 | g496493 | BLASTN | 844 | 1e−61 | 83 |
| 3375 | 2207 | 701214788H1 | SOYMON035 | g496493 | BLASTN | 613 | 1e−42 | 80 |
| 3376 | 26781 | 701213755H1 | SOYMON035 | g1100222 | BLASTN | 535 | 1e−55 | 79 |
| 3377 | 26781 | 701213579H1 | SOYMON035 | g1100222 | BLASTN | 535 | 1e−45 | 79 |
| 3378 | 3953 | 701061621H1 | SOYMON033 | g172766 | BLASTX | 104 | 1e−12 | 62 |
| 3379 | 4979 | 700566452H1 | SOYMON002 | g166705 | BLASTN | 1068 | 1e−80 | 85 |
| 3380 | 4979 | 701051147H1 | SOYMON032 | g166705 | BLASTN | 993 | 1e−74 | 83 |
| 3381 | 4979 | 700851348H1 | SOYMON023 | g166705 | BLASTN | 603 | 1e−73 | 87 |
| 3382 | 4979 | 700851470H1 | SOYMON023 | g166705 | BLASTN | 978 | 1e−72 | 87 |
| 3383 | 4979 | 701014769H1 | SOYMON019 | g166705 | BLASTN | 979 | 1e−72 | 84 |
| 3384 | 4979 | 700667186H1 | SOYMON006 | g21065 | BLASTN | 964 | 1e−71 | 86 |
| 3385 | 4979 | 700734161H1 | SOYMON010 | g21065 | BLASTN | 956 | 1e−70 | 89 |
| 3386 | 4979 | 700669545H1 | SOYMON006 | g166705 | BLASTN | 783 | 1e−65 | 84 |
| 3387 | 4979 | 700895425H1 | SOYMON027 | g16021 | BLASTN | 834 | 1e−65 | 82 |
| 3388 | 4979 | 701050651H1 | SOYMON032 | g409574 | BLASTN | 892 | 1e−65 | 84 |
| 3389 | 4979 | 701014770H1 | SOYMON019 | g409574 | BLASTN | 680 | 1e−62 | 83 |
| 3390 | 4979 | 700786662H1 | SOYMON011 | g166709 | BLASTN | 445 | 1e−60 | 85 |
| 3391 | 4979 | 700974162H1 | SOYMON005 | g167259 | BLASTN | 824 | 1e−59 | 83 |
| 3392 | 4979 | 700843984H1 | SOYMON021 | g16021 | BLASTN | 801 | 1e−57 | 84 |
| 3393 | 4979 | 700893406H1 | SOYMON024 | g166705 | BLASTN | 485 | 1e−56 | 82 |
| 3394 | 4979 | 700740022H1 | SOYMON012 | g167259 | BLASTN | 654 | 1e−56 | 84 |
| 3395 | 4979 | 701051962H1 | SOYMON032 | g166709 | BLASTN | 509 | 1e−53 | 87 |
| 3396 | 4979 | 700899741H1 | SOYMON027 | g2078297 | BLASTN | 746 | 1e−53 | 84 |
| 3397 | 4979 | 700890234H1 | SOYMON024 | g167259 | BLASTN | 671 | 1e−47 | 82 |
| 3398 | 4979 | 701043720H1 | SOYMON032 | g166705 | BLASTN | 571 | 1e−38 | 87 |
| 3399 | 4979 | 700893919H1 | SOYMON024 | g1345501 | BLASTX | 179 | 1e−17 | 88 |
| 3400 | 535 | 701064754H1 | SOYMON034 | g496493 | BLASTN | 1077 | 1e−80 | 88 |
| 3401 | 535 | 700660246H1 | SOYMON004 | g496493 | BLASTN | 1022 | 1e−76 | 90 |
| 3402 | 535 | 700725553H1 | SOYMON009 | g496493 | BLASTN | 978 | 1e−72 | 86 |
| 3403 | 535 | 700906586H1 | SOYMON022 | g496493 | BLASTN | 745 | 1e−62 | 89 |
| 3404 | 535 | 700555311H1 | SOYMON001 | g496493 | BLASTN | 855 | 1e−62 | 78 |
| 3405 | 535 | 700655860H1 | SOYMON004 | g496493 | BLASTN | 792 | 1e−57 | 86 |
| 3406 | 535 | 700656931H1 | SOYMON004 | g496493 | BLASTN | 669 | 1e−46 | 86 |
| 3407 | 535 | 700684630H1 | SOYMON008 | g496493 | BLASTN | 528 | 1e−35 | 83 |
| 3408 | 535 | 700999674H1 | SOYMON018 | g1842115 | BLASTX | 183 | 1e−18 | 92 |
| 3409 | 667 | 700763868H1 | SOYMON018 | g496493 | BLASTN | 973 | 1e−74 | 83 |
| 3410 | 667 | 700789653H2 | SOYMON011 | g496493 | BLASTN | 928 | 1e−68 | 85 |
| 3411 | 667 | 700986940H1 | SOYMON009 | g496493 | BLASTN | 929 | 1e−68 | 81 |
| 3412 | 667 | 700982690H1 | SOYMON009 | g496493 | BLASTN | 845 | 1e−64 | 85 |
| 3413 | 667 | 700975608H1 | SOYMON009 | g496493 | BLASTN | 875 | 1e−64 | 82 |
| 3414 | 667 | 700874732H1 | SOYMON018 | g496493 | BLASTN | 679 | 1e−63 | 82 |
| 3415 | 667 | 700956280H1 | SOYMON022 | g496493 | BLASTN | 809 | 1e−61 | 84 |
| 3416 | 667 | 700891885H1 | SOYMON024 | g496493 | BLASTN | 816 | 1e−61 | 83 |
| 3417 | 667 | 701145577H1 | SOYMON031 | g496493 | BLASTN | 764 | 1e−60 | 84 |
| 3418 | 667 | 700975787H1 | SOYMON009 | g496493 | BLASTN | 487 | 1e−59 | 83 |
| 3419 | 667 | 700989677H1 | SOYMON011 | g496493 | BLASTN | 590 | 1e−58 | 84 |
| 3420 | 667 | 700941396H1 | SOYMON024 | g496493 | BLASTN | 781 | 1e−58 | 85 |
| 3421 | 667 | 700985895H1 | SOYMON009 | g496493 | BLASTN | 449 | 1e−57 | 82 |
| 3422 | 667 | 700788465H1 | SOYMON011 | g496493 | BLASTN | 800 | 1e−57 | 80 |
| 3423 | 667 | 700898809H1 | SOYMON027 | g496493 | BLASTN | 743 | 1e−55 | 82 |
| 3424 | 667 | 700659510H1 | SOYMON004 | g496493 | BLASTN | 712 | 1e−53 | 83 |
| 3425 | 667 | 700957466H1 | SOYMON022 | g496493 | BLASTN | 477 | 1e−52 | 82 |
| 3426 | 667 | 700957672H1 | SOYMON022 | g496493 | BLASTN | 730 | 1e−52 | 83 |
| 3427 | 667 | 700752023H1 | SOYMON014 | g496493 | BLASTN | 710 | 1e−50 | 79 |
| 3428 | 667 | 700684123H1 | SOYMON008 | g496493 | BLASTN | 657 | 1e−48 | 82 |
| 3429 | 667 | 701204216H2 | SOYMON035 | g496493 | BLASTN | 632 | 1e−46 | 77 |
| 3430 | 667 | 700684018H1 | SOYMON008 | g496493 | BLASTN | 502 | 1e−44 | 83 |
| 3431 | 667 | 700981833H1 | SOYMON009 | g496493 | BLASTN | 320 | 1e−43 | 81 |
| 3432 | 667 | 700685767H1 | SOYMON008 | g496493 | BLASTN | 566 | 1e−38 | 83 |

TABLE A*-continued

| Seq No. | Cluster ID | CloneID | Library | NCBI gi | Method | Score | P-value | % Ident |
|---|---|---|---|---|---|---|---|---|
| 3433 | 667 | 701119840H1 | SOYMON037 | g496493 | BLASTN | 518 | 1e−37 | 82 |
| 3434 | 667 | 700739439H1 | SOYMON012 | g496493 | BLASTN | 535 | 1e−35 | 86 |
| 3435 | 667 | 701108638H1 | SOYMON036 | g496493 | BLASTN | 420 | 1e−26 | 80 |
| 3436 | 667 | 700681550H1 | SOYMON008 | g496493 | BLASTN | 247 | 1e−20 | 82 |
| 3437 | 667 | 700838733H1 | SOYMON020 | g474408 | BLASTX | 185 | 1e−18 | 80 |
| 3438 | 667 | 700874784H1 | SOYMON018 | g474408 | BLASTX | 174 | 1e−17 | 83 |
| 3439 | 667 | 700796275H1 | SOYMON017 | g474408 | BLASTX | 167 | 1e−16 | 83 |
| 3440 | -GM11584 | LIB3049-013-Q1-E1-F2 | LIB3049 | g2905771 | BLASTN | 257 | 1e−10 | 83 |
| 3441 | -GM12588 | LIB3049-035-Q1-E1-B2 | LIB3049 | g20728 | BLASTN | 448 | 1e−35 | 75 |
| 3442 | -GM15977 | LIB3054-003-Q1-N1-B6 | LIB3054 | g12158 | BLASTN | 601 | 1e−41 | 70 |
| 3443 | -GM1666 | LIB3028-009-Q1-B1-C6 | LIB3028 | g169090 | BLASTN | 647 | 1e−43 | 74 |
| 3444 | -GM17526 | LIB3055-013-Q1-N1-E4 | LIB3055 | g20728 | BLASTN | 249 | 1e−22 | 77 |
| 3445 | -GM22093 | LIB3030-004-Q1-B1-G2 | LIB3030 | g20551 | BLASTX | 102 | 1e−35 | 75 |
| 3446 | -GM41500 | LIB3051-097-Q1-K1-H1 | LIB3051 | g2905772 | BLASTX | 106 | 1e−25 | 44 |
| 3447 | -GM4481 | LIB3039-010-Q1-E1-B9 | LIB3039 | g169090 | BLASTN | 692 | 1e−48 | 65 |
| 3448 | -GM5704 | LIB3039-017-Q1-E1-F2 | LIB3039 | g166705 | BLASTN | 276 | 1e−24 | 75 |
| 3449 | 1061 | LIB3028-008-Q1-B1-F6 | LIB3028 | g20728 | BLASTN | 743 | 1e−99 | 84 |
| 3450 | 1061 | LIB3053-005-Q1-N1-D9 | LIB3053 | g12158 | BLASTN | 1302 | 1e−99 | 82 |
| 3451 | 1061 | LIB3054-004-Q1-N1-E12 | LIB3054 | g20728 | BLASTN | 743 | 1e−92 | 84 |
| 3452 | 1061 | LIB3053-006-Q1-N1-E5 | LIB3053 | g20728 | BLASTN | 729 | 1e−89 | 80 |
| 3453 | 1061 | LIB3053-006-Q1-N1-C11 | LIB3053 | g12158 | BLASTN | 1096 | 1e−82 | 81 |
| 3454 | 1061 | LIB3028-003-Q1-B1-D12 | LIB3028 | g20728 | BLASTN | 728 | 1e−80 | 86 |
| 3455 | 1061 | LIB3040-023-Q1-E1-D10 | LIB3040 | g12158 | BLASTN | 741 | 1e−79 | 83 |
| 3456 | 1061 | LIB3040-036-Q1-E1-A12 | LIB3040 | g20728 | BLASTN | 735 | 1e−71 | 86 |
| 3457 | 1061 | LIB3055-006-Q1-N1-B3 | LIB3055 | g20728 | BLASTN | 667 | 1e−56 | 83 |
| 3458 | 1061 | LIB3055-002-Q1-B1-A9 | LIB3055 | g20728 | BLASTN | 735 | 1e−50 | 86 |
| 3459 | 1061 | LIB3040-053-Q1-E1-D5 | LIB3040 | g20728 | BLASTN | 579 | 1e−43 | 84 |
| 3460 | 1392 | LIB3051-059-Q1-K2-D8 | LIB3051 | g21142 | BLASTN | 1165 | 1e−101 | 82 |
| 3461 | 1392 | LIB3039-009-Q1-E1-H2 | LIB3039 | g19565 | BLASTN | 923 | 1e−68 | 80 |
| 3462 | 16 | LIB3052-014-Q1-N1-E5 | LIB3052 | g20732 | BLASTN | 1436 | 1e−110 | 84 |
| 3463 | 16 | LIB3055-002-Q1-B1-A6 | LIB3055 | g169090 | BLASTN | 1404 | 1e−108 | 82 |
| 3464 | 16 | LIB3028-004-Q1-B1-C2 | LIB3028 | g169090 | BLASTN | 1399 | 1e−107 | 82 |
| 3465 | 16 | LIB3065-011-Q1-N1-E4 | LIB3065 | g169090 | BLASTN | 1382 | 1e−106 | 83 |
| 3466 | 16 | LIB3053-014-Q1-N1-D3 | LIB3053 | g20732 | BLASTN | 727 | 1e−104 | 82 |
| 3467 | 16 | LIB3051-063-Q1-K1-F4 | LIB3051 | g169090 | BLASTN | 1150 | 1e−103 | 78 |
| 3468 | 16 | LIB3040-052-Q1-E1-B5 | LIB3040 | g169090 | BLASTN | 1247 | 1e−102 | 83 |
| 3469 | 16 | LIB3054-006-Q1-N1-C1 | LIB3054 | g169090 | BLASTN | 1160 | 1e−100 | 83 |
| 3470 | 16 | LIB3052-001-Q1-B1-C6 | LIB3052 | g169090 | BLASTN | 1142 | 1e−98 | 82 |
| 3471 | 16 | LIB3055-004-Q1-N1-F6 | LIB3055 | g20732 | BLASTN | 690 | 1e−94 | 83 |
| 3472 | 16 | LIB3051-087-Q1-K1-E1 | LIB3051 | g169090 | BLASTN | 1190 | 1e−94 | 77 |
| 3473 | 16 | LIB3051-018-Q1-E1-H11 | LIB3051 | g169090 | BLASTN | 772 | 1e−91 | 83 |
| 3474 | 16 | LIB3056-012-Q1-N1-H7 | LIB3056 | g169090 | BLASTN | 1132 | 1e−89 | 77 |

TABLE A*-continued

| Seq No. | Cluster ID | CloneID | Library | NCBI gi | Method | Score | P-value | % Ident |
|---|---|---|---|---|---|---|---|---|
| 3475 | 16 | LIB3052-014-Q1-N1-E1 | LIB3052 | g20732 | BLASTN | 1027 | 1e−86 | 79 |
| 3476 | 16 | LIB3039-015-Q1-E1-A12 | LIB3039 | g169090 | BLASTN | 1138 | 1e−86 | 83 |
| 3477 | 16 | LIB3039-003-Q1-E1-C4 | LIB3039 | g169090 | BLASTN | 719 | 1e−85 | 81 |
| 3478 | 16 | LIB3040-015-Q1-E1-H5 | LIB3040 | g169090 | BLASTN | 1127 | 1e−85 | 82 |
| 3479 | 16 | LIB3040-041-Q1-E1-A4 | LIB3040 | g169090 | BLASTN | 952 | 1e−84 | 80 |
| 3480 | 16 | LIB3040-004-Q1-E1-E11 | LIB3040 | g169090 | BLASTN | 952 | 1e−84 | 79 |
| 3481 | 16 | LIB3039-036-Q1-E1-D10 | LIB3039 | g169090 | BLASTN | 1110 | 1e−83 | 79 |
| 3482 | 16 | LIB3039-030-Q1-E1-D5 | LIB3039 | g169090 | BLASTN | 1093 | 1e−82 | 79 |
| 3483 | 16 | LIB3055-008-Q1-N1-E2 | LIB3055 | g169090 | BLASTN | 634 | 1e−81 | 84 |
| 3484 | 16 | LIB3039-003-Q1-E1-G1 | LIB3039 | g169090 | BLASTN | 890 | 1e−81 | 78 |
| 3485 | 16 | LIB3049-020-Q1-E1-A4 | LIB3049 | g169090 | BLASTN | 957 | 1e−81 | 78 |
| 3486 | 16 | LIB3030-012-Q1-B1-D5 | LIB3030 | g169090 | BLASTN | 691 | 1e−80 | 74 |
| 3487 | 16 | LIB3039-007-Q1-E1-F8 | LIB3039 | g169090 | BLASTN | 1066 | 1e−80 | 78 |
| 3488 | 16 | LIB3056-003-Q1-N1-H12 | LIB3056 | g169090 | BLASTN | 1070 | 1e−80 | 78 |
| 3489 | 16 | LIB3049-044-Q1-E1-H6 | LIB3049 | g169090 | BLASTN | 958 | 1e−79 | 78 |
| 3490 | 16 | LIB3051-042-Q1-K1-D7 | LIB3051 | g169090 | BLASTN | 1047 | 1e−78 | 81 |
| 3491 | 16 | LIB3039-005-Q1-E1-F7 | LIB3039 | g169090 | BLASTN | 957 | 1e−77 | 78 |
| 3492 | 16 | LIB3040-028-Q1-E1-C3 | LIB3040 | g169090 | BLASTN | 974 | 1e−77 | 81 |
| 3493 | 16 | LIB3049-014-Q1-E1-A10 | LIB3049 | g169090 | BLASTN | 737 | 1e−76 | 78 |
| 3494 | 16 | LIB3040-012-Q1-E1-G8 | LIB3040 | g169090 | BLASTN | 800 | 1e−76 | 78 |
| 3495 | 16 | LIB3040-061-Q1-E11-F6 | LIB3040 | g169090 | BLASTN | 957 | 1e−76 | 79 |
| 3496 | 16 | LIB3049-044-Q1-E1-G1 | LIB3049 | g169090 | BLASTN | 976 | 1e−75 | 80 |
| 3497 | 16 | LIB3039-040-Q1-E1-A8 | LIB3039 | g169090 | BLASTN | 994 | 1e−74 | 78 |
| 3498 | 16 | LIB3049-054-Q1-E1-G11 | LIB3049 | g169090 | BLASTN | 766 | 1e−73 | 79 |
| 3499 | 16 | LIB3051-062-Q1-K1-B9 | LIB3051 | g166705 | BLASTN | 869 | 1e−73 | 77 |
| 3500 | 16 | LIB3040-039-Q1-E1-A5 | LIB3040 | g169090 | BLASTN | 970 | 1e−72 | 83 |
| 3501 | 16 | LIB3039-031-Q1-E1-E11 | LIB3039 | g19565 | BLASTN | 970 | 1e−72 | 83 |
| 3502 | 16 | LIB3040-043-Q1-E1-G3 | LIB3040 | g169090 | BLASTN | 970 | 1e−72 | 83 |
| 3503 | 16 | LIB3039-031-Q1-E1-A7 | LIB3039 | g19565 | BLASTN | 971 | 1e−72 | 83 |
| 3504 | 16 | LIB3039-047-Q1-E1-B12 | LIB3039 | g169090 | BLASTN | 713 | 1e−71 | 78 |
| 3505 | 16 | LIB3039-033-Q1-E1-D8 | LIB3039 | g409574 | BLASTN | 965 | 1e−71 | 82 |
| 3506 | 16 | LIB3040-010-Q1-E1-A11 | LIB3040 | g19565 | BLASTN | 969 | 1e−71 | 83 |
| 3507 | 16 | LIB3040-015-Q1-E1-G5 | LIB3040 | g169090 | BLASTN | 726 | 1e−70 | 78 |
| 3508 | 16 | LIB3040-008-Q1-E1-G6 | LIB3040 | g169090 | BLASTN | 842 | 1e−70 | 81 |
| 3509 | 16 | LIB3049-045-Q1-E1-H2 | LIB3049 | g19565 | BLASTN | 955 | 1e−70 | 82 |
| 3510 | 16 | LIB3065-008-Q1-N1-B3 | LIB3065 | g169090 | BLASTN | 416 | 1e−69 | 80 |
| 3511 | 16 | LIB3039-028-Q1-E1-D6 | LIB3039 | g169090 | BLASTN | 713 | 1e−69 | 78 |
| 3512 | 16 | LIB3039-045-Q1-E1-D5 | LIB3039 | g169090 | BLASTN | 940 | 1e−69 | 83 |

TABLE A*-continued

| Seq No. | Cluster ID | CloneID | Library | NCBI gi | Method | Score | P-value | % Ident |
|---|---|---|---|---|---|---|---|---|
| 3513 | 16 | LIB3040-058-Q1-E1-G12 | LIB3040 | g20732 | BLASTN | 396 | 1e-68 | 80 |
| 3514 | 16 | LIB3049-034-Q1-E1-F1 | LIB3049 | g169090 | BLASTN | 633 | 1e-67 | 80 |
| 3515 | 16 | LIB3039-050-Q1-E1-C11 | LIB3039 | g169090 | BLASTN | 730 | 1e-67 | 79 |
| 3516 | 16 | LIB3040-042-Q1-E1-E12 | LIB3040 | g19565 | BLASTN | 762 | 1e-67 | 80 |
| 3517 | 16 | LIB3040-030-Q1-E1-E11 | LIB3040 | g169090 | BLASTN | 847 | 1e-67 | 79 |
| 3518 | 16 | LIB3040-054-Q1-E1-E9 | LIB3040 | g169090 | BLASTN | 909 | 1e-67 | 78 |
| 3519 | 16 | LIB3039-046-Q1-E1-H3 | LIB3039 | g19565 | BLASTN | 917 | 1e-67 | 82 |
| 3520 | 16 | LIB3039-020-Q1-E1-E1 | LIB3039 | g19565 | BLASTN | 908 | 1e-66 | 82 |
| 3521 | 16 | LIB3040-036-Q1-E1-F9 | LIB3040 | g19565 | BLASTN | 693 | 1e-63 | 83 |
| 3522 | 16 | LIB3039-054-Q1-E1-G11 | LIB3039 | g169090 | BLASTN | 633 | 1e-62 | 79 |
| 3523 | 16 | LIB3040-053-Q1-E1-C6 | LIB3040 | g169090 | BLASTN | 508 | 1e-60 | 77 |
| 3524 | 16 | LIB3040-006-Q1-E1-H9 | LIB3040 | g409574 | BLASTN | 855 | 1e-60 | 82 |
| 3525 | 16 | LIB3027-011-Q1-B1-C6 | LIB3027 | g2905771 | BLASTN | 754 | 1e-56 | 97 |
| 3526 | 16 | LIB3039-045-Q1-E1-E3 | LIB3039 | g169090 | BLASTN | 751 | 1e-52 | 73 |
| 3527 | 16 | LIB3039-029-Q1-E1-D8 | LIB3039 | g169090 | BLASTN | 422 | 1e-50 | 80 |
| 3528 | 16 | LIB3049-022-Q1-E1-G9 | LIB3049 | g166705 | BLASTN | 376 | 1e-46 | 79 |
| 3529 | 16 | LIB3039-027-Q1-E1-C2 | LIB3039 | g19565 | BLASTN | 417 | 1e-45 | 83 |
| 3530 | 16 | LIB3040-026-Q1-E1-C12 | LIB3040 | g169090 | BLASTN | 514 | 1e-43 | 69 |
| 3531 | 16 | LIB3040-042-Q1-E1-E1 | LIB3040 | g19565 | BLASTN | 575 | 1e-42 | 80 |
| 3532 | 16 | LIB3039-003-Q1-E1-A2 | LIB3039 | g2905771 | BLASTN | 422 | 1e-39 | 87 |
| 3533 | 16 | LIB3039-048-Q1-E1-D6 | LIB3039 | g169090 | BLASTN | 422 | 1e-36 | 77 |
| 3534 | 16 | LIB3040-018-Q1-E1-G2 | LIB3040 | g22238 | BLASTX | 79 | 1e-34 | 78 |
| 3535 | 16 | LIB3050-020-Q1-K1-A10 | LIB3050 | g19565 | BLASTN | 549 | 1e-34 | 87 |
| 3536 | 16 | LIB3051-022-Q1-K1-D1 | LIB3051 | g19565 | BLASTN | 480 | 1e-31 | 85 |
| 3537 | 16 | LIB3039-051-Q1-E1-F10 | LIB3039 | g1345567 | BLASTX | 110 | 1e-28 | 63 |
| 3538 | 1976 | LIB3053-010-Q1-N1-B4 | LIB3053 | g496493 | BLASTN | 341 | 1e-57 | 83 |
| 3539 | 33625 | LIB3054-008-Q1-N1-D12 | LIB3054 | g20732 | BLASTN | 227 | 1e-11 | 85 |
| 3540 | 535 | LIB3053-009-Q1-N1-D11 | LIB3053 | g496493 | BLASTN | 808 | 1e-58 | 86 |
| MAIZE TRIOSE PHOSPHATE ISOMERASE | | | | | | | | |
| 3541 | -700019675 | 700019675H1 | SATMON001 | g546735 | BLASTX | 134 | 1e-11 | 78 |
| 3542 | -700073894 | 700073894H1 | SATMON007 | g609261 | BLASTN | 257 | 1e-10 | 84 |
| 3543 | -700167260 | 700167260H1 | SATMON013 | g609261 | BLASTN | 644 | 1e-44 | 79 |
| 3544 | -700380595 | 700380595H1 | SATMON021 | g609261 | BLASTN | 1121 | 1e-84 | 87 |
| 3545 | -700449667 | 700449667H1 | SATMON028 | g217973 | BLASTN | 204 | 1e-18 | 93 |
| 3546 | -700449720 | 700449720H2 | SATMON028 | g217973 | BLASTN | 216 | 1e-18 | 88 |
| 3547 | -700570661 | 700570661H1 | SATMON030 | g168647 | BLASTX | 131 | 1e-11 | 88 |
| 3548 | -700616770 | 700616770H1 | SATMON033 | g407525 | BLASTX | 149 | 1e-13 | 83 |
| 3549 | -701170944 | 701170944H1 | SATMONN05 | g217921 | BLASTX | 188 | 1e-20 | 53 |
| 3550 | 11337 | 700337974H1 | SATMON020 | g256119 | BLASTN | 535 | 1e-61 | 78 |
| 3551 | 11337 | 700027829H1 | SATMON003 | g256119 | BLASTN | 726 | 1e-51 | 80 |
| 3552 | 126 | 700050046H1 | SATMON003 | g1785947 | BLASTN | 440 | 1e-26 | 92 |
| 3553 | 282 | 700077320H1 | SATMON007 | g217973 | BLASTN | 666 | 1e-108 | 97 |
| 3554 | 282 | 700104541H1 | SATMON010 | g217973 | BLASTN | 631 | 1e-106 | 97 |
| 3555 | 282 | 700047476H1 | SATMON003 | g217973 | BLASTN | 648 | 1e-105 | 97 |
| 3556 | 282 | 700211559H1 | SATMON016 | g217973 | BLASTN | 525 | 1e-104 | 97 |
| 3557 | 282 | 700073553H1 | SATMON007 | g217973 | BLASTN | 981 | 1e-103 | 98 |
| 3558 | 282 | 700613011H1 | SATMON033 | g217973 | BLASTN | 552 | 1e-102 | 98 |
| 3559 | 282 | 700352119H1 | SATMON023 | g217973 | BLASTN | 666 | 1e-101 | 97 |

TABLE A*-continued

| Seq No. | Cluster ID | CloneID | Library | NCBI gi | Method | Score | P-value | % Ident |
|---|---|---|---|---|---|---|---|---|
| 3560 | 282 | 700088148H1 | SATMON011 | g217973 | BLASTN | 666 | 1e−100 | 98 |
| 3561 | 282 | 700351626H1 | SATMON023 | g217973 | BLASTN | 401 | 1e−99 | 98 |
| 3562 | 282 | 700240096H1 | SATMON010 | g217973 | BLASTN | 666 | 1e−98 | 97 |
| 3563 | 282 | 700083660H1 | SATMON011 | g217973 | BLASTN | 666 | 1e−97 | 99 |
| 3564 | 282 | 700208721H1 | SATMON016 | g217973 | BLASTN | 497 | 1e−96 | 98 |
| 3565 | 282 | 700203144H1 | SATMON003 | g217973 | BLASTN | 511 | 1e−96 | 96 |
| 3566 | 282 | 700430425H1 | SATMONN01 | g217973 | BLASTN | 666 | 1e−96 | 98 |
| 3567 | 282 | 700206091H1 | SATMON003 | g217973 | BLASTN | 497 | 1e−94 | 97 |
| 3568 | 282 | 700077017H1 | SATMON007 | g217973 | BLASTN | 614 | 1e−93 | 93 |
| 3569 | 282 | 700618792H1 | SATMON034 | g217973 | BLASTN | 546 | 1e−92 | 96 |
| 3570 | 282 | 700572532H1 | SATMON030 | g407524 | BLASTN | 1212 | 1e−92 | 84 |
| 3571 | 282 | 700106512H1 | SATMON010 | g217973 | BLASTN | 632 | 1e−91 | 97 |
| 3572 | 282 | 700195031H1 | SATMON014 | g217973 | BLASTN | 471 | 1e−90 | 97 |
| 3573 | 282 | 700168131H1 | SATMON013 | g217973 | BLASTN | 497 | 1e−89 | 98 |
| 3574 | 282 | 700197039H1 | SATMON014 | g217973 | BLASTN | 546 | 1e−89 | 98 |
| 3575 | 282 | 700572688H1 | SATMON030 | g169820 | BLASTN | 1114 | 1e−89 | 85 |
| 3576 | 282 | 700021313H1 | SATMON001 | g217973 | BLASTN | 913 | 1e−87 | 97 |
| 3577 | 282 | 700452417H1 | SATMON028 | g217973 | BLASTN | 425 | 1e−86 | 95 |
| 3578 | 282 | 700346119H1 | SATMON021 | g217973 | BLASTN | 444 | 1e−86 | 96 |
| 3579 | 282 | 700082359H1 | SATMON011 | g217973 | BLASTN | 542 | 1e−86 | 93 |
| 3580 | 282 | 700240042H1 | SATMON010 | g217973 | BLASTN | 596 | 1e−86 | 97 |
| 3581 | 282 | 700030064H1 | SATMON003 | g217973 | BLASTN | 587 | 1e−85 | 94 |
| 3582 | 282 | 700615185H1 | SATMON033 | g217973 | BLASTN | 430 | 1e−84 | 98 |
| 3583 | 282 | 700196125H1 | SATMON014 | g217973 | BLASTN | 581 | 1e−84 | 100 |
| 3584 | 282 | 700243429H1 | SATMON010 | g217973 | BLASTN | 632 | 1e−84 | 97 |
| 3585 | 282 | 700474112H1 | SATMON025 | g217973 | BLASTN | 570 | 1e−83 | 98 |
| 3586 | 282 | 700572282H1 | SATMON030 | g407524 | BLASTN | 838 | 1e−83 | 82 |
| 3587 | 282 | 700622238H1 | SATMON034 | g169820 | BLASTN | 917 | 1e−80 | 86 |
| 3588 | 282 | 700095609H1 | SATMON008 | g169820 | BLASTN | 1067 | 1e−80 | 82 |
| 3589 | 282 | 700218886H1 | SATMON011 | g217973 | BLASTN | 551 | 1e−79 | 93 |
| 3590 | 282 | 700018688H1 | SATMON001 | g217973 | BLASTN | 1066 | 1e−79 | 99 |
| 3591 | 282 | 700049775H1 | SATMON003 | g217973 | BLASTN | 362 | 1e−78 | 91 |
| 3592 | 282 | 700575972H1 | SATMON030 | g169820 | BLASTN | 894 | 1e−78 | 79 |
| 3593 | 282 | 700215519H1 | SATMON016 | g217973 | BLASTN | 497 | 1e−76 | 97 |
| 3594 | 282 | 700161120H1 | SATMON012 | g217973 | BLASTN | 622 | 1e−76 | 98 |
| 3595 | 282 | 700581760H1 | SATMON031 | g217973 | BLASTN | 533 | 1e−75 | 90 |
| 3596 | 282 | 700104672H1 | SATMON010 | g169820 | BLASTN | 1012 | 1e−75 | 83 |
| 3597 | 282 | 700346053H1 | SATMON021 | g169820 | BLASTN | 1012 | 1e−75 | 83 |
| 3598 | 282 | 701166592H1 | SATMONN04 | g217973 | BLASTN | 661 | 1e−74 | 95 |
| 3599 | 282 | 700968667H1 | SATMONN04 | g217973 | BLASTN | 497 | 1e−73 | 92 |
| 3600 | 282 | 700205627H1 | SATMON003 | g217973 | BLASTN | 666 | 1e−73 | 99 |
| 3601 | 282 | 700029005H1 | SATMON003 | g169820 | BLASTN | 979 | 1e−72 | 85 |
| 3602 | 282 | 700476479H1 | SATMON025 | g169820 | BLASTN | 554 | 1e−71 | 84 |
| 3603 | 282 | 700050148H1 | SATMON003 | g169820 | BLASTN | 608 | 1e−70 | 83 |
| 3604 | 282 | 700259846H1 | SATMON017 | g217973 | BLASTN | 283 | 1e−69 | 94 |
| 3605 | 282 | 700344093H1 | SATMON021 | g169820 | BLASTN | 934 | 1e−69 | 83 |
| 3606 | 282 | 700082327H1 | SATMON011 | g169820 | BLASTN | 943 | 1e−69 | 85 |
| 3607 | 282 | 700020156H1 | SATMON001 | g217973 | BLASTN | 420 | 1e−68 | 99 |
| 3608 | 282 | 700577714H1 | SATMON031 | g169820 | BLASTN | 928 | 1e−68 | 85 |
| 3609 | 282 | 700104904H1 | SATMON010 | g169820 | BLASTN | 913 | 1e−67 | 84 |
| 3610 | 282 | 700104685H1 | SATMON010 | g169820 | BLASTN | 897 | 1e−66 | 84 |
| 3611 | 282 | 700053463H1 | SATMON009 | g169820 | BLASTN | 907 | 1e−66 | 85 |
| 3612 | 282 | 700171639H1 | SATMON013 | g217973 | BLASTN | 401 | 1e−65 | 98 |
| 3613 | 282 | 700574233H1 | SATMON030 | g169820 | BLASTN | 651 | 1e−65 | 83 |
| 3614 | 282 | 700262653H1 | SATMON017 | g169820 | BLASTN | 877 | 1e−64 | 84 |
| 3615 | 282 | 700456738H1 | SATMON029 | g169820 | BLASTN | 877 | 1e−64 | 84 |
| 3616 | 282 | 700611806H1 | SATMON022 | g169820 | BLASTN | 877 | 1e−64 | 83 |
| 3617 | 282 | 700381177H1 | SATMON023 | g169820 | BLASTN | 884 | 1e−64 | 84 |
| 3618 | 282 | 700103347H1 | SATMON010 | g169820 | BLASTN | 861 | 1e−63 | 84 |
| 3619 | 282 | 700103605H1 | SATMON010 | g169820 | BLASTN | 868 | 1e−63 | 84 |
| 3620 | 282 | 700578536H1 | SATMON031 | g169820 | BLASTN | 856 | 1e−62 | 84 |
| 3621 | 282 | 700258606H1 | SATMON017 | g169820 | BLASTN | 807 | 1e−61 | 83 |
| 3622 | 282 | 700335703H1 | SATMON019 | g217973 | BLASTN | 376 | 1e−60 | 90 |
| 3623 | 282 | 700351044H1 | SATMON023 | g169820 | BLASTN | 471 | 1e−59 | 83 |
| 3624 | 282 | 700346364H1 | SATMON021 | g169820 | BLASTN | 813 | 1e−59 | 85 |
| 3625 | 282 | 700619037H1 | SATMON034 | g169820 | BLASTN | 814 | 1e−59 | 84 |
| 3626 | 282 | 700465160H1 | SATMON025 | g169820 | BLASTN | 751 | 1e−57 | 84 |
| 3627 | 282 | 700235687H1 | SATMON015 | g169820 | BLASTN | 791 | 1e−57 | 82 |
| 3628 | 282 | 700105645H1 | SATMON010 | g169820 | BLASTN | 793 | 1e−57 | 83 |
| 3629 | 282 | 700082237H1 | SATMON011 | g169820 | BLASTN | 793 | 1e−57 | 84 |
| 3630 | 282 | 700261906H1 | SATMON017 | g169820 | BLASTN | 796 | 1e−57 | 83 |
| 3631 | 282 | 700456154H1 | SATMON029 | g169820 | BLASTN | 799 | 1e−57 | 84 |
| 3632 | 282 | 700047696H1 | SATMON003 | g169820 | BLASTN | 561 | 1e−56 | 83 |
| 3633 | 282 | 700449905H1 | SATMON028 | g169820 | BLASTN | 788 | 1e−56 | 84 |
| 3634 | 282 | 700336106H1 | SATMON019 | g217973 | BLASTN | 325 | 1e−55 | 92 |
| 3635 | 282 | 700381867H1 | SATMON023 | g2529386 | BLASTN | 422 | 1e−55 | 97 |
| 3636 | 282 | 700051335H1 | SATMON003 | g169820 | BLASTN | 608 | 1e−55 | 83 |

TABLE A*-continued

| Seq No. | Cluster ID | CloneID | Library | NCBI gi | Method | Score | P-value | % Ident |
|---|---|---|---|---|---|---|---|---|
| 3637 | 282 | 700050988H1 | SATMON003 | g169820 | BLASTN | 768 | 1e−55 | 86 |
| 3638 | 282 | 700029471H1 | SATMON003 | g169820 | BLASTN | 772 | 1e−55 | 84 |
| 3639 | 282 | 700106806H1 | SATMON010 | g169820 | BLASTN | 773 | 1e−55 | 84 |
| 3640 | 282 | 700071749H1 | SATMON007 | g217973 | BLASTN | 362 | 1e−54 | 85 |
| 3641 | 282 | 700207607H1 | SATMON016 | g217973 | BLASTN | 362 | 1e−54 | 85 |
| 3642 | 282 | 700573465H2 | SATMON030 | g169820 | BLASTN | 753 | 1e−54 | 86 |
| 3643 | 282 | 700220908H1 | SATMON011 | g169820 | BLASTN | 758 | 1e−54 | 84 |
| 3644 | 282 | 700467719H1 | SATMON025 | g169820 | BLASTN | 761 | 1e−54 | 85 |
| 3645 | 282 | 700456018H1 | SATMON029 | g169820 | BLASTN | 764 | 1e−54 | 81 |
| 3646 | 282 | 700453767H1 | SATMON029 | g217973 | BLASTN | 296 | 1e−52 | 94 |
| 3647 | 282 | 700026118H1 | SATMON003 | g217973 | BLASTN | 341 | 1e−52 | 93 |
| 3648 | 282 | 700026760H1 | SATMON003 | g217973 | BLASTN | 421 | 1e−52 | 99 |
| 3649 | 282 | 700029525H1 | SATMON003 | g169820 | BLASTN | 738 | 1e−52 | 85 |
| 3650 | 282 | 700457972H1 | SATMON029 | g169820 | BLASTN | 723 | 1e−51 | 85 |
| 3651 | 282 | 700455866H1 | SATMON029 | g169820 | BLASTN | 726 | 1e−51 | 84 |
| 3652 | 282 | 700165290H1 | SATMON013 | g169820 | BLASTN | 726 | 1e−51 | 84 |
| 3653 | 282 | 700351190H1 | SATMON023 | g169820 | BLASTN | 672 | 1e−50 | 81 |
| 3654 | 282 | 700154095H1 | SATMON007 | g169820 | BLASTN | 696 | 1e−49 | 84 |
| 3655 | 282 | 700450438H1 | SATMON028 | g217973 | BLASTN | 430 | 1e−48 | 99 |
| 3656 | 282 | 700044892H1 | SATMON004 | g169820 | BLASTN | 683 | 1e−48 | 85 |
| 3657 | 282 | 700185095H1 | SATMON014 | g169820 | BLASTN | 673 | 1e−47 | 84 |
| 3658 | 282 | 700575506H1 | SATMON030 | g169820 | BLASTN | 680 | 1e−47 | 83 |
| 3659 | 282 | 700161966H1 | SATMON012 | g217973 | BLASTN | 335 | 1e−46 | 98 |
| 3660 | 282 | 700343401H1 | SATMON021 | g169820 | BLASTN | 426 | 1e−45 | 77 |
| 3661 | 282 | 700152354H1 | SATMON007 | g169820 | BLASTN | 653 | 1e−45 | 84 |
| 3662 | 282 | 701164924H1 | SATMONN04 | g169820 | BLASTN | 397 | 1e−44 | 84 |
| 3663 | 282 | 700346896H1 | SATMON021 | g169820 | BLASTN | 496 | 1e−42 | 84 |
| 3664 | 282 | 700210157H1 | SATMON016 | g169820 | BLASTN | 617 | 1e−42 | 84 |
| 3665 | 282 | 700383103H1 | SATMON024 | g169820 | BLASTN | 531 | 1e−41 | 84 |
| 3666 | 282 | 701158829H1 | SATMONN04 | g407524 | BLASTN | 549 | 1e−40 | 80 |
| 3667 | 282 | 700619883H1 | SATMON034 | g217973 | BLASTN | 325 | 1e−38 | 99 |
| 3668 | 282 | 700168219H1 | SATMON013 | g169820 | BLASTN | 540 | 1e−36 | 83 |
| 3669 | 282 | 700155210H1 | SATMON007 | g169820 | BLASTN | 545 | 1e−36 | 83 |
| 3670 | 282 | 700334861H1 | SATMON019 | g169820 | BLASTN | 484 | 1e−31 | 82 |
| 3671 | 282 | 700355663H1 | SATMON024 | g217973 | BLASTN | 213 | 1e−30 | 88 |
| 3672 | 282 | 700074764H1 | SATMON007 | g546734 | BLASTN | 387 | 1e−27 | 84 |
| 3673 | 282 | 700621934H1 | SATMON034 | g217973 | BLASTN | 430 | 1e−26 | 100 |
| 3674 | 282 | 700802084H1 | SATMON036 | g217973 | BLASTN | 270 | 1e−24 | 98 |
| 3675 | 3039 | 700620444H1 | SATMON034 | g1785947 | BLASTN | 473 | 1e−56 | 75 |
| 3676 | 3039 | 700356205H1 | SATMON024 | g1785947 | BLASTN | 332 | 1e−32 | 72 |
| 3677 | 3039 | 700215549H1 | SATMON016 | g414549 | BLASTN | 443 | 1e−26 | 72 |
| 3678 | 3039 | 700620318H1 | SATMON034 | g556171 | BLASTX | 214 | 1e−25 | 79 |
| 3679 | 3039 | 700028742H1 | SATMON003 | g556171 | BLASTX | 156 | 1e−20 | 86 |
| 3680 | 3039 | 700150060H1 | SATMON007 | g556171 | BLASTX | 181 | 1e−17 | 89 |
| 3681 | 3039 | 700448477H1 | SATMON027 | g556171 | BLASTX | 137 | 1e−12 | 85 |
| 3682 | 3039 | 700336489H1 | SATMON019 | g556171 | BLASTX | 126 | 1e−10 | 81 |
| 3683 | 3414 | 700099709H1 | SATMON009 | g609261 | BLASTN | 600 | 1e−49 | 84 |
| 3684 | 3414 | 700075837H1 | SATMON007 | g609261 | BLASTN | 494 | 1e−41 | 84 |
| 3685 | 3414 | 700045678H1 | SATMON004 | g609261 | BLASTN | 340 | 1e−29 | 73 |
| 3686 | 3414 | 700097852H1 | SATMON009 | g609261 | BLASTN | 436 | 1e−27 | 84 |
| 3687 | 3414 | 700053342H1 | SATMON009 | g609261 | BLASTN | 346 | 1e−25 | 73 |
| 3688 | 3414 | 700041954H1 | SATMON004 | g609261 | BLASTN | 340 | 1e−24 | 82 |
| 3689 | 3414 | 700217471H1 | SATMON016 | g609261 | BLASTN | 265 | 1e−21 | 71 |
| 3690 | 3414 | 700264437H1 | SATMON017 | g609261 | BLASTN | 231 | 1e−17 | 69 |
| 3691 | 3414 | 700218371H1 | SATMON016 | g609261 | BLASTN | 156 | 1e−10 | 68 |
| 3692 | 5593 | 700381686H1 | SATMON023 | g609261 | BLASTN | 534 | 1e−44 | 89 |
| 3693 | 5593 | 700356082H1 | SATMON024 | g609261 | BLASTN | 246 | 1e−24 | 90 |
| 3694 | 5593 | 700622077H1 | SATMON034 | g609261 | BLASTN | 292 | 1e−20 | 86 |
| 3695 | 5593 | 700470822H1 | SATMON025 | g609262 | BLASTX | 134 | 1e−11 | 79 |
| 3696 | 6525 | 700083139H1 | SATMON011 | g256119 | BLASTN | 880 | 1e−64 | 76 |
| 3697 | 6525 | 700205474H1 | SATMON003 | g169820 | BLASTN | 849 | 1e−62 | 77 |
| 3698 | 6991 | 700336856H1 | SATMON019 | g609261 | BLASTN | 1131 | 1e−85 | 85 |
| 3699 | 6991 | 700042717H1 | SATMON004 | g609261 | BLASTN | 1028 | 1e−76 | 85 |
| 3700 | 6991 | 700379491H1 | SATMON020 | g609261 | BLASTN | 995 | 1e−74 | 81 |
| 3701 | 6991 | 700156635H1 | SATMON012 | g609261 | BLASTN | 877 | 1e−64 | 84 |
| 3702 | 6991 | 700046340H1 | SATMON004 | g609261 | BLASTN | 852 | 1e−62 | 84 |
| 3703 | 6991 | 700081869H1 | SATMON011 | g609261 | BLASTN | 266 | 1e−14 | 80 |
| 3704 | 6991 | 700426102H1 | SATMONN01 | g806312 | BLASTX | 134 | 1e−13 | 89 |
| 3705 | 7384 | 700613626H1 | SATMON033 | g609261 | BLASTN | 920 | 1e−87 | 85 |
| 3706 | 7384 | 700101506H1 | SATMON009 | g609261 | BLASTN | 1124 | 1e−84 | 85 |
| 3707 | 7384 | 700206445H1 | SATMON003 | g609261 | BLASTN | 987 | 1e−73 | 79 |
| 3708 | 7384 | 700220160H1 | SATMON011 | g609261 | BLASTN | 878 | 1e−64 | 85 |
| 3709 | −L1431527 | LIB143-004-Q1-E1-C5 | LIB143 | g217973 | BLASTN | 290 | 1e−13 | 93 |
| 3710 | −L30613868 | LIB3061-017-Q1-K1-C9 | LIB3061 | g217973 | BLASTN | 182 | 1e−13 | 70 |

TABLE A*-continued

| Seq No. | Cluster ID | CloneID | Library | NCBI gi | Method | Score | P-value | % Ident |
|---|---|---|---|---|---|---|---|---|
| 3711 | -L30623620 | LIB3062-034-Q1-K1-A8 | LIB3062 | g609261 | BLASTN | 599 | 1e-39 | 74 |
| 3712 | -L361705 | LIB36-021-Q1-E1-E7 | LIB36 | g609261 | BLASTN | 266 | 1e-14 | 80 |
| 3713 | 23992 | LIB3062-056-Q1-K1-F9 | LIB3062 | g1200507 | BLASTX | 285 | 1e-64 | 61 |
| 3714 | 282 | LIB3067-047-Q1-K1-H2 | LIB3067 | g217973 | BLASTN | 1076 | 1e-164 | 96 |
| 3715 | 282 | LIB3067-055-Q1-K1-G8 | LIB3067 | g217973 | BLASTN | 1076 | 1e-133 | 93 |
| 3716 | 282 | LIB3067-059-Q1-K1-D10 | LIB3067 | g169820 | BLASTN | 1401 | 1e-115 | 84 |
| 3717 | 282 | LIB3067-027-Q1-K1-B10 | LIB3067 | g407524 | BLASTN | 995 | 1e-113 | 83 |
| 3718 | 282 | LIB189-032-Q1-E1-H2 | LIB189 | g217973 | BLASTN | 629 | 1e-111 | 93 |
| 3719 | 282 | LIB3059-023-Q1-K1-A7 | LIB3059 | g407524 | BLASTN | 1436 | 1e-111 | 83 |
| 3720 | 282 | LIB3069-016-Q1-K1-D9 | LIB3069 | g169820 | BLASTN | 1301 | 1e-107 | 81 |
| 3721 | 282 | LIB143-006-Q1-E1-A8 | LIB143 | g169820 | BLASTN | 1373 | 1e-105 | 84 |
| 3722 | 282 | LIB3068-054-Q1-K1-C11 | LIB3068 | g169820 | BLASTN | 1327 | 1e-102 | 82 |
| 3723 | 282 | LIB3067-034-Q1-K1-B7 | LIB3067 | g407524 | BLASTN | 1321 | 1e-101 | 83 |
| 3724 | 282 | LIB143-031-Q1-E1-E5 | LIB143 | g169820 | BLASTN | 1311 | 1e-100 | 84 |
| 3725 | 282 | LIB3069-055-Q1-K1-H12 | LIB3069 | g169820 | BLASTN | 1046 | 1e-97 | 75 |
| 3726 | 282 | LIB3061-027-Q1-K1-A8 | LIB3061 | g169820 | BLASTN | 936 | 1e-96 | 83 |
| 3727 | 282 | LIB3078-008-Q1-K1-E5 | LIB3078 | g169820 | BLASTN | 1210 | 1e-92 | 82 |
| 3728 | 282 | LIB3066-027-Q1-K1-E1 | LIB3066 | g407524 | BLASTN | 1196 | 1e-91 | 82 |
| 3729 | 282 | LIB3067-032-Q1-K1-E5 | LIB3067 | g169820 | BLASTN | 1122 | 1e-84 | 84 |
| 3730 | 282 | LIB3078-029-Q1-K1-F7 | LIB3078 | g169820 | BLASTN | 827 | 1e-83 | 82 |
| 3731 | 282 | LIB3061-006-Q1-K1-B7 | LIB3061 | g169820 | BLASTN | 1091 | 1e-82 | 78 |
| 3732 | 282 | LIB143-048-Q1-E1-F8 | LIB143 | g169820 | BLASTN | 644 | 1e-74 | 75 |
| 3733 | 282 | LIB3078-033-Q1-K1-B10 | LIB3078 | g169820 | BLASTN | 584 | 1e-73 | 79 |
| 3734 | 282 | LIB3069-046-Q1-K1-C4 | LIB3069 | g169820 | BLASTN | 819 | 1e-59 | 79 |
| 3735 | 282 | LIB3061-049-Q1-K1-H2 | LIB3061 | g169820 | BLASTN | 587 | 1e-47 | 80 |
| 3736 | 282 | LIB143-029-Q1-E1-G4 | LIB143 | g169820 | BLASTN | 679 | 1e-47 | 84 |
| 3737 | 282 | LIB84-027-Q1-E1-E5 | LIB84 | g169820 | BLASTN | 613 | 1e-46 | 78 |
| 3738 | 282 | LIB3062-001-Q1-K2-F7 | LIB3062 | g169820 | BLASTN | 507 | 1e-33 | 80 |
| 3739 | 282 | LIB3066-014-Q1-K1-H11 | LIB3066 | g169820 | BLASTN | 385 | 1e-25 | 76 |
| 3740 | 29645 | LIB3069-014-Q1-K1-C11 | LIB3069 | g168647 | BLASTX | 131 | 1e-27 | 34 |
| 3741 | 29645 | LIB3069-013-Q1-K1-C11 | LIB3069 | g168647 | BLASTX | 124 | 1e-24 | 33 |
| 3742 | 3039 | LIB3062-045-Q1-K1-F6 | LIB3062 | g1785947 | BLASTN | 1119 | 1e-84 | 72 |
| 3743 | 5593 | LIB3067-045-Q1-K1-E5 | LIB3067 | g609261 | BLASTN | 702 | 1e-58 | 75 |
| 3744 | 6991 | LIB3059-026-Q1-K1-G9 | LIB3059 | g609261 | BLASTN | 1493 | 1e-115 | 84 |
| 3745 | 6991 | LIB3078-049-Q1-K1-E4 | LIB3078 | g609261 | BLASTN | 747 | 1e-55 | 83 |
| 3746 | 7384 | LIB3062-034-Q1-K1-A4 | LIB3062 | g609261 | BLASTN | 1351 | 1e-107 | 85 |
| SOYBEAN TRIOSE PHOSPHATE ISOMERASE | | | | | | | | |
| 3747 | -700743237 | 700743237H1 | SOYMON012 | g407525 | BLASTX | 173 | 1e-17 | 91 |
| 3748 | -700977730 | 700977730H1 | SOYMON009 | g602589 | BLASTN | 373 | 1e-20 | 71 |
| 3749 | -701056176 | 701056176H1 | SOYMON032 | g806311 | BLASTN | 752 | 1e-53 | 74 |

TABLE A*-continued

| Seq No. | Cluster ID | CloneID | Library | NCBI gi | Method | Score | P-value | % Ident |
|---|---|---|---|---|---|---|---|---|
| 3750 | -701110172 | 701110172H1 | SOYMON036 | g806311 | BLASTN | 801 | 1e-57 | 78 |
| 3751 | 10244 | 700995141H1 | SOYMON011 | g806311 | BLASTN | 470 | 1e-30 | 87 |
| 3752 | 10244 | 701124548H1 | SOYMON037 | g806311 | BLASTN | 490 | 1e-30 | 88 |
| 3753 | 10244 | 700739771H1 | SOYMON012 | g806311 | BLASTN | 329 | 1e-16 | 77 |
| 3754 | 10244 | 700999820H1 | SOYMON018 | g806312 | BLASTX | 147 | 1e-13 | 84 |
| 3755 | 10244 | 701119858H1 | SOYMON037 | g806312 | BLASTX | 118 | 1e-9 | 72 |
| 3756 | 10535 | 700988684H1 | SOYMON009 | g806311 | BLASTN | 905 | 1e-66 | 79 |
| 3757 | 10535 | 700902425H1 | SOYMON027 | g806311 | BLASTN | 872 | 1e-63 | 80 |
| 3758 | 1357 | 701069004H1 | SOYMON034 | g806311 | BLASTN | 832 | 1e-60 | 81 |
| 3759 | 1357 | 701151554H1 | SOYMON031 | g806311 | BLASTN | 568 | 1e-38 | 82 |
| 3760 | 1357 | 700659936H1 | SOYMON004 | g806311 | BLASTN | 545 | 1e-36 | 79 |
| 3761 | 16 | 700680927H1 | SOYMON008 | g256119 | BLASTN | 1020 | 1e-81 | 78 |
| 3762 | 16 | 700656871H1 | SOYMON004 | g256119 | BLASTN | 903 | 1e-66 | 81 |
| 3763 | 16 | 701124364H1 | SOYMON037 | g256119 | BLASTN | 872 | 1e-64 | 80 |
| 3764 | 16 | 701134707H2 | SOYMON038 | g256119 | BLASTN | 874 | 1e-64 | 81 |
| 3765 | 16 | 700673750H1 | SOYMON007 | g256119 | BLASTN | 781 | 1e-60 | 81 |
| 3766 | 16 | 701123269H1 | SOYMON037 | g602589 | BLASTN | 819 | 1e-59 | 78 |
| 3767 | 16 | 701004846H1 | SOYMON019 | g256119 | BLASTN | 801 | 1e-58 | 80 |
| 3768 | 16 | 700993362H1 | SOYMON011 | g256119 | BLASTN | 808 | 1e-58 | 80 |
| 3769 | 16 | 701005445H1 | SOYMON019 | g256119 | BLASTN | 630 | 1e-56 | 78 |
| 3770 | 16 | 701134327H1 | SOYMON038 | g602589 | BLASTN | 782 | 1e-56 | 79 |
| 3771 | 16 | 701148169H1 | SOYMON031 | g602589 | BLASTN | 574 | 1e-51 | 76 |
| 3772 | 16 | 701153410H1 | SOYMON031 | g602589 | BLASTN | 451 | 1e-50 | 80 |
| 3773 | 16 | 700830168H1 | SOYMON019 | g256119 | BLASTN | 705 | 1e-50 | 77 |
| 3774 | 16 | 701120627H1 | SOYMON037 | g602589 | BLASTN | 715 | 1e-50 | 78 |
| 3775 | 16 | 700975358H1 | SOYMON009 | g602589 | BLASTN | 628 | 1e-49 | 77 |
| 3776 | 16 | 700755979H1 | SOYMON014 | g602589 | BLASTN | 697 | 1e-49 | 79 |
| 3777 | 16 | 701131374H1 | SOYMON038 | g602589 | BLASTN | 703 | 1e-49 | 79 |
| 3778 | 16 | 700994166H1 | SOYMON011 | g602589 | BLASTN | 513 | 1e-47 | 77 |
| 3779 | 16 | 701138038H1 | SOYMON038 | g602589 | BLASTN | 672 | 1e-47 | 77 |
| 3780 | 16 | 700974248H1 | SOYMON005 | g602589 | BLASTN | 658 | 1e-46 | 77 |
| 3781 | 16 | 700655832H1 | SOYMON004 | g602589 | BLASTN | 664 | 1e-46 | 78 |
| 3782 | 16 | 700758320H1 | SOYMON015 | g602589 | BLASTN | 409 | 1e-45 | 80 |
| 3783 | 16 | 701064709H1 | SOYMON034 | g602589 | BLASTN | 477 | 1e-45 | 78 |
| 3784 | 16 | 701138504H1 | SOYMON038 | g602589 | BLASTN | 591 | 1e-45 | 76 |
| 3785 | 16 | 700980284H1 | SOYMON009 | g602589 | BLASTN | 652 | 1e-45 | 79 |
| 3786 | 16 | 701133585H2 | SOYMON038 | g602589 | BLASTN | 634 | 1e-44 | 78 |
| 3787 | 16 | 700674706H1 | SOYMON007 | g602589 | BLASTN | 634 | 1e-44 | 78 |
| 3788 | 16 | 700964927H1 | SOYMON022 | g602589 | BLASTN | 639 | 1e-44 | 78 |
| 3789 | 16 | 700830923H1 | SOYMON019 | g602589 | BLASTN | 626 | 1e-43 | 76 |
| 3790 | 16 | 700662845H1 | SOYMON005 | g602589 | BLASTN | 617 | 1e-42 | 76 |
| 3791 | 16 | 701133824H1 | SOYMON038 | g602589 | BLASTN | 619 | 1e-42 | 78 |
| 3792 | 16 | 700848913H1 | SOYMON021 | g602589 | BLASTN | 603 | 1e-41 | 77 |
| 3793 | 16 | 701005984H1 | SOYMON019 | g602589 | BLASTN | 604 | 1e-41 | 78 |
| 3794 | 16 | 701140769H1 | SOYMON038 | g602589 | BLASTN | 605 | 1e-41 | 76 |
| 3795 | 16 | 700753357H1 | SOYMON014 | g602589 | BLASTN | 328 | 1e-40 | 78 |
| 3796 | 16 | 701056336H1 | SOYMON032 | g602589 | BLASTN | 344 | 1e-40 | 77 |
| 3797 | 16 | 700895411H1 | SOYMON027 | g602589 | BLASTN | 593 | 1e-40 | 78 |
| 3798 | 16 | 701060188H1 | SOYMON033 | g602589 | BLASTN | 277 | 1e-39 | 80 |
| 3799 | 16 | 700739461H1 | SOYMON012 | g602589 | BLASTN | 573 | 1e-39 | 77 |
| 3800 | 16 | 700941104H1 | SOYMON024 | g602589 | BLASTN | 579 | 1e-39 | 79 |
| 3801 | 16 | 700732960H1 | SOYMON010 | g602589 | BLASTN | 581 | 1e-39 | 79 |
| 3802 | 16 | 700686476H1 | SOYMON008 | g602589 | BLASTN | 583 | 1e-39 | 79 |
| 3803 | 16 | 701054231H1 | SOYMON032 | g602589 | BLASTN | 583 | 1e-39 | 77 |
| 3804 | 16 | 700671690H1 | SOYMON006 | g602589 | BLASTN | 566 | 1e-38 | 77 |
| 3805 | 16 | 700941174H1 | SOYMON024 | g602589 | BLASTN | 569 | 1e-38 | 78 |
| 3806 | 16 | 701125091H1 | SOYMON037 | g256119 | BLASTN | 358 | 1e-37 | 74 |
| 3807 | 16 | 700989827H1 | SOYMON011 | g602589 | BLASTN | 555 | 1e-37 | 78 |
| 3808 | 16 | 700835006H1 | SOYMON019 | g602589 | BLASTN | 555 | 1e-37 | 75 |
| 3809 | 16 | 700834847H1 | SOYMON019 | g602589 | BLASTN | 559 | 1e-37 | 78 |
| 3810 | 16 | 700953411H1 | SOYMON022 | g602589 | BLASTN | 314 | 1e-36 | 80 |
| 3811 | 16 | 700869222H1 | SOYMON016 | g602589 | BLASTN | 541 | 1e-36 | 78 |
| 3812 | 16 | 700850633H1 | SOYMON023 | g602589 | BLASTN | 544 | 1e-36 | 78 |
| 3813 | 16 | 700890283H1 | SOYMON024 | g602589 | BLASTN | 310 | 1e-35 | 80 |
| 3814 | 16 | 700727079H1 | SOYMON009 | g414549 | BLASTN | 358 | 1e-35 | 73 |
| 3815 | 16 | 700892544H1 | SOYMON024 | g602589 | BLASTN | 486 | 1e-35 | 78 |
| 3816 | 16 | 700869230H1 | SOYMON016 | g602589 | BLASTN | 528 | 1e-35 | 78 |
| 3817 | 16 | 700993034H1 | SOYMON011 | g602589 | BLASTN | 518 | 1e-34 | 75 |
| 3818 | 16 | 700975553H1 | SOYMON009 | g414549 | BLASTN | 524 | 1e-34 | 79 |
| 3819 | 16 | 700651326H1 | SOYMON003 | g602589 | BLASTN | 356 | 1e-33 | 80 |
| 3820 | 16 | 701215308H1 | SOYMON035 | g414549 | BLASTN | 450 | 1e-33 | 75 |
| 3821 | 16 | 700654480H1 | SOYMON004 | g414549 | BLASTN | 511 | 1e-33 | 80 |
| 3822 | 16 | 701045128H1 | SOYMON032 | g414549 | BLASTN | 512 | 1e-33 | 78 |
| 3823 | 16 | 701060759H1 | SOYMON033 | g414549 | BLASTN | 513 | 1e-33 | 80 |
| 3824 | 16 | 700741652H1 | SOYMON012 | g602589 | BLASTN | 493 | 1e-32 | 79 |
| 3825 | 16 | 700675469H1 | SOYMON007 | g602589 | BLASTN | 494 | 1e-32 | 78 |
| 3826 | 16 | 700983693H1 | SOYMON009 | g414549 | BLASTN | 495 | 1e-32 | 80 |

TABLE A*-continued

| Seq No. | Cluster ID | CloneID | Library | NCBI gi | Method | Score | P-value | % Ident |
|---|---|---|---|---|---|---|---|---|
| 3827 | 16 | 701156784H1 | SOYMON031 | g602589 | BLASTN | 495 | 1e−32 | 78 |
| 3828 | 16 | 701009957H2 | SOYMON019 | g414549 | BLASTN | 495 | 1e−32 | 80 |
| 3829 | 16 | 700657787H1 | SOYMON004 | g414549 | BLASTN | 495 | 1e−32 | 79 |
| 3830 | 16 | 700893935H1 | SOYMON024 | g602589 | BLASTN | 481 | 1e−31 | 79 |
| 3831 | 16 | 701144619H1 | SOYMON031 | g414549 | BLASTN | 485 | 1e−31 | 78 |
| 3832 | 16 | 701148851H1 | SOYMON031 | g414549 | BLASTN | 487 | 1e−31 | 79 |
| 3833 | 16 | 701058218H1 | SOYMON033 | g602589 | BLASTN | 495 | 1e−31 | 78 |
| 3834 | 16 | 700975165H1 | SOYMON009 | g414549 | BLASTN | 466 | 1e−30 | 80 |
| 3835 | 16 | 701100165H1 | SOYMON028 | g602589 | BLASTN | 485 | 1e−30 | 79 |
| 3836 | 16 | 701150241H1 | SOYMON031 | g602589 | BLASTN | 455 | 1e−29 | 79 |
| 3837 | 16 | 701098308H1 | SOYMON028 | g414549 | BLASTN | 460 | 1e−29 | 79 |
| 3838 | 16 | 701150440H1 | SOYMON031 | g602589 | BLASTN | 462 | 1e−29 | 78 |
| 3839 | 16 | 700685125H1 | SOYMON008 | g414549 | BLASTN | 471 | 1e−29 | 81 |
| 3840 | 16 | 701061565H1 | SOYMON033 | g414549 | BLASTN | 471 | 1e−29 | 81 |
| 3841 | 16 | 700991418H1 | SOYMON011 | g602589 | BLASTN | 394 | 1e−28 | 68 |
| 3842 | 16 | 701156156H1 | SOYMON031 | g602589 | BLASTN | 456 | 1e−28 | 78 |
| 3843 | 16 | 701007231H2 | SOYMON019 | g602589 | BLASTN | 461 | 1e−28 | 79 |
| 3844 | 16 | 700829667H1 | SOYMON019 | g414549 | BLASTN | 333 | 1e−27 | 73 |
| 3845 | 16 | 701156033H1 | SOYMON031 | g602589 | BLASTN | 432 | 1e−27 | 78 |
| 3846 | 16 | 701014293H1 | SOYMON019 | g414549 | BLASTN | 446 | 1e−27 | 77 |
| 3847 | 16 | 700945665H1 | SOYMON024 | g414549 | BLASTN | 450 | 1e−27 | 81 |
| 3848 | 16 | 701152138H1 | SOYMON031 | g414549 | BLASTN | 450 | 1e−27 | 81 |
| 3849 | 16 | 701001407H1 | SOYMON018 | g169820 | BLASTN | 219 | 1e−26 | 72 |
| 3850 | 16 | 700983185H1 | SOYMON009 | g414549 | BLASTN | 435 | 1e−26 | 72 |
| 3851 | 16 | 700752364H1 | SOYMON014 | g414549 | BLASTN | 441 | 1e−26 | 76 |
| 3852 | 16 | 700992409H1 | SOYMON011 | g414549 | BLASTN | 427 | 1e−25 | 75 |
| 3853 | 16 | 701109396H1 | SOYMON036 | g414549 | BLASTN | 420 | 1e−24 | 76 |
| 3854 | 16 | 701151402H1 | SOYMON031 | g556171 | BLASTX | 151 | 1e−23 | 85 |
| 3855 | 16 | 701149617H1 | SOYMON031 | g556171 | BLASTX | 158 | 1e−23 | 86 |
| 3856 | 16 | 700747310H1 | SOYMON013 | g414549 | BLASTN | 406 | 1e−23 | 73 |
| 3857 | 16 | 701139569H1 | SOYMON038 | g556171 | BLASTX | 191 | 1e−22 | 84 |
| 3858 | 16 | 701213275H1 | SOYMON035 | g602589 | BLASTN | 255 | 1e−22 | 80 |
| 3859 | 16 | 701157185H1 | SOYMON031 | g556171 | BLASTX | 197 | 1e−20 | 90 |
| 3860 | 16 | 700655520H1 | SOYMON004 | g556171 | BLASTX | 166 | 1e−19 | 86 |
| 3861 | 16 | 701010779H1 | SOYMON019 | g556171 | BLASTX | 173 | 1e−19 | 64 |
| 3862 | 16 | 701044104H1 | SOYMON032 | g556171 | BLASTX | 188 | 1e−19 | 89 |
| 3863 | 16 | 700867605H1 | SOYMON016 | g556171 | BLASTX | 160 | 1e−17 | 70 |
| 3864 | 16 | 701125521H1 | SOYMON037 | g414550 | BLASTX | 166 | 1e−16 | 81 |
| 3865 | 16 | 701058593H1 | SOYMON033 | g168647 | BLASTX | 169 | 1e−16 | 94 |
| 3866 | 16 | 701070286H1 | SOYMON034 | g168647 | BLASTX | 164 | 1e−15 | 91 |
| 3867 | 16 | 700649007H1 | SOYMON003 | g414550 | BLASTX | 152 | 1e−14 | 88 |
| 3868 | 16 | 700876790H1 | SOYMON018 | g168647 | BLASTX | 154 | 1e−14 | 93 |
| 3869 | 16 | 700877219H1 | SOYMON018 | g168647 | BLASTX | 154 | 1e−14 | 93 |
| 3870 | 16 | 700877212H1 | SOYMON018 | g168647 | BLASTX | 154 | 1e−14 | 93 |
| 3871 | 16 | 700760847H1 | SOYMON015 | g556171 | BLASTX | 138 | 1e−13 | 86 |
| 3872 | 16 | 700893711H1 | SOYMON024 | g168647 | BLASTX | 140 | 1e−13 | 82 |
| 3873 | 16 | 700557532H1 | SOYMON001 | g256120 | BLASTX | 115 | 1e−12 | 88 |
| 3874 | 16 | 700793802H1 | SOYMON017 | g556171 | BLASTX | 138 | 1e−12 | 93 |
| 3875 | 16 | 700659725H1 | SOYMON004 | g556171 | BLASTX | 144 | 1e−12 | 47 |
| 3876 | 16 | 701044545H1 | SOYMON032 | g556171 | BLASTX | 144 | 1e−12 | 92 |
| 3877 | 16 | 701037485H1 | SOYMON029 | g556171 | BLASTX | 135 | 1e−11 | 96 |
| 3878 | 16 | 700683524H1 | SOYMON008 | g168647 | BLASTX | 136 | 1e−11 | 90 |
| 3879 | 16 | 700876711H1 | SOYMON018 | g168647 | BLASTX | 109 | 1e−10 | 85 |
| 3880 | 16 | 701155437H1 | SOYMON031 | g556171 | BLASTX | 130 | 1e−10 | 92 |
| 3881 | 28599 | 700997892H1 | SOYMON018 | g806311 | BLASTN | 834 | 1e−60 | 78 |
| 3882 | 31 | 701053174H1 | SOYMON032 | g806311 | BLASTN | 572 | 1e−37 | 73 |
| 3883 | 31 | 700754467H1 | SOYMON014 | g806312 | BLASTX | 145 | 1e−21 | 66 |
| 3884 | 31 | 701107430H1 | SOYMON036 | g806312 | BLASTX | 199 | 1e−20 | 63 |
| 3885 | 31 | 700985855H1 | SOYMON009 | g806312 | BLASTX | 145 | 1e−18 | 64 |
| 3886 | 31 | 701038167H1 | SOYMON029 | g806312 | BLASTX | 179 | 1e−17 | 61 |
| 3887 | 31 | 700670393H1 | SOYMON006 | g806312 | BLASTX | 167 | 1e−16 | 78 |
| 3888 | 31 | 700559280H1 | SOYMON001 | g609262 | BLASTX | 164 | 1e−15 | 69 |
| 3889 | 31 | 700793048H1 | SOYMON017 | g806312 | BLASTX | 97 | 1e−12 | 60 |
| 3890 | 31 | 700993683H1 | SOYMON011 | g806312 | BLASTX | 103 | 1e−11 | 60 |
| 3891 | 31 | 700663233H1 | SOYMON005 | g806312 | BLASTX | 130 | 1e−11 | 56 |
| 3892 | 31 | 700908079H1 | SOYMON022 | g806312 | BLASTX | 103 | 1e−10 | 60 |
| 3893 | 31 | 701043447H1 | SOYMON029 | g609262 | BLASTX | 126 | 1e−10 | 84 |
| 3894 | 31 | 700740188H1 | SOYMON012 | g806312 | BLASTX | 103 | 1e−8 | 60 |
| 3895 | 7466 | 700742922H1 | SOYMON012 | g806311 | BLASTN | 435 | 1e−27 | 76 |
| 3896 | 7466 | 700606255H1 | SOYMON008 | g806312 | BLASTX | 117 | 1e−17 | 80 |
| 3897 | 16 | LIB3053-005-Q1-N1-F9 | LIB3053 | g602589 | BLASTN | 1000 | 1e−74 | 77 |
| 3898 | 16 | LIB3039-035-Q1-E1-C5 | LIB3039 | g602589 | BLASTN | 979 | 1e−72 | 78 |
| 3899 | 16 | LIB3039-031-Q1-E1-A8 | LIB3039 | g256119 | BLASTN | 911 | 1e−71 | 80 |

TABLE A*-continued

| Seq No. | Cluster ID | CloneID | Library | NCBI gi | Method | Score | P-value | % Ident |
|---|---|---|---|---|---|---|---|---|
| 3900 | 16 | LIB3030-003-Q1-B1-C9 | LIB3030 | g602589 | BLASTN | 949 | 1e−70 | 78 |
| 3901 | 16 | LIB3039-023-Q1-E1-H12 | LIB3039 | g602589 | BLASTN | 913 | 1e−67 | 78 |
| 3902 | 16 | LIB3039-047-Q1-E1-D8 | LIB3039 | g602589 | BLASTN | 566 | 1e−65 | 75 |
| 3903 | 16 | LIB3039-052-Q1-E1-D6 | LIB3039 | g602589 | BLASTN | 890 | 1e−65 | 77 |
| 3904 | 16 | LIB3039-051-Q1-E1-A1 | LIB3039 | g602589 | BLASTN | 855 | 1e−62 | 78 |
| 3905 | 16 | LIB3049-009-Q1-E1-G5 | LIB3049 | g602589 | BLASTN | 783 | 1e−56 | 78 |
| 3906 | 16 | LIB3039-009-Q1-E1-C1 | LIB3039 | g602589 | BLASTN | 805 | 1e−56 | 78 |
| 3907 | 16 | LIB3055-006-Q1-N1-H3 | LIB3055 | g256119 | BLASTN | 481 | 1e−54 | 78 |
| 3908 | 16 | LIB3055-013-Q1-N1-C3 | LIB3055 | g256119 | BLASTN | 769 | 1e−54 | 79 |
| 3909 | 16 | LIB3049-034-Q1-E1-A2 | LIB3049 | g602589 | BLASTN | 626 | 1e−51 | 76 |
| 3910 | 16 | LIB3049-022-Q1-E1-F9 | LIB3049 | g602589 | BLASTN | 519 | 1e−43 | 78 |
| 3911 | 16 | LIB3049-030-Q1-E1-C7 | LIB3049 | g602589 | BLASTN | 572 | 1e−38 | 77 |
| 3912 | 16 | LIB3040-035-Q1-E1-C5 | LIB3040 | g556171 | BLASTX | 175 | 1e−33 | 82 |
| 3913 | 16 | LIB3040-005-Q1-E1-H8 | LIB3040 | g169820 | BLASTN | 324 | 1e−33 | 76 |
| 3914 | 16 | LIB3028-025-Q1-B1-D1 | LIB3028 | g602589 | BLASTN | 464 | 1e−33 | 78 |
| 3915 | 16 | LIB3039-022-Q1-E1-D5 | LIB3039 | g602589 | BLASTN | 357 | 1e−32 | 73 |
| 3916 | 16 | LIB3052-001-Q1-B1-C5 | LIB3052 | g414549 | BLASTN | 327 | 1e−29 | 73 |
| 3917 | 28599 | LIB3039-047-Q1-E1-D9 | LIB3039 | g806311 | BLASTN | 1183 | 1e−94 | 81 |
| 3918 | 28599 | LIB3039-048-Q1-E1-D12 | LIB3039 | g806311 | BLASTN | 1007 | 1e−92 | 81 |
| MAIZE ALDOLASE | | | | | | | | |
| 3919 | −700026544 | 700026544H1 | SATMON003 | g22144 | BLASTN | 215 | 1e−30 | 88 |
| 3920 | −700073329 | 700073329H1 | SATMON007 | g22144 | BLASTN | 590 | 1e−89 | 95 |
| 3921 | −700151987 | 700151987H1 | SATMON007 | g22144 | BLASTN | 212 | 1e−8 | 78 |
| 3922 | −700206575 | 700206575H1 | SATMON003 | g22144 | BLASTN | 1009 | 1e−109 | 96 |
| 3923 | −700333727 | 700333727H1 | SATMON019 | g1217893 | BLASTX | 154 | 1e−16 | 61 |
| 3924 | −700335938 | 700335938H1 | SATMON019 | g1730326 | BLASTX | 76 | 1e−19 | 59 |
| 3925 | −700429795 | 700429795H1 | SATMONN01 | g1619605 | BLASTX | 102 | 1e−16 | 77 |
| 3926 | −700453040 | 700453040H1 | SATMON028 | g2213867 | BLASTX | 96 | 1e−14 | 65 |
| 3927 | −700804137 | 700804137H1 | SATMON036 | g22144 | BLASTN | 742 | 1e−52 | 92 |
| 3928 | 1182 | 700449930H1 | SATMON028 | g22632 | BLASTN | 856 | 1e−62 | 79 |
| 3929 | 1182 | 701185559H1 | SATMONN06 | g22632 | BLASTN | 793 | 1e−57 | 79 |
| 3930 | 1182 | 700203130H1 | SATMON003 | g22632 | BLASTN | 799 | 1e−57 | 78 |
| 3931 | 1182 | 700083459H1 | SATMON011 | g22632 | BLASTN | 800 | 1e−57 | 76 |
| 3932 | 1182 | 700465449H1 | SATMON025 | g22632 | BLASTN | 405 | 1e−50 | 76 |
| 3933 | 1182 | 701165344H1 | SATMONN04 | g22632 | BLASTN | 326 | 1e−29 | 78 |
| 3934 | 1461 | 700101296H1 | SATMON009 | g218155 | BLASTX | 164 | 1e−15 | 80 |
| 3935 | 1461 | 700101839H1 | SATMON009 | g218155 | BLASTX | 140 | 1e−12 | 93 |
| 3936 | 1461 | 700044840H1 | SATMON004 | g218155 | BLASTX | 140 | 1e−12 | 93 |
| 3937 | 1461 | 700045985H1 | SATMON004 | g218155 | BLASTX | 140 | 1e−12 | 93 |
| 3938 | 1461 | 700101549H1 | SATMON009 | g218155 | BLASTX | 93 | 1e−11 | 91 |
| 3939 | 1461 | 700100334H1 | SATMON009 | g218155 | BLASTX | 123 | 1e−9 | 59 |
| 3940 | 1461 | 700100704H1 | SATMON009 | g218155 | BLASTX | 112 | 1e−8 | 96 |
| 3941 | 28693 | 700041744H1 | SATMON004 | g20203 | BLASTN | 696 | 1e−49 | 75 |
| 3942 | 38 | 700224356H1 | SATMON011 | g22144 | BLASTN | 1290 | 1e−98 | 96 |
| 3943 | 38 | 700048169H1 | SATMON003 | g22144 | BLASTN | 528 | 1e−72 | 98 |
| 3944 | 38 | 700616610H1 | SATMON033 | g22144 | BLASTN | 278 | 1e−31 | 91 |
| 3945 | 38 | 700355765H1 | SATMON024 | g20204 | BLASTX | 141 | 1e−12 | 96 |
| 3946 | 4416 | 700342330H1 | SATMON021 | g218155 | BLASTX | 96 | 1e−14 | 66 |
| 3947 | 4416 | 700223989H1 | SATMON011 | g218155 | BLASTX | 98 | 1e−10 | 63 |
| 3948 | 6547 | 700194431H1 | SATMON014 | g2636513 | BLASTX | 181 | 1e−17 | 47 |
| 3949 | 6547 | 700469777H1 | SATMON025 | g2636513 | BLASTX | 174 | 1e−16 | 48 |
| 3950 | 8494 | 700426129H1 | SATMONN01 | g20203 | BLASTN | 250 | 1e−20 | 73 |
| 3951 | 8494 | 700425929H1 | SATMONN01 | g927507 | BLASTX | 67 | 1e−11 | 89 |
| 3952 | −L30603643 | LIB3060-046-Q1-K1-G7 | LIB3060 | g169037 | BLASTX | 155 | 1e−44 | 66 |
| 3953 | −L30604872 | LIB3060-022-Q1-K1-C10 | LIB3060 | g218155 | BLASTX | 86 | 1e−27 | 57 |

TABLE A*-continued

| Seq No. | Cluster ID | CloneID | Library | NCBI gi | Method | Score | P-value | % Ident |
|---|---|---|---|---|---|---|---|---|
| 3954 | -L30605671 | LIB3060-046-Q1-K1-B12 | LIB3060 | g3695 | BLASTN | 440 | 1e-29 | 71 |
| 3955 | 1182 | LIB3079-006-Q1-K1-H8 | LIB3079 | g22632 | BLASTN | 598 | 1e-39 | 65 |
| 3956 | 1461 | LIB3060-017-Q1-K1-F3 | LIB3060 | g218155 | BLASTX | 196 | 1e-41 | 67 |
| 3957 | 1461 | LIB3059-040-Q1-K1-C12 | LIB3059 | g218155 | BLASTX | 112 | 1e-40 | 84 |
| 3958 | 1461 | LIB3060-030-Q1-K1-H11 | LIB3060 | g218155 | BLASTX | 112 | 1e-38 | 66 |
| 3959 | 28633 | LIB3062-015-Q1-K1-G12 | LIB3062 | g1208898 | BLASTX | 116 | 1e-24 | 45 |
| 3960 | 28693 | LIB3060-018-Q1-K1-E6 | LIB3060 | g20203 | BLASTN | 926 | 1e-74 | 74 |
| 3961 | 28693 | LIB3060-044-Q1-K1-F10 | LIB3060 | g20203 | BLASTN | 748 | 1e-62 | 74 |
| 3962 | 38 | LIB3061-025-Q1-K1-C9 | LIB3061 | g22144 | BLASTN | 895 | 1e-133 | 94 |
| 3963 | 38 | LIB3059-020-Q1-K1-H3 | LIB3059 | g22144 | BLASTN | 745 | 1e-53 | 98 |
| | | | SOYBEAN ALDOLASE | | | | | |
| 3964 | -700565253 | 700565253H1 | SOYMON002 | g3021337 | BLASTN | 352 | 1e-39 | 76 |
| 3965 | -700865276 | 700865276H1 | SOYMON016 | g3021337 | BLASTN | 629 | 1e-43 | 76 |
| 3966 | -700873022 | 700873022H1 | SOYMON018 | g3696 | BLASTX | 211 | 1e-26 | 70 |
| 3967 | -700943855 | 700943855H1 | SOYMON024 | g20204 | BLASTX | 202 | 1e-20 | 86 |
| 3968 | -700974965 | 700974965H1 | SOYMON005 | g3021337 | BLASTN | 259 | 1e-10 | 84 |
| 3969 | -701039850 | 701039850H1 | SOYMON029 | g22632 | BLASTN | 408 | 1e-23 | 76 |
| 3970 | -701206840 | 701206840H1 | SOYMON035 | g3021338 | BLASTX | 151 | 1e-13 | 83 |
| 3971 | 11792 | 700654881H1 | SOYMON004 | g20204 | BLASTX | 150 | 1e-13 | 76 |
| 3972 | 11792 | 700746016H1 | SOYMON013 | g3021337 | BLASTN | 284 | 1e-12 | 67 |
| 3973 | 12314 | 701037190H1 | SOYMON029 | g3021337 | BLASTN | 634 | 1e-44 | 78 |
| 3974 | 12314 | 701042664H1 | SOYMON029 | g3021338 | BLASTX | 197 | 1e-20 | 66 |
| 3975 | 16 | 700651596H1 | SOYMON003 | g3021337 | BLASTN | 1101 | 1e-83 | 86 |
| 3976 | 16 | 700750439H1 | SOYMON013 | g3021337 | BLASTN | 1078 | 1e-81 | 86 |
| 3977 | 16 | 700649475H1 | SOYMON003 | g3021337 | BLASTN | 1082 | 1e-81 | 84 |
| 3978 | 16 | 700652995H1 | SOYMON003 | g3021337 | BLASTN | 1084 | 1e-81 | 82 |
| 3979 | 16 | 700981967H1 | SOYMON009 | g3021337 | BLASTN | 1071 | 1e-80 | 85 |
| 3980 | 16 | 700863243H1 | SOYMON023 | g3021337 | BLASTN | 1044 | 1e-78 | 86 |
| 3981 | 16 | 700558625H1 | SOYMON001 | g3021337 | BLASTN | 1041 | 1e-77 | 84 |
| 3982 | 16 | 700564806H1 | SOYMON002 | g3021337 | BLASTN | 1021 | 1e-76 | 80 |
| 3983 | 16 | 700746368H1 | SOYMON013 | g3021337 | BLASTN | 897 | 1e-75 | 86 |
| 3984 | 16 | 700960290H1 | SOYMON022 | g3021337 | BLASTN | 1009 | 1e-75 | 87 |
| 3985 | 16 | 701055132H1 | SOYMON032 | g3021337 | BLASTN | 1011 | 1e-75 | 86 |
| 3986 | 16 | 701056109H1 | SOYMON032 | g3021337 | BLASTN | 1012 | 1e-75 | 84 |
| 3987 | 16 | 701119884H1 | SOYMON037 | g3021337 | BLASTN | 1014 | 1e-75 | 87 |
| 3988 | 16 | 700898149H1 | SOYMON027 | g3021337 | BLASTN | 1015 | 1e-75 | 86 |
| 3989 | 16 | 700661436H1 | SOYMON005 | g3021337 | BLASTN | 596 | 1e-74 | 83 |
| 3990 | 16 | 701042223H1 | SOYMON029 | g3021337 | BLASTN | 997 | 1e-74 | 84 |
| 3991 | 16 | 700676004H1 | SOYMON007 | g3021337 | BLASTN | 984 | 1e-73 | 85 |
| 3992 | 16 | 700747718H1 | SOYMON013 | g3021337 | BLASTN | 988 | 1e-73 | 87 |
| 3993 | 16 | 700751133H1 | SOYMON014 | g3021337 | BLASTN | 989 | 1e-73 | 86 |
| 3994 | 16 | 701215247H1 | SOYMON035 | g3021337 | BLASTN | 989 | 1e-73 | 84 |
| 3995 | 16 | 700652484H1 | SOYMON003 | g3021337 | BLASTN | 910 | 1e-72 | 85 |
| 3996 | 16 | 700981960H1 | SOYMON009 | g3021337 | BLASTN | 970 | 1e-72 | 87 |
| 3997 | 16 | 700869785H1 | SOYMON016 | g3021337 | BLASTN | 970 | 1e-72 | 87 |
| 3998 | 16 | 700969335H1 | SOYMON005 | g3021337 | BLASTN | 972 | 1e-72 | 82 |
| 3999 | 16 | 700854174H1 | SOYMON023 | g3021337 | BLASTN | 965 | 1e-71 | 84 |
| 4000 | 16 | 700761638H1 | SOYMON015 | g3021337 | BLASTN | 966 | 1e-71 | 86 |
| 4001 | 16 | 701005716H1 | SOYMON019 | g3021337 | BLASTN | 967 | 1e-71 | 83 |
| 4002 | 16 | 700984860H1 | SOYMON009 | g3021337 | BLASTN | 967 | 1e-71 | 84 |
| 4003 | 16 | 700941053H1 | SOYMON024 | g3021337 | BLASTN | 968 | 1e-71 | 86 |
| 4004 | 16 | 700561358H1 | SOYMON002 | g3021337 | BLASTN | 968 | 1e-71 | 82 |
| 4005 | 16 | 700564906H1 | SOYMON002 | g3021337 | BLASTN | 562 | 1e-70 | 82 |
| 4006 | 16 | 700833951H1 | SOYMON019 | g3021337 | BLASTN | 954 | 1e-70 | 88 |
| 4007 | 16 | 701117626H1 | SOYMON037 | g3021337 | BLASTN | 957 | 1e-70 | 85 |
| 4008 | 16 | 700729103H1 | SOYMON009 | g3021337 | BLASTN | 535 | 1e-69 | 86 |
| 4009 | 16 | 700670615H1 | SOYMON006 | g3021337 | BLASTN | 936 | 1e-69 | 83 |
| 4010 | 16 | 701053635H1 | SOYMON032 | g3021337 | BLASTN | 941 | 1e-69 | 84 |
| 4011 | 16 | 700982280H1 | SOYMON009 | g3021337 | BLASTN | 923 | 1e-68 | 82 |
| 4012 | 16 | 701119874H1 | SOYMON037 | g3021337 | BLASTN | 925 | 1e-68 | 88 |
| 4013 | 16 | 700758937H1 | SOYMON015 | g3021337 | BLASTN | 926 | 1e-68 | 87 |
| 4014 | 16 | 701214027H1 | SOYMON035 | g3021337 | BLASTN | 928 | 1e-68 | 82 |
| 4015 | 16 | 700972858H1 | SOYMON005 | g3021337 | BLASTN | 929 | 1e-68 | 84 |
| 4016 | 16 | 701099780H1 | SOYMON028 | g3021337 | BLASTN | 930 | 1e-68 | 85 |
| 4017 | 16 | 700829560H1 | SOYMON019 | g3021337 | BLASTN | 932 | 1e-68 | 85 |
| 4018 | 16 | 700971973H1 | SOYMON005 | g3021337 | BLASTN | 576 | 1e-67 | 85 |

TABLE A*-continued

| Seq No. | Cluster ID | CloneID | Library | NCBI gi | Method | Score | P-value | % Ident |
|---|---|---|---|---|---|---|---|---|
| 4019 | 16 | 701142336H1 | SOYMON038 | g3021337 | BLASTN | 750 | 1e−67 | 81 |
| 4020 | 16 | 701132605H1 | SOYMON038 | g3021337 | BLASTN | 759 | 1e−67 | 85 |
| 4021 | 16 | 700969222H1 | SOYMON005 | g3021337 | BLASTN | 913 | 1e−67 | 84 |
| 4022 | 16 | 700670956H1 | SOYMON006 | g3021337 | BLASTN | 920 | 1e−67 | 84 |
| 4023 | 16 | 701013771H1 | SOYMON019 | g3021337 | BLASTN | 921 | 1e−67 | 81 |
| 4024 | 16 | 700895725H1 | SOYMON027 | g3021337 | BLASTN | 921 | 1e−67 | 84 |
| 4025 | 16 | 701055481H1 | SOYMON032 | g3021337 | BLASTN | 654 | 1e−66 | 80 |
| 4026 | 16 | 700753940H1 | SOYMON014 | g3021337 | BLASTN | 899 | 1e−66 | 84 |
| 4027 | 16 | 700974141H1 | SOYMON005 | g3021337 | BLASTN | 900 | 1e−66 | 81 |
| 4028 | 16 | 700562408H1 | SOYMON002 | g3021337 | BLASTN | 902 | 1e−66 | 82 |
| 4029 | 16 | 700685292H1 | SOYMON008 | g3021337 | BLASTN | 903 | 1e−66 | 83 |
| 4030 | 16 | 700985157H1 | SOYMON009 | g3021337 | BLASTN | 907 | 1e−66 | 82 |
| 4031 | 16 | 701038194H1 | SOYMON029 | g3021337 | BLASTN | 907 | 1e−66 | 82 |
| 4032 | 16 | 700986633H1 | SOYMON009 | g3021337 | BLASTN | 908 | 1e−66 | 83 |
| 4033 | 16 | 700564282H1 | SOYMON002 | g3021337 | BLASTN | 517 | 1e−65 | 83 |
| 4034 | 16 | 700733754H1 | SOYMON010 | g3021337 | BLASTN | 680 | 1e−65 | 84 |
| 4035 | 16 | 700988179H1 | SOYMON009 | g3021337 | BLASTN | 887 | 1e−65 | 82 |
| 4036 | 16 | 700555591H1 | SOYMON001 | g3021337 | BLASTN | 887 | 1e−65 | 82 |
| 4037 | 16 | 701206717H1 | SOYMON035 | g3021337 | BLASTN | 888 | 1e−65 | 81 |
| 4038 | 16 | 700968494H1 | SOYMON036 | g3021337 | BLASTN | 889 | 1e−65 | 86 |
| 4039 | 16 | 700677674H1 | SOYMON007 | g3021337 | BLASTN | 894 | 1e−65 | 83 |
| 4040 | 16 | 700906271H1 | SOYMON022 | g3021337 | BLASTN | 894 | 1e−65 | 82 |
| 4041 | 16 | 700970391H1 | SOYMON005 | g3021337 | BLASTN | 896 | 1e−65 | 83 |
| 4042 | 16 | 700753641H1 | SOYMON014 | g3021337 | BLASTN | 897 | 1e−65 | 82 |
| 4043 | 16 | 700646593H1 | SOYMON014 | g3021337 | BLASTN | 468 | 1e−64 | 80 |
| 4044 | 16 | 700565615H1 | SOYMON002 | g3021337 | BLASTN | 667 | 1e−64 | 80 |
| 4045 | 16 | 700746523H1 | SOYMON013 | g3021337 | BLASTN | 744 | 1e−64 | 83 |
| 4046 | 16 | 700899019H1 | SOYMON027 | g3021337 | BLASTN | 875 | 1e−64 | 83 |
| 4047 | 16 | 701127167H1 | SOYMON037 | g3021337 | BLASTN | 876 | 1e−64 | 84 |
| 4048 | 16 | 701131053H1 | SOYMON038 | g3021337 | BLASTN | 879 | 1e−64 | 84 |
| 4049 | 16 | 701055811H1 | SOYMON032 | g3021337 | BLASTN | 881 | 1e−64 | 85 |
| 4050 | 16 | 700670980H1 | SOYMON006 | g3021337 | BLASTN | 881 | 1e−64 | 83 |
| 4051 | 16 | 700900103H1 | SOYMON027 | g3021337 | BLASTN | 882 | 1e−64 | 83 |
| 4052 | 16 | 700975609H1 | SOYMON009 | g3021337 | BLASTN | 882 | 1e−64 | 84 |
| 4053 | 16 | 701102865H1 | SOYMON028 | g3021337 | BLASTN | 883 | 1e−64 | 85 |
| 4054 | 16 | 701145255H1 | SOYMON031 | g3021337 | BLASTN | 509 | 1e−63 | 80 |
| 4055 | 16 | 701210875H1 | SOYMON035 | g3021337 | BLASTN | 616 | 1e−63 | 84 |
| 4056 | 16 | 700646664H1 | SOYMON014 | g3021337 | BLASTN | 862 | 1e−63 | 85 |
| 4057 | 16 | 700897337H1 | SOYMON027 | g3021337 | BLASTN | 865 | 1e−63 | 86 |
| 4058 | 16 | 700736783H1 | SOYMON010 | g3021337 | BLASTN | 867 | 1e−63 | 83 |
| 4059 | 16 | 701059586H1 | SOYMON033 | g3021337 | BLASTN | 869 | 1e−63 | 81 |
| 4060 | 16 | 701127063H1 | SOYMON037 | g3021337 | BLASTN | 412 | 1e−62 | 84 |
| 4061 | 16 | 700556614H1 | SOYMON001 | g3021337 | BLASTN | 475 | 1e−62 | 86 |
| 4062 | 16 | 700672681H1 | SOYMON006 | g3021337 | BLASTN | 818 | 1e−62 | 82 |
| 4063 | 16 | 700727057H1 | SOYMON009 | g3021337 | BLASTN | 850 | 1e−62 | 82 |
| 4064 | 16 | 701042141H1 | SOYMON029 | g3021337 | BLASTN | 851 | 1e−62 | 83 |
| 4065 | 16 | 700561860H1 | SOYMON002 | g3021337 | BLASTN | 854 | 1e−62 | 81 |
| 4066 | 16 | 700677460H1 | SOYMON007 | g3021337 | BLASTN | 855 | 1e−62 | 83 |
| 4067 | 16 | 700749578H1 | SOYMON013 | g3021337 | BLASTN | 856 | 1e−62 | 81 |
| 4068 | 16 | 700971671H1 | SOYMON005 | g3021337 | BLASTN | 856 | 1e−62 | 81 |
| 4069 | 16 | 700672288H1 | SOYMON006 | g3021337 | BLASTN | 860 | 1e−62 | 81 |
| 4070 | 16 | 701068481H1 | SOYMON034 | g3021337 | BLASTN | 861 | 1e−62 | 81 |
| 4071 | 16 | 700729913H1 | SOYMON009 | g3021337 | BLASTN | 661 | 1e−61 | 79 |
| 4072 | 16 | 700739449H1 | SOYMON012 | g3021337 | BLASTN | 724 | 1e−61 | 85 |
| 4073 | 16 | 700830902H1 | SOYMON019 | g3021337 | BLASTN | 814 | 1e−61 | 83 |
| 4074 | 16 | 700895304H1 | SOYMON027 | g3021337 | BLASTN | 840 | 1e−61 | 82 |
| 4075 | 16 | 700605676H2 | SOYMON005 | g3021337 | BLASTN | 842 | 1e−61 | 84 |
| 4076 | 16 | 700677453H1 | SOYMON007 | g3021337 | BLASTN | 843 | 1e−61 | 83 |
| 4077 | 16 | 700983108H1 | SOYMON009 | g3021337 | BLASTN | 843 | 1e−61 | 81 |
| 4078 | 16 | 700889170H1 | SOYMON024 | g3021337 | BLASTN | 845 | 1e−61 | 86 |
| 4079 | 16 | 701004956H1 | SOYMON019 | g3021337 | BLASTN | 849 | 1e−61 | 82 |
| 4080 | 16 | 700958213H1 | SOYMON022 | g3021337 | BLASTN | 849 | 1e−61 | 82 |
| 4081 | 16 | 701129305H1 | SOYMON037 | g3021337 | BLASTN | 659 | 1e−60 | 85 |
| 4082 | 16 | 701014446H1 | SOYMON019 | g3021337 | BLASTN | 669 | 1e−60 | 85 |
| 4083 | 16 | 700832047H1 | SOYMON019 | g3021337 | BLASTN | 738 | 1e−60 | 83 |
| 4084 | 16 | 700669966H1 | SOYMON006 | g3021337 | BLASTN | 829 | 1e−60 | 82 |
| 4085 | 16 | 700659491H1 | SOYMON004 | g3021337 | BLASTN | 829 | 1e−60 | 83 |
| 4086 | 16 | 701003560H1 | SOYMON019 | g3021337 | BLASTN | 829 | 1e−60 | 82 |
| 4087 | 16 | 700758028H1 | SOYMON015 | g3021337 | BLASTN | 829 | 1e−60 | 81 |
| 4088 | 16 | 701060964H1 | SOYMON033 | g3021337 | BLASTN | 833 | 1e−60 | 81 |
| 4089 | 16 | 700548284H1 | SOYMON002 | g3021337 | BLASTN | 834 | 1e−60 | 82 |
| 4090 | 16 | 700894957H1 | SOYMON024 | g3021337 | BLASTN | 837 | 1e−60 | 81 |
| 4091 | 16 | 700646551H1 | SOYMON014 | g3021337 | BLASTN | 479 | 1e−59 | 83 |
| 4092 | 16 | 700967633H1 | SOYMON032 | g3021337 | BLASTN | 530 | 1e−59 | 81 |
| 4093 | 16 | 700754430H1 | SOYMON014 | g3021337 | BLASTN | 654 | 1e−59 | 85 |
| 4094 | 16 | 700865919H1 | SOYMON016 | g3021337 | BLASTN | 814 | 1e−59 | 81 |
| 4095 | 16 | 700980426H1 | SOYMON009 | g3021337 | BLASTN | 815 | 1e−59 | 80 |

TABLE A*-continued

| Seq No. | Cluster ID | CloneID | Library | NCBI gi | Method | Score | P-value | % Ident |
|---|---|---|---|---|---|---|---|---|
| 4096 | 16 | 701048203H1 | SOYMON032 | g3021337 | BLASTN | 816 | 1e−59 | 81 |
| 4097 | 16 | 700846414H1 | SOYMON021 | g3021337 | BLASTN | 819 | 1e−59 | 81 |
| 4098 | 16 | 700851608H1 | SOYMON023 | g3021337 | BLASTN | 822 | 1e−59 | 81 |
| 4099 | 16 | 700970160H1 | SOYMON005 | g3021337 | BLASTN | 822 | 1e−59 | 82 |
| 4100 | 16 | 701206312H1 | SOYMON035 | g3021337 | BLASTN | 823 | 1e−59 | 85 |
| 4101 | 16 | 700834462H1 | SOYMON019 | g3021337 | BLASTN | 823 | 1e−59 | 81 |
| 4102 | 16 | 700562478H1 | SOYMON002 | g3021337 | BLASTN | 487 | 1e−58 | 84 |
| 4103 | 16 | 700788114H1 | SOYMON011 | g3021337 | BLASTN | 751 | 1e−58 | 83 |
| 4104 | 16 | 700753792H1 | SOYMON014 | g3021337 | BLASTN | 804 | 1e−58 | 84 |
| 4105 | 16 | 700837427H1 | SOYMON020 | g3021337 | BLASTN | 805 | 1e−58 | 86 |
| 4106 | 16 | 700753668H1 | SOYMON014 | g3021337 | BLASTN | 806 | 1e−58 | 85 |
| 4107 | 16 | 700667315H1 | SOYMON006 | g3021337 | BLASTN | 809 | 1e−58 | 81 |
| 4108 | 16 | 700808315H1 | SOYMON024 | g3021337 | BLASTN | 558 | 1e−57 | 80 |
| 4109 | 16 | 700839033H1 | SOYMON020 | g3021337 | BLASTN | 791 | 1e−57 | 81 |
| 4110 | 16 | 700670207H1 | SOYMON006 | g3021337 | BLASTN | 791 | 1e−57 | 87 |
| 4111 | 16 | 700849886H1 | SOYMON021 | g3021337 | BLASTN | 791 | 1e−57 | 83 |
| 4112 | 16 | 700751117H1 | SOYMON014 | g3021337 | BLASTN | 799 | 1e−57 | 86 |
| 4113 | 16 | 700851803H1 | SOYMON023 | g3021337 | BLASTN | 799 | 1e−57 | 86 |
| 4114 | 16 | 700669164H1 | SOYMON006 | g3021337 | BLASTN | 800 | 1e−57 | 80 |
| 4115 | 16 | 700548285H1 | SOYMON002 | g3021337 | BLASTN | 801 | 1e−57 | 85 |
| 4116 | 16 | 701065620H1 | SOYMON034 | g3021337 | BLASTN | 426 | 1e−56 | 82 |
| 4117 | 16 | 700727996H1 | SOYMON009 | g3021337 | BLASTN | 468 | 1e−56 | 79 |
| 4118 | 16 | 700869176H1 | SOYMON016 | g3021337 | BLASTN | 786 | 1e−56 | 85 |
| 4119 | 16 | 700973141H1 | SOYMON005 | g3021337 | BLASTN | 440 | 1e−55 | 79 |
| 4120 | 16 | 700969555H1 | SOYMON005 | g3021337 | BLASTN | 448 | 1e−55 | 81 |
| 4121 | 16 | 700866138H1 | SOYMON016 | g3021337 | BLASTN | 641 | 1e−55 | 86 |
| 4122 | 16 | 700904813H1 | SOYMON022 | g3021337 | BLASTN | 699 | 1e−55 | 85 |
| 4123 | 16 | 700669945H1 | SOYMON006 | g3021337 | BLASTN | 773 | 1e−55 | 86 |
| 4124 | 16 | 700894146H1 | SOYMON024 | g3021337 | BLASTN | 773 | 1e−55 | 86 |
| 4125 | 16 | 701060489H1 | SOYMON033 | g3021337 | BLASTN | 664 | 1e−54 | 85 |
| 4126 | 16 | 701125675H1 | SOYMON037 | g3021337 | BLASTN | 721 | 1e−54 | 85 |
| 4127 | 16 | 700754750H1 | SOYMON014 | g3021337 | BLASTN | 722 | 1e−54 | 86 |
| 4128 | 16 | 701142770H1 | SOYMON038 | g3021337 | BLASTN | 755 | 1e−54 | 88 |
| 4129 | 16 | 700731095H1 | SOYMON009 | g3021337 | BLASTN | 755 | 1e−54 | 87 |
| 4130 | 16 | 700667966H1 | SOYMON006 | g3021337 | BLASTN | 756 | 1e−54 | 84 |
| 4131 | 16 | 700673606H1 | SOYMON007 | g3021337 | BLASTN | 760 | 1e−54 | 83 |
| 4132 | 16 | 700965253H1 | SOYMON022 | g3021337 | BLASTN | 763 | 1e−54 | 86 |
| 4133 | 16 | 700605289H2 | SOYMON003 | g3021337 | BLASTN | 763 | 1e−54 | 84 |
| 4134 | 16 | 700732985H1 | SOYMON010 | g3021337 | BLASTN | 765 | 1e−54 | 87 |
| 4135 | 16 | 700986523H1 | SOYMON009 | g3021337 | BLASTN | 474 | 1e−53 | 85 |
| 4136 | 16 | 701100040H2 | SOYMON028 | g3021337 | BLASTN | 602 | 1e−53 | 85 |
| 4137 | 16 | 700895328H1 | SOYMON027 | g3021337 | BLASTN | 742 | 1e−53 | 83 |
| 4138 | 16 | 701141083H1 | SOYMON038 | g3021337 | BLASTN | 751 | 1e−53 | 85 |
| 4139 | 16 | 700829878H1 | SOYMON019 | g3021337 | BLASTN | 417 | 1e−52 | 86 |
| 4140 | 16 | 700671825H1 | SOYMON006 | g3021337 | BLASTN | 431 | 1e−52 | 79 |
| 4141 | 16 | 700755240H1 | SOYMON014 | g3021337 | BLASTN | 731 | 1e−52 | 88 |
| 4142 | 16 | 701011659H1 | SOYMON019 | g3021337 | BLASTN | 734 | 1e−52 | 86 |
| 4143 | 16 | 701011547H1 | SOYMON019 | g3021337 | BLASTN | 381 | 1e−51 | 84 |
| 4144 | 16 | 700835614H1 | SOYMON019 | g3021337 | BLASTN | 437 | 1e−51 | 80 |
| 4145 | 16 | 700671849H1 | SOYMON006 | g3021337 | BLASTN | 471 | 1e−51 | 87 |
| 4146 | 16 | 700734822H1 | SOYMON010 | g3021337 | BLASTN | 486 | 1e−51 | 79 |
| 4147 | 16 | 700830223H1 | SOYMON019 | g3021337 | BLASTN | 622 | 1e−51 | 84 |
| 4148 | 16 | 700659970H1 | SOYMON004 | g3021337 | BLASTN | 722 | 1e−51 | 82 |
| 4149 | 16 | 701101779H1 | SOYMON028 | g3021337 | BLASTN | 728 | 1e−51 | 86 |
| 4150 | 16 | 700852553H1 | SOYMON023 | g3021337 | BLASTN | 490 | 1e−50 | 88 |
| 4151 | 16 | 700853857H1 | SOYMON023 | g3021337 | BLASTN | 711 | 1e−50 | 88 |
| 4152 | 16 | 700980358H1 | SOYMON009 | g3021337 | BLASTN | 712 | 1e−50 | 85 |
| 4153 | 16 | 700672182H1 | SOYMON006 | g3021337 | BLASTN | 714 | 1e−50 | 89 |
| 4154 | 16 | 700748455H1 | SOYMON013 | g3021337 | BLASTN | 396 | 1e−49 | 85 |
| 4155 | 16 | 700657257H1 | SOYMON004 | g3021337 | BLASTN | 694 | 1e−49 | 75 |
| 4156 | 16 | 700729301H1 | SOYMON009 | g3021337 | BLASTN | 702 | 1e−49 | 80 |
| 4157 | 16 | 700726175H1 | SOYMON009 | g3021337 | BLASTN | 704 | 1e−49 | 80 |
| 4158 | 16 | 700966844H1 | SOYMON028 | g3021337 | BLASTN | 414 | 1e−47 | 81 |
| 4159 | 16 | 700960965H1 | SOYMON022 | g3021337 | BLASTN | 452 | 1e−47 | 85 |
| 4160 | 16 | 700678326H1 | SOYMON007 | g3021337 | BLASTN | 480 | 1e−47 | 83 |
| 4161 | 16 | 700751042H1 | SOYMON014 | g3021337 | BLASTN | 675 | 1e−47 | 87 |
| 4162 | 16 | 700830863H1 | SOYMON019 | g3021337 | BLASTN | 343 | 1e−46 | 84 |
| 4163 | 16 | 700870215H1 | SOYMON016 | g3021337 | BLASTN | 667 | 1e−46 | 80 |
| 4164 | 16 | 701213640H1 | SOYMON035 | g3021337 | BLASTN | 667 | 1e−46 | 87 |
| 4165 | 16 | 700658278H1 | SOYMON004 | g3021337 | BLASTN | 425 | 1e−44 | 87 |
| 4166 | 16 | 700942532H1 | SOYMON024 | g3021337 | BLASTN | 583 | 1e−44 | 83 |
| 4167 | 16 | 700986276H1 | SOYMON009 | g3021337 | BLASTN | 630 | 1e−43 | 81 |
| 4168 | 16 | 700870216H1 | SOYMON016 | g3021337 | BLASTN | 457 | 1e−42 | 82 |
| 4169 | 16 | 700899828H1 | SOYMON027 | g3021337 | BLASTN | 464 | 1e−42 | 83 |
| 4170 | 16 | 700678816H1 | SOYMON007 | g3021337 | BLASTN | 618 | 1e−42 | 86 |
| 4171 | 16 | 700666809H1 | SOYMON005 | g3021337 | BLASTN | 621 | 1e−42 | 82 |
| 4172 | 16 | 701098073H1 | SOYMON028 | g3021337 | BLASTN | 285 | 1e−41 | 83 |

TABLE A*-continued

| Seq No. | Cluster ID | CloneID | Library | NCBI gi | Method | Score | P-value | % Ident |
|---|---|---|---|---|---|---|---|---|
| 4173 | 16 | 700669492H1 | SOYMON006 | g3021337 | BLASTN | 504 | 1e−39 | 83 |
| 4174 | 16 | 700975340H1 | SOYMON009 | g3021337 | BLASTN | 574 | 1e−39 | 81 |
| 4175 | 16 | 700753528H1 | SOYMON014 | g3021337 | BLASTN | 576 | 1e−39 | 81 |
| 4176 | 16 | 700665923H1 | SOYMON005 | g3021337 | BLASTN | 373 | 1e−35 | 84 |
| 4177 | 16 | 701038320H1 | SOYMON029 | g3021337 | BLASTN | 518 | 1e−34 | 84 |
| 4178 | 16 | 700755605H1 | SOYMON014 | g3021337 | BLASTN | 431 | 1e−33 | 81 |
| 4179 | 16 | 700890349H1 | SOYMON024 | g3021337 | BLASTN | 511 | 1e−33 | 88 |
| 4180 | 16 | 700669817H1 | SOYMON006 | g3021337 | BLASTN | 363 | 1e−31 | 87 |
| 4181 | 16 | 701097640H1 | SOYMON028 | g3021337 | BLASTN | 476 | 1e−30 | 67 |
| 4182 | 16 | 700562959H1 | SOYMON002 | g3021337 | BLASTN | 482 | 1e−30 | 81 |
| 4183 | 16 | 700852454H1 | SOYMON023 | g3021337 | BLASTN | 446 | 1e−28 | 77 |
| 4184 | 16 | 701121443H1 | SOYMON037 | g3021337 | BLASTN | 418 | 1e−24 | 84 |
| 4185 | 16 | 701118247H1 | SOYMON037 | g3021337 | BLASTN | 280 | 1e−18 | 85 |
| 4186 | 16 | 700665401H1 | SOYMON005 | g927505 | BLASTX | 172 | 1e−16 | 94 |
| 4187 | 16 | 700750038H1 | SOYMON013 | g3021338 | BLASTX | 162 | 1e−15 | 84 |
| 4188 | 16 | 700665414H1 | SOYMON005 | g3021337 | BLASTN | 273 | 1e−13 | 88 |
| 4189 | 16 | 700889072H1 | SOYMON024 | g3021338 | BLASTX | 136 | 1e−11 | 83 |
| 4190 | 16 | 700727964H1 | SOYMON009 | g927505 | BLASTX | 137 | 1e−11 | 86 |
| 4191 | 16 | 700680648H1 | SOYMON008 | g3021337 | BLASTN | 226 | 1e−10 | 73 |
| 4192 | 16 | 701044547H1 | SOYMON032 | g927505 | BLASTX | 91 | 1e−9 | 76 |
| 4193 | 16 | 700649174H1 | SOYMON003 | g3021338 | BLASTX | 126 | 1e−9 | 83 |
| 4194 | 16531 | 701120682H1 | SOYMON037 | g3021337 | BLASTN | 716 | 1e−50 | 77 |
| 4195 | 1701 | 700993909H1 | SOYMON011 | g22633 | BLASTX | 112 | 1e−31 | 78 |
| 4196 | 1701 | 700955490H1 | SOYMON022 | g22633 | BLASTX | 176 | 1e−25 | 70 |
| 4197 | 1701 | 700682081H1 | SOYMON008 | g22633 | BLASTX | 147 | 1e−20 | 68 |
| 4198 | 1701 | 700988843H1 | SOYMON011 | g22633 | BLASTX | 90 | 1e−14 | 67 |
| 4199 | 1701 | 700740531H1 | SOYMON012 | g22633 | BLASTX | 92 | 1e−12 | 64 |
| 4200 | 1701 | 700790059H2 | SOYMON011 | g22633 | BLASTX | 92 | 1e−12 | 67 |
| 4201 | 1701 | 700872670H1 | SOYMON018 | g169037 | BLASTX | 144 | 1e−12 | 90 |
| 4202 | 1701 | 700990591H1 | SOYMON011 | g22632 | BLASTN | 199 | 1e−11 | 68 |
| 4203 | 1701 | 700743120H1 | SOYMON012 | g22633 | BLASTX | 92 | 1e−9 | 68 |
| 4204 | 1701 | 700994931H1 | SOYMON011 | g22633 | BLASTX | 92 | 1e−8 | 64 |
| 4205 | 1938 | 700738074H1 | SOYMON012 | g927507 | BLASTX | 134 | 1e−11 | 90 |
| 4206 | 239 | 701126904H1 | SOYMON037 | g169037 | BLASTX | 231 | 1e−24 | 81 |
| 4207 | 239 | 700668532H1 | SOYMON006 | g169037 | BLASTX | 202 | 1e−20 | 83 |
| 4208 | 239 | 700666028H1 | SOYMON005 | g218155 | BLASTX | 186 | 1e−18 | 78 |
| 4209 | 239 | 701009915H2 | SOYMON019 | g169037 | BLASTX | 180 | 1e−17 | 84 |
| 4210 | 239 | 700943660H1 | SOYMON024 | g169037 | BLASTX | 180 | 1e−17 | 84 |
| 4211 | 239 | 701100047H2 | SOYMON028 | g169037 | BLASTX | 160 | 1e−15 | 84 |
| 4212 | 239 | 700794458H1 | SOYMON017 | g22633 | BLASTX | 131 | 1e−10 | 58 |
| 4213 | 239 | 700738441H1 | SOYMON012 | g169037 | BLASTX | 118 | 1e−8 | 78 |
| 4214 | 3425 | 700984050H1 | SOYMON009 | g3021337 | BLASTN | 874 | 1e−64 | 80 |
| 4215 | 3425 | 701014509H1 | SOYMON019 | g3021337 | BLASTN | 520 | 1e−60 | 80 |
| 4216 | 3425 | 701138819H1 | SOYMON038 | g3021337 | BLASTN | 815 | 1e−59 | 80 |
| 4217 | 3425 | 700977309H1 | SOYMON009 | g3021337 | BLASTN | 809 | 1e−58 | 80 |
| 4218 | 3425 | 700984876H1 | SOYMON009 | g3021337 | BLASTN | 813 | 1e−58 | 80 |
| 4219 | 3425 | 701046151H1 | SOYMON032 | g3021337 | BLASTN | 730 | 1e−52 | 80 |
| 4220 | 3425 | 700976571H1 | SOYMON009 | g3021337 | BLASTN | 737 | 1e−52 | 81 |
| 4221 | 3425 | 700889668H1 | SOYMON024 | g3021337 | BLASTN | 737 | 1e−52 | 81 |
| 4222 | 3425 | 701045371H1 | SOYMON032 | g3021337 | BLASTN | 716 | 1e−50 | 79 |
| 4223 | 3425 | 700548283H1 | SOYMON002 | g3021337 | BLASTN | 700 | 1e−49 | 81 |
| 4224 | 3425 | 701103461H1 | SOYMON028 | g3021337 | BLASTN | 705 | 1e−49 | 81 |
| 4225 | 3425 | 700898446H1 | SOYMON027 | g3021337 | BLASTN | 686 | 1e−48 | 83 |
| 4226 | 3425 | 701006432H1 | SOYMON019 | g3021337 | BLASTN | 688 | 1e−48 | 83 |
| 4227 | 3425 | 701041476H1 | SOYMON029 | g3021337 | BLASTN | 693 | 1e−48 | 81 |
| 4228 | 3425 | 700568335H1 | SOYMON002 | g3021337 | BLASTN | 678 | 1e−47 | 82 |
| 4229 | 3425 | 701046312H1 | SOYMON032 | g3021337 | BLASTN | 650 | 1e−45 | 85 |
| 4230 | 3425 | 701050171H1 | SOYMON032 | g3021337 | BLASTN | 650 | 1e−45 | 85 |
| 4231 | 3425 | 700685063H1 | SOYMON008 | g3021337 | BLASTN | 643 | 1e−44 | 83 |
| 4232 | 3425 | 701010250H2 | SOYMON019 | g3021337 | BLASTN | 542 | 1e−36 | 86 |
| 4233 | 3425 | 700665454H1 | SOYMON005 | g3021337 | BLASTN | 520 | 1e−34 | 80 |
| 4234 | 3425 | 701043888H1 | SOYMON032 | g3021337 | BLASTN | 495 | 1e−32 | 85 |
| 4235 | 3425 | 700726806H1 | SOYMON009 | g3021337 | BLASTN | 213 | 1e−23 | 76 |
| 4236 | 491 | 700997879H1 | SOYMON018 | g22632 | BLASTN | 789 | 1e−56 | 77 |
| 4237 | 491 | 700646208H1 | SOYMON012 | g22632 | BLASTN | 733 | 1e−52 | 76 |
| 4238 | 491 | 700559796H1 | SOYMON001 | g22632 | BLASTN | 715 | 1e−50 | 76 |
| 4239 | 491 | 700789784H1 | SOYMON011 | g22632 | BLASTN | 664 | 1e−46 | 76 |
| 4240 | 491 | 700683122H1 | SOYMON008 | g22632 | BLASTN | 485 | 1e−41 | 86 |
| 4241 | 491 | 701105914H1 | SOYMON036 | g22632 | BLASTN | 504 | 1e−41 | 73 |
| 4242 | 491 | 700558789H1 | SOYMON001 | g22632 | BLASTN | 607 | 1e−41 | 74 |
| 4243 | 491 | 700873051H1 | SOYMON018 | g22632 | BLASTN | 608 | 1e−41 | 75 |
| 4244 | 491 | 700684010H1 | SOYMON008 | g22632 | BLASTN | 597 | 1e−40 | 75 |
| 4245 | 491 | 700786096H2 | SOYMON011 | g22632 | BLASTN | 576 | 1e−39 | 75 |
| 4246 | 491 | 700731865H1 | SOYMON010 | g22632 | BLASTN | 582 | 1e−39 | 75 |
| 4247 | 491 | 701108111H1 | SOYMON036 | g22632 | BLASTN | 467 | 1e−38 | 75 |
| 4248 | 491 | 700740887H1 | SOYMON012 | g22632 | BLASTN | 567 | 1e−38 | 74 |
| 4249 | 491 | 700559579H1 | SOYMON001 | g22632 | BLASTN | 572 | 1e−38 | 75 |

TABLE A*-continued

| Seq No. | Cluster ID | CloneID | Library | NCBI gi | Method | Score | P-value | % Ident |
|---|---|---|---|---|---|---|---|---|
| 4250 | 491 | 700996104H1 | SOYMON018 | g22632 | BLASTN | 476 | 1e−37 | 76 |
| 4251 | 491 | 700682145H1 | SOYMON008 | g22632 | BLASTN | 542 | 1e−36 | 74 |
| 4252 | 491 | 700737263H1 | SOYMON010 | g22632 | BLASTN | 526 | 1e−35 | 74 |
| 4253 | 491 | 700547963H1 | SOYMON001 | g22632 | BLASTN | 527 | 1e−35 | 73 |
| 4254 | 491 | 700686296H1 | SOYMON008 | g22632 | BLASTN | 527 | 1e−35 | 73 |
| 4255 | 491 | 700646072H1 | SOYMON011 | g22632 | BLASTN | 537 | 1e−35 | 74 |
| 4256 | 491 | 701106662H1 | SOYMON036 | g22632 | BLASTN | 514 | 1e−34 | 74 |
| 4257 | 491 | 700684335H1 | SOYMON008 | g22632 | BLASTN | 516 | 1e−34 | 74 |
| 4258 | 491 | 701000609H1 | SOYMON018 | g22632 | BLASTN | 520 | 1e−34 | 74 |
| 4259 | 491 | 700685658H1 | SOYMON008 | g22632 | BLASTN | 520 | 1e−34 | 74 |
| 4260 | 491 | 700875532H1 | SOYMON018 | g22632 | BLASTN | 521 | 1e−34 | 73 |
| 4261 | 491 | 700685813H1 | SOYMON008 | g22632 | BLASTN | 502 | 1e−33 | 74 |
| 4262 | 491 | 700872948H1 | SOYMON018 | g22632 | BLASTN | 502 | 1e−33 | 74 |
| 4263 | 491 | 700730264H1 | SOYMON009 | g22632 | BLASTN | 502 | 1e−33 | 74 |
| 4264 | 491 | 701104554H1 | SOYMON036 | g22632 | BLASTN | 503 | 1e−33 | 74 |
| 4265 | 491 | 700960601H1 | SOYMON022 | g22632 | BLASTN | 503 | 1e−33 | 74 |
| 4266 | 491 | 700876633H1 | SOYMON018 | g22632 | BLASTN | 503 | 1e−33 | 74 |
| 4267 | 491 | 700739662H1 | SOYMON012 | g22632 | BLASTN | 504 | 1e−33 | 72 |
| 4268 | 491 | 700685904H1 | SOYMON008 | g22632 | BLASTN | 505 | 1e−33 | 72 |
| 4269 | 491 | 700995183H1 | SOYMON011 | g22632 | BLASTN | 513 | 1e−33 | 73 |
| 4270 | 491 | 700901996H1 | SOYMON027 | g22632 | BLASTN | 513 | 1e−33 | 74 |
| 4271 | 491 | 700727070H1 | SOYMON009 | g22632 | BLASTN | 490 | 1e−32 | 72 |
| 4272 | 491 | 700685790H1 | SOYMON008 | g22632 | BLASTN | 492 | 1e−32 | 74 |
| 4273 | 491 | 700998652H1 | SOYMON018 | g22632 | BLASTN | 494 | 1e−32 | 72 |
| 4274 | 491 | 700740465H1 | SOYMON012 | g22632 | BLASTN | 482 | 1e−31 | 74 |
| 4275 | 491 | 700682621H2 | SOYMON008 | g22632 | BLASTN | 484 | 1e−31 | 74 |
| 4276 | 491 | 700874316H1 | SOYMON018 | g22632 | BLASTN | 466 | 1e−30 | 73 |
| 4277 | 491 | 700686477H1 | SOYMON008 | g22632 | BLASTN | 473 | 1e−30 | 73 |
| 4278 | 491 | 700739979H1 | SOYMON012 | g22632 | BLASTN | 476 | 1e−30 | 74 |
| 4279 | 491 | 700739416H1 | SOYMON012 | g22632 | BLASTN | 476 | 1e−30 | 74 |
| 4280 | 491 | 700685976H1 | SOYMON008 | g22632 | BLASTN | 476 | 1e−30 | 74 |
| 4281 | 491 | 700739629H1 | SOYMON012 | g22632 | BLASTN | 486 | 1e−30 | 70 |
| 4282 | 491 | 700989163H1 | SOYMON011 | g22632 | BLASTN | 468 | 1e−29 | 72 |
| 4283 | 491 | 701000555H1 | SOYMON018 | g22632 | BLASTN | 477 | 1e−29 | 72 |
| 4284 | 491 | 700872702H1 | SOYMON018 | g22632 | BLASTN | 436 | 1e−28 | 72 |
| 4285 | 491 | 701000781H1 | SOYMON018 | g22632 | BLASTN | 460 | 1e−28 | 73 |
| 4286 | 491 | 700682760H1 | SOYMON008 | g22632 | BLASTN | 463 | 1e−28 | 72 |
| 4287 | 491 | 700740390H1 | SOYMON012 | g22632 | BLASTN | 440 | 1e−27 | 73 |
| 4288 | 491 | 700685346H1 | SOYMON008 | g22632 | BLASTN | 451 | 1e−27 | 72 |
| 4289 | 491 | 700557272H1 | SOYMON001 | g22632 | BLASTN | 250 | 1e−26 | 78 |
| 4290 | 491 | 700953343H1 | SOYMON022 | g22632 | BLASTN | 349 | 1e−26 | 74 |
| 4291 | 491 | 700741960H1 | SOYMON012 | g22632 | BLASTN | 430 | 1e−26 | 73 |
| 4292 | 491 | 700680247H2 | SOYMON008 | g22632 | BLASTN | 425 | 1e−25 | 67 |
| 4293 | 491 | 700680002H2 | SOYMON008 | g22632 | BLASTN | 241 | 1e−24 | 72 |
| 4294 | 491 | 700684827H1 | SOYMON008 | g22632 | BLASTN | 379 | 1e−24 | 74 |
| 4295 | 491 | 700956353H1 | SOYMON022 | g22632 | BLASTN | 410 | 1e−24 | 72 |
| 4296 | 491 | 700787513H1 | SOYMON011 | g22632 | BLASTN | 235 | 1e−22 | 72 |
| 4297 | 491 | 700725070H1 | SOYMON009 | g22632 | BLASTN | 241 | 1e−22 | 71 |
| 4298 | 491 | 700741111H1 | SOYMON012 | g22632 | BLASTN | 304 | 1e−22 | 73 |
| 4299 | 491 | 700738230H1 | SOYMON012 | g22632 | BLASTN | 241 | 1e−21 | 72 |
| 4300 | 491 | 700985308H1 | SOYMON009 | g22632 | BLASTN | 241 | 1e−21 | 80 |
| 4301 | 491 | 700991396H1 | SOYMON011 | g22632 | BLASTN | 350 | 1e−21 | 72 |
| 4302 | 491 | 700741276H1 | SOYMON012 | g22632 | BLASTN | 379 | 1e−21 | 71 |
| 4303 | 491 | 700740223H1 | SOYMON012 | g22632 | BLASTN | 241 | 1e−20 | 72 |
| 4304 | 491 | 700738808H1 | SOYMON012 | g22632 | BLASTN | 241 | 1e−20 | 72 |
| 4305 | 491 | 700997995H1 | SOYMON018 | g22632 | BLASTN | 241 | 1e−19 | 81 |
| 4306 | 491 | 700989713H1 | SOYMON011 | g22632 | BLASTN | 241 | 1e−19 | 73 |
| 4307 | 491 | 700875139H1 | SOYMON018 | g22632 | BLASTN | 241 | 1e−19 | 71 |
| 4308 | 491 | 700958366H1 | SOYMON022 | g22632 | BLASTN | 241 | 1e−18 | 71 |
| 4309 | 491 | 700683887H1 | SOYMON008 | g22632 | BLASTN | 344 | 1e−18 | 70 |
| 4310 | 491 | 700740788H1 | SOYMON012 | g22632 | BLASTN | 339 | 1e−17 | 70 |
| 4311 | 491 | 700743058H1 | SOYMON012 | g22632 | BLASTN | 205 | 1e−16 | 81 |
| 4312 | 491 | 700996423H1 | SOYMON018 | g22632 | BLASTN | 234 | 1e−16 | 80 |
| 4313 | 491 | 700686075H1 | SOYMON008 | g22632 | BLASTN | 241 | 1e−16 | 71 |
| 4314 | 491 | 700738811H1 | SOYMON012 | g22632 | BLASTN | 193 | 1e−15 | 72 |
| 4315 | 491 | 700998312H1 | SOYMON018 | g22632 | BLASTN | 234 | 1e−15 | 73 |
| 4316 | 491 | 700681825H1 | SOYMON008 | g22632 | BLASTN | 241 | 1e−15 | 81 |
| 4317 | 491 | 701109105H1 | SOYMON036 | g22632 | BLASTN | 290 | 1e−14 | 69 |
| 4318 | 491 | 701203741H2 | SOYMON035 | g22632 | BLASTN | 230 | 1e−13 | 78 |
| 4319 | 491 | 700740785H1 | SOYMON012 | g22632 | BLASTN | 287 | 1e−13 | 68 |
| 4320 | 491 | 700738486H1 | SOYMON012 | g22632 | BLASTN | 295 | 1e−13 | 64 |
| 4321 | 491 | 700739078H1 | SOYMON012 | g22632 | BLASTN | 178 | 1e−12 | 73 |
| 4322 | 491 | 701002287H1 | SOYMON018 | g22632 | BLASTN | 255 | 1e−12 | 74 |
| 4323 | 491 | 700742470H1 | SOYMON012 | g22632 | BLASTN | 278 | 1e−12 | 69 |
| 4324 | 491 | 700743421H1 | SOYMON012 | g22632 | BLASTN | 261 | 1e−11 | 71 |
| 4325 | 491 | 700744039H1 | SOYMON012 | g22632 | BLASTN | 265 | 1e−11 | 69 |
| 4326 | 491 | 700789444H2 | SOYMON011 | g22632 | BLASTN | 158 | 1e−10 | 87 |

TABLE A*-continued

| Seq No. | Cluster ID | CloneID | Library | NCBI gi | Method | Score | P-value | % Ident |
|---|---|---|---|---|---|---|---|---|
| 4327 | 491 | 700741074H1 | SOYMON012 | g22632 | BLASTN | 178 | 1e−10 | 77 |
| 4328 | 491 | 700998877H1 | SOYMON018 | g22632 | BLASTN | 235 | 1e−10 | 72 |
| 4329 | 491 | 700740005H1 | SOYMON012 | g22633 | BLASTX | 75 | 1e−9 | 64 |
| 4330 | 491 | 700872703H1 | SOYMON018 | g169037 | BLASTX | 116 | 1e−9 | 83 |
| 4331 | 491 | 700990557H1 | SOYMON011 | g22632 | BLASTN | 241 | 1e−9 | 76 |
| 4332 | 491 | 701001909H1 | SOYMON018 | g22632 | BLASTN | 241 | 1e−9 | 76 |
| 4333 | 491 | 700875039H1 | SOYMON018 | g22632 | BLASTN | 241 | 1e−9 | 72 |
| 4334 | 491 | 700743495H1 | SOYMON012 | g22632 | BLASTN | 241 | 1e−9 | 76 |
| 4335 | 491 | 700743995H1 | SOYMON012 | g22632 | BLASTN | 241 | 1e−9 | 76 |
| 4336 | 491 | 700743301H1 | SOYMON012 | g22632 | BLASTN | 241 | 1e−9 | 76 |
| 4337 | 491 | 700742515H1 | SOYMON012 | g22632 | BLASTN | 241 | 1e−9 | 76 |
| 4338 | 491 | 701001445H1 | SOYMON018 | g169037 | BLASTX | 115 | 1e−8 | 92 |
| 4339 | 491 | 700554881H1 | SOYMON001 | g169037 | BLASTX | 116 | 1e−8 | 94 |
| 4340 | 491 | 700954194H1 | SOYMON022 | g169037 | BLASTX | 116 | 1e−8 | 94 |
| 4341 | 491 | 700996869H1 | SOYMON018 | g22632 | BLASTN | 230 | 1e−8 | 76 |
| 4342 | 491 | 700897820H1 | SOYMON027 | g22632 | BLASTN | 234 | 1e−8 | 74 |
| 4343 | 491 | 700742574H1 | SOYMON012 | g22632 | BLASTN | 234 | 1e−8 | 74 |
| 4344 | 491 | 700684738H1 | SOYMON008 | g22632 | BLASTN | 235 | 1e−8 | 75 |
| 4345 | 7368 | 700739343H1 | SOYMON012 | g927507 | BLASTX | 164 | 1e−15 | 88 |
| 4346 | -GM32379 | LIB3051-015-Q1-E1-B12 | LIB3051 | g3021337 | BLASTN | 260 | 1e−28 | 77 |
| 4347 | -GM8265 | LIB3039-048-Q1-E1-F11 | LIB3039 | g3021337 | BLASTN | 481 | 1e−29 | 65 |
| 4348 | 16 | LIB3027-010-Q1-B1-B7 | LIB3027 | g3021337 | BLASTN | 1393 | 1e−107 | 82 |
| 4349 | 16 | LIB3039-049-Q1-E1-B8 | LIB3039 | g3021337 | BLASTN | 1297 | 1e−99 | 83 |
| 4350 | 16 | LIB3051-061-Q1-K1-E11 | LIB3051 | g3021337 | BLASTN | 1303 | 1e−99 | 84 |
| 4351 | 16 | LIB3056-009-Q1-N1-A10 | LIB3056 | g3021337 | BLASTN | 1126 | 1e−96 | 84 |
| 4352 | 16 | LIB3051-025-Q1-K1-E11 | LIB3051 | g3021337 | BLASTN | 1262 | 1e−96 | 83 |
| 4353 | 16 | LIB3056-014-Q1-N1-E1 | LIB3056 | g3021337 | BLASTN | 1077 | 1e−94 | 81 |
| 4354 | 16 | LIB3055-005-Q1-N1-A8 | LIB3055 | g3021337 | BLASTN | 1227 | 1e−93 | 84 |
| 4355 | 16 | LIB3040-045-Q1-E1-A4 | LIB3040 | g3021337 | BLASTN | 1211 | 1e−92 | 83 |
| 4356 | 16 | LIB3028-010-Q1-B1-G9 | LIB3028 | g3021337 | BLASTN | 1215 | 1e−92 | 83 |
| 4357 | 16 | LIB3056-010-Q1-N1-G8 | LIB3056 | g3021337 | BLASTN | 1217 | 1e−92 | 84 |
| 4358 | 16 | LIB3039-029-Q1-E1-A6 | LIB3039 | g3021337 | BLASTN | 1128 | 1e−85 | 85 |
| 4359 | 16 | LIB3051-014-Q1-E1-D2 | LIB3051 | g3021337 | BLASTN | 716 | 1e−80 | 83 |
| 4360 | 16 | LIB3030-010-Q1-B1-D7 | LIB3030 | g3021337 | BLASTN | 1052 | 1e−78 | 83 |
| 4361 | 16 | LIB3051-094-Q1-K1-A9 | LIB3051 | g3021337 | BLASTN | 778 | 1e−74 | 83 |
| 4362 | 16 | LIB3028-030-Q1-B1-C9 | LIB3028 | g3021337 | BLASTN | 953 | 1e−70 | 85 |
| 4363 | 16 | LIB3052-004-Q1-N1-D8 | LIB3052 | g3021337 | BLASTN | 868 | 1e−63 | 82 |
| 4364 | 16 | LIB3065-014-Q1-N1-A3 | LIB3065 | g3021337 | BLASTN | 540 | 1e−61 | 79 |
| 4365 | 16 | LIB3050-019-Q1-K1-H1 | LIB3050 | g168420 | BLASTX | 223 | 1e−40 | 63 |
| 4366 | 16 | LIB3051-062-Q1-K1-B5 | LIB3051 | g3021337 | BLASTN | 541 | 1e−38 | 79 |
| 4367 | 3425 | LIB3051-067-Q1-K1-E7 | LIB3051 | g3021337 | BLASTN | 1082 | 1e−81 | 78 |
| 4368 | 3425 | LIB3050-006-Q1-E1-G7 | LIB3050 | g3021337 | BLASTN | 752 | 1e−57 | 75 |
| 4369 | 491 | LIB3028-011-Q1-B1-B9 | LIB3028 | g22632 | BLASTN | 911 | 1e−67 | 75 |
| 4370 | 491 | LIB3028-011-Q1-B1-F2 | LIB3028 | g22632 | BLASTN | 886 | 1e−65 | 77 |
| MAIZE FRUCTOSE-1,6-BISPHOSPHATASE | | | | | | | | |
| 4371 | -700262935 | 700262935H1 | SATMON017 | g3041775 | BLASTX | 184 | 1e−18 | 94 |
| 4372 | -700432173 | 700432173H1 | SATMONN01 | g1790679 | BLASTX | 123 | 1e−16 | 56 |
| 4373 | -700455709 | 700455709H1 | SATMON029 | g3041776 | BLASTN | 597 | 1e−40 | 85 |
| 4374 | -700573083 | 700573083H1 | SATMON030 | g3041775 | BLASTX | 69 | 1e−10 | 64 |
| 4375 | -701158577 | 701158577H1 | SATMONN04 | g895908 | BLASTN | 200 | 1e−10 | 84 |
| 4376 | 12846 | 700101851H1 | SATMON009 | g3041776 | BLASTN | 1312 | 1e−100 | 91 |

TABLE A*-continued

| Seq No. | Cluster ID | CloneID | Library | NCBI gi | Method | Score | P-value | % Ident |
|---|---|---|---|---|---|---|---|---|
| 4377 | 12846 | 700101541H1 | SATMON009 | g3041776 | BLASTN | 1252 | 1e-95 | 90 |
| 4378 | 12846 | 700581510H1 | SATMON031 | g3041776 | BLASTN | 872 | 1e-82 | 90 |
| 4379 | 15627 | 700046054H1 | SATMON004 | g21736 | BLASTN | 1213 | 1e-92 | 91 |
| 4380 | 15627 | 700421605H1 | SATMONN01 | g3041776 | BLASTN | 664 | 1e-77 | 90 |
| 4381 | 15627 | 700445495H1 | SATMON027 | g21736 | BLASTN | 1004 | 1e-74 | 84 |
| 4382 | 15627 | 700042188H1 | SATMON004 | g3041776 | BLASTN | 875 | 1e-64 | 88 |
| 4383 | 16870 | 700100752H1 | SATMON009 | g3041776 | BLASTN | 257 | 1e-33 | 75 |
| 4384 | 16870 | 700044805H1 | SATMON004 | g3041776 | BLASTN | 194 | 1e-14 | 76 |
| 4385 | 16870 | 700099217H1 | SATMON009 | g21736 | BLASTN | 246 | 1e-9 | 59 |
| 4386 | 25562 | 701166271H1 | SATMONN04 | g895908 | BLASTN | 352 | 1e-43 | 91 |
| 4387 | 25562 | 701163676H1 | SATMONN04 | g895908 | BLASTN | 299 | 1e-37 | 91 |
| 4388 | 32637 | 700097620H1 | SATMON009 | g895908 | BLASTN | 1380 | 1e-106 | 92 |
| 4389 | 32637 | 700580175H1 | SATMON031 | g895908 | BLASTN | 930 | 1e-68 | 89 |
| 4390 | 5480 | 700098780H1 | SATMON009 | g895908 | BLASTN | 1103 | 1e-90 | 95 |
| 4391 | 5480 | 700043335H1 | SATMON004 | g895908 | BLASTN | 1026 | 1e-76 | 93 |
| 4392 | 5480 | 700043111H1 | SATMON004 | g895908 | BLASTN | 879 | 1e-64 | 97 |
| 4393 | 5480 | 700442189H1 | SATMON026 | g3041774 | BLASTN | 536 | 1e-54 | 93 |
| 4394 | 5480 | 700208394H1 | SATMON016 | g895908 | BLASTN | 520 | 1e-43 | 92 |
| 4395 | 5480 | 700045530H1 | SATMON004 | g895908 | BLASTN | 613 | 1e-42 | 97 |
| 4396 | 5480 | 700098393H1 | SATMON009 | g895908 | BLASTN | 308 | 1e-16 | 88 |
| 4397 | 8243 | 700264654H1 | SATMON017 | g3041774 | BLASTN | 942 | 1e-69 | 84 |
| 4398 | 8243 | 700479624H1 | SATMON034 | g3041774 | BLASTN | 902 | 1e-66 | 82 |
| 4399 | 8243 | 700448974H1 | SATMON028 | g3041774 | BLASTN | 876 | 1e-64 | 84 |
| 4400 | 8666 | 700100948H1 | SATMON009 | g895908 | BLASTN | 1327 | 1e-101 | 92 |
| 4401 | 8666 | 700212964H1 | SATMON016 | g895908 | BLASTN | 1189 | 1e-90 | 91 |
| 4402 | 8666 | 700578027H1 | SATMON031 | g895908 | BLASTN | 1076 | 1e-80 | 91 |
| 4403 | -L1485381 | LIB148-057-Q1-E1-E6 | LIB148 | g440591 | BLASTX | 80 | 1e-30 | 63 |
| 4404 | -L30662838 | LIB3066-032-Q1-K1-F11 | LIB3066 | g895908 | BLASTN | 640 | 1e-58 | 86 |
| 4405 | -L30662839 | LIB3066-035-Q1-K1-F11 | LIB3066 | g3041774 | BLASTN | 215 | 1e-15 | 77 |
| 4406 | -L362913 | LIB36-013-Q1-E1-D10 | LIB36 | g3041776 | BLASTN | 937 | 1e-69 | 88 |
| 4407 | -L831319 | LIB83-003-Q1-E1-B4 | LIB83 | g895908 | BLASTN | 341 | 1e-58 | 86 |
| 4408 | -L832444 | LIB83-005-Q1-E1-D2 | LIB83 | g3041776 | BLASTN | 575 | 1e-37 | 93 |
| 4409 | -L841984 | LIB84-023-Q1-E1-F10 | LIB84 | g895908 | BLASTN | 937 | 1e-69 | 82 |
| 4410 | 12846 | LIB83-008-Q1-E1-A8 | LIB83 | g3041776 | BLASTN | 1610 | 1e-135 | 92 |
| 4411 | 12846 | LIB3078-003-Q1-K1-C7 | LIB3078 | g3041776 | BLASTN | 873 | 1e-98 | 93 |
| 4412 | 16870 | LIB3060-052-Q1-K1-D11 | LIB3060 | g21736 | BLASTN | 377 | 1e-66 | 70 |
| 4413 | 26002 | LIB83-008-Q1-E1-B10 | LIB83 | g3041776 | BLASTN | 378 | 1e-20 | 86 |
| 4414 | 32637 | LIB189-010-Q1-E1-C10 | LIB189 | g895908 | BLASTN | 1182 | 1e-138 | 92 |
| 4415 | 5480 | LIB83-002-Q1-E1-C2 | LIB83 | g895908 | BLASTN | 1773 | 1e-139 | 94 |
| 4416 | 5480 | LIB36-016-Q2-E2-H10 | LIB36 | g895908 | BLASTN | 1615 | 1e-125 | 94 |
| 4417 | 5480 | LIB189-032-Q1-E1-B6 | LIB189 | g895908 | BLASTN | 1598 | 1e-124 | 95 |
| 4418 | 5480 | LIB36-010-Q1-E1-C4 | LIB36 | g895908 | BLASTN | 1574 | 1e-122 | 93 |
| 4419 | 5480 | LIB3060-010-Q1-K1-D2 | LIB3060 | g895908 | BLASTN | 990 | 1e-82 | 91 |
| 4420 | 5480 | LIB189-021-Q1-E1-E10 | LIB189 | g895908 | BLASTN | 1045 | 1e-78 | 93 |
| 4421 | 5480 | LIB84-013-Q1-E1-F7 | LIB84 | g895908 | BLASTN | 1032 | 1e-77 | 96 |
| SOYBEAN FRUCTOSE-1,6-BISPHOSPHATASE | | | | | | | | |
| 4422 | -700685384 | 700685384H1 | SOYMON008 | g21244 | BLASTN | 597 | 1e-49 | 80 |
| 4423 | -700737915 | 700737915H1 | SOYMON012 | g515746 | BLASTN | 1316 | 1e-100 | 97 |
| 4424 | -700741457 | 700741457H1 | SOYMON012 | g3041774 | BLASTN | 692 | 1e-58 | 80 |
| 4425 | -700873234 | 700873234H1 | SOYMON018 | g166955 | BLASTN | 417 | 1e-33 | 83 |
| 4426 | -700874831 | 700874831H1 | SOYMON018 | g515746 | BLASTN | 1295 | 1e-99 | 100 |
| 4427 | -700983024 | 700983024H1 | SOYMON009 | g166955 | BLASTN | 575 | 1e-60 | 76 |
| 4428 | -700993304 | 700993304H1 | SOYMON011 | g166955 | BLASTN | 902 | 1e-66 | 84 |
| 4429 | -700996155 | 700996155H1 | SOYMON018 | g3041774 | BLASTN | 651 | 1e-45 | 83 |
| 4430 | -700996632 | 700996632H1 | SOYMON018 | g515746 | BLASTN | 507 | 1e-51 | 90 |
| 4431 | -700998027 | 700998027H1 | SOYMON018 | g515746 | BLASTN | 636 | 1e-65 | 94 |
| 4432 | -701209548 | 701209548H1 | SOYMON035 | g3041774 | BLASTN | 642 | 1e-44 | 83 |

TABLE A*-continued

| Seq No. | Cluster ID | CloneID | Library | NCBI gi | Method | Score | P-value | % Ident |
|---|---|---|---|---|---|---|---|---|
| 4433 | 10129 | 700870828H1 | SOYMON018 | g21244 | BLASTN | 827 | 1e-60 | 79 |
| 4434 | 10129 | 700741669H1 | SOYMON012 | g21244 | BLASTN | 657 | 1e-53 | 80 |
| 4435 | 10348 | 700555754H1 | SOYMON001 | g21244 | BLASTN | 466 | 1e-29 | 77 |
| 4436 | 10348 | 700991527H1 | SOYMON011 | g440591 | BLASTX | 169 | 1e-16 | 88 |
| 4437 | 13716 | 700898719H1 | SOYMON027 | g515746 | BLASTN | 1186 | 1e-90 | 97 |
| 4438 | 13716 | 700993540H1 | SOYMON011 | g515746 | BLASTN | 1179 | 1e-89 | 98 |
| 4439 | 13716 | 700909657H1 | SOYMON022 | g515746 | BLASTN | 568 | 1e-57 | 86 |
| 4440 | 1894 | 700555054H1 | SOYMON001 | g515746 | BLASTN | 1320 | 1e-101 | 100 |
| 4441 | 1894 | 700685264H1 | SOYMON008 | g515746 | BLASTN | 1323 | 1e-101 | 99 |
| 4442 | 1894 | 700558854H1 | SOYMON001 | g515746 | BLASTN | 695 | 1e-98 | 100 |
| 4443 | 1894 | 700554755H1 | SOYMON001 | g515746 | BLASTN | 767 | 1e-98 | 99 |
| 4444 | 1894 | 701000504H1 | SOYMON018 | g515746 | BLASTN | 626 | 1e-95 | 98 |
| 4445 | 1894 | 700738115H1 | SOYMQN012 | g515746 | BLASTN | 1230 | 1e-93 | 100 |
| 4446 | 1894 | 700992933H1 | SOYMON011 | g515746 | BLASTN | 1074 | 1e-91 | 98 |
| 4447 | 1894 | 701107444H1 | SOYMON036 | g515746 | BLASTN | 1201 | 1e-91 | 99 |
| 4448 | 1894 | 700852823H1 | SOYMON023 | g515746 | BLASTN | 1041 | 1e-90 | 98 |
| 4449 | 1894 | 700733478H1 | SOYMON010 | g515746 | BLASTN | 1150 | 1e-90 | 97 |
| 4450 | 1894 | 701105185H1 | SOYMON036 | g515746 | BLASTN | 641 | 1e-87 | 89 |
| 4451 | 1894 | 700737830H1 | SOYMON012 | g515746 | BLASTN | 1060 | 1e-87 | 100 |
| 4452 | 1894 | 700685110H1 | SOYMON008 | g515746 | BLASTN | 597 | 1e-86 | 90 |
| 4453 | 1894 | 700968307H1 | SOYMON036 | g515746 | BLASTN | 1113 | 1e-84 | 97 |
| 4454 | 1894 | 700653014H1 | SOYMON003 | g515746 | BLASTN | 587 | 1e-82 | 90 |
| 4455 | 1894 | 700555504H1 | SOYMON001 | g515746 | BLASTN | 626 | 1e-81 | 88 |
| 4456 | 1894 | 700751540H1 | SOYMON014 | g515746 | BLASTN | 585 | 1e-77 | 91 |
| 4457 | 1894 | 700901976H1 | SOYMON027 | g515746 | BLASTN | 505 | 1e-73 | 87 |
| 4458 | 1894 | 700986496H1 | SOYMON009 | g515746 | BLASTN | 559 | 1e-73 | 90 |
| 4459 | 1894 | 700751580H1 | SOYMON014 | g515746 | BLASTN | 569 | 1e-72 | 89 |
| 4460 | 1894 | 700751532H1 | SOYMON014 | g515746 | BLASTN | 571 | 1e-72 | 90 |
| 4461 | 1894 | 700990937H1 | SOYMON011 | g515746 | BLASTN | 544 | 1e-71 | 88 |
| 4462 | 1894 | 700740789H1 | SOYMON012 | g515746 | BLASTN | 630 | 1e-69 | 100 |
| 4463 | 1894 | 700743994H1 | SOYMON012 | g515746 | BLASTN | 945 | 1e-69 | 100 |
| 4464 | 1894 | 700754374H1 | SOYMON014 | g515746 | BLASTN | 460 | 1e-62 | 91 |
| 4465 | 1894 | 701001295H1 | SOYMON018 | g515746 | BLASTN | 541 | 1e-62 | 97 |
| 4466 | 1894 | 701155952H1 | SOYMON031 | g515746 | BLASTN | 568 | 1e-51 | 83 |
| 4467 | 1894 | 700872212H1 | SOYMON018 | g515746 | BLASTN | 670 | 1e-47 | 100 |
| 4468 | 1894 | 700682196H1 | SOYMON008 | g515746 | BLASTN | 609 | 1e-41 | 98 |
| 4469 | 1894 | 700738779H1 | SOYMON012 | g515746 | BLASTN | 252 | 1e-16 | 82 |
| 4470 | 26568 | 700844816H1 | SOYMON021 | g21244 | BLASTN | 649 | 1e-45 | 78 |
| 4471 | 27512 | 701128049H1 | SOYMON037 | g440591 | BLASTX | 185 | 1e-18 | 87 |
| 4472 | 27512 | 701152064H1 | SOYMON031 | g895908 | BLASTN | 243 | 1e-9 | 77 |
| 4473 | 7128 | 700649626H1 | SOYMON003 | g166955 | BLASTN | 326 | 1e-25 | 79 |
| 4474 | 7128 | 700649846H1 | SOYMON003 | g440591 | BLASTX | 125 | 1e-15 | 81 |
| 4475 | 10348 | LIB3030-010-Q1-B1-C7 | LIB3030 | g21244 | BLASTN | 476 | 1e-28 | 76 |

MAIZE TRANSKETOLASE

| Seq No. | Cluster ID | CloneID | Library | NCBI gi | Method | Score | P-value | % Ident |
|---|---|---|---|---|---|---|---|---|
| 4476 | -700097383 | 700097383H1 | SATMON009 | g664902 | BLASTN | 1029 | 1e-76 | 80 |
| 4477 | -701159054 | 701159054H1 | SATMONN04 | g2529342 | BLASTX | 214 | 1e-27 | 79 |
| 4478 | -701184582 | 701184582H1 | SATMONN06 | g1658321 | BLASTN | 745 | 1e-53 | 74 |
| 4479 | 1244 | 700553205H1 | SATMON022 | g1658321 | BLASTN | 816 | 1e-59 | 75 |
| 4480 | 1244 | 700473792H1 | SATMON025 | g1658321 | BLASTN | 826 | 1e-59 | 75 |
| 4481 | 1244 | 700405168H1 | SATMON028 | g1658321 | BLASTN | 805 | 1e-58 | 75 |
| 4482 | 1244 | 700089307H1 | SATMON011 | g1658321 | BLASTN | 743 | 1e-53 | 74 |
| 4483 | 1244 | 700355533H1 | SATMON024 | g1658321 | BLASTN | 589 | 1e-51 | 76 |
| 4484 | 1244 | 700085136H1 | SATMON011 | g1658321 | BLASTN | 690 | 1e-48 | 76 |
| 4485 | 1244 | 700382850H1 | SATMON024 | g664900 | BLASTN | 537 | 1e-47 | 72 |
| 4486 | 1244 | 700454437H1 | SATMON029 | g1658321 | BLASTN | 655 | 1e-45 | 75 |
| 4487 | 1244 | 700150022H1 | SATMON007 | g1658321 | BLASTN | 606 | 1e-41 | 76 |
| 4488 | 1244 | 700212701H1 | SATMON016 | g1658321 | BLASTN | 507 | 1e-40 | 74 |
| 4489 | 1244 | 700438654H1 | SATMON026 | g2529342 | BLASTX | 160 | 1e-24 | 89 |
| 4490 | 1244 | 700458530H1 | SATMON029 | g2529342 | BLASTX | 177 | 1e-20 | 87 |
| 4491 | 2946 | 700262031H1 | SATMON017 | g1658321 | BLASTN | 467 | 1e-30 | 74 |
| 4492 | 3403 | 700075930H1 | SATMON007 | g664900 | BLASTN | 968 | 1e-71 | 81 |
| 4493 | 3403 | 700381012H1 | SATMON023 | g1658321 | BLASTN | 949 | 1e-70 | 80 |
| 4494 | 3403 | 700243701H1 | SATMON010 | g1658321 | BLASTN | 874 | 1e-63 | 80 |
| 4495 | 3403 | 700220485H1 | SATMON011 | g664900 | BLASTN | 666 | 1e-54 | 74 |
| 4496 | 3403 | 700045165H1 | SATMON004 | g664900 | BLASTN | 734 | 1e-52 | 73 |
| 4497 | 3403 | 701185190H1 | SATMONN06 | g664900 | BLASTN | 709 | 1e-50 | 77 |
| 4498 | 3403 | 700552475H1 | SATMON022 | g664900 | BLASTN | 591 | 1e-49 | 81 |
| 4499 | 3403 | 700044755H1 | SATMON004 | g664900 | BLASTN | 690 | 1e-48 | 72 |
| 4500 | 3403 | 700051910H1 | SATMON003 | g664900 | BLASTN | 671 | 1e-47 | 77 |
| 4501 | 3403 | 700027425H1 | SATMON003 | g664900 | BLASTN | 675 | 1e-47 | 71 |
| 4502 | 3403 | 700048347H1 | SATMON003 | g664900 | BLASTN | 662 | 1e-46 | 71 |
| 4503 | 3403 | 700380608H1 | SATMON021 | g1658321 | BLASTN | 623 | 1e-43 | 82 |
| 4504 | 3403 | 700448484H1 | SATMON027 | g664900 | BLASTN | 522 | 1e-33 | 71 |
| 4505 | 3403 | 700184906H1 | SATMON014 | g2529342 | BLASTX | 251 | 1e-27 | 77 |
| 4506 | 3403 | 700048819H1 | SATMON003 | g664900 | BLASTN | 453 | 1e-27 | 74 |

TABLE A*-continued

| Seq No. | Cluster ID | CloneID | Library | NCBI gi | Method | Score | P-value | % Ident |
|---|---|---|---|---|---|---|---|---|
| 4507 | 3403 | 701167994H1 | SATMONN05 | g2529342 | BLASTX | 193 | 1e−19 | 76 |
| 4508 | 8097 | 700084375H1 | SATMON011 | g664900 | BLASTN | 855 | 1e−76 | 79 |
| 4509 | 8097 | 700445226H1 | SATMON027 | g664900 | BLASTN | 464 | 1e−60 | 79 |
| 4510 | 8097 | 700240770H1 | SATMON010 | g664900 | BLASTN | 750 | 1e−60 | 80 |
| 4511 | 8097 | 700045122H1 | SATMON004 | g664900 | BLASTN | 638 | 1e−54 | 80 |
| 4512 | 3403 | LIB3060-013-Q1-K1-A12 | LIB3060 | g664900 | BLASTN | 1052 | 1e−78 | 72 |
| 4513 | 3403 | LIB3078-007-Q1-K1-G3 | LIB3078 | g664900 | BLASTN | 629 | 1e−41 | 69 |
| MAIZE PUTATIVE TRANSKETOLASE | | | | | | | | |
| 4514 | -700045462 | 700045462H1 | SATMON004 | g2612940 | BLASTN | 1219 | 1e−92 | 89 |
| 4515 | -700223919 | 700223919H1 | SATMON011 | g2612940 | BLASTN | 1025 | 1e−76 | 87 |
| 4516 | -700256830 | 700256830H1 | SATMON017 | g2612940 | BLASTN | 1029 | 1e−76 | 87 |
| 4517 | -701169515 | 701169515H1 | SATMONN05 | g2612940 | BLASTN | 327 | 1e−40 | 92 |
| 4518 | 23377 | 700263420H1 | SATMON017 | g2612940 | BLASTN | 489 | 1e−31 | 75 |
| 4519 | 23377 | 701185311H1 | SATMONN06 | g2612940 | BLASTN | 460 | 1e−27 | 78 |
| 4520 | 7446 | 700624329H1 | SATMON034 | g2612940 | BLASTN | 1046 | 1e−87 | 88 |
| 4521 | 7446 | 700159091H1 | SATMON012 | g2612940 | BLASTN | 898 | 1e−77 | 89 |
| 4522 | -L30626416 | LIB3062-048-Q1-K1-D12 | LIB3062 | g2612940 | BLASTN | 808 | 1e−74 | 86 |
| 4523 | -L30684293 | LIB3068-046-Q1-K1-B2 | LIB3068 | g2612940 | BLASTN | 846 | 1e−90 | 87 |
| 4524 | 28081 | LIB36-007-Q1-E1-F12 | LIB36 | g2612940 | BLASTN | 521 | 1e−32 | 92 |
| SOYBEAN TRANSKETOLASE | | | | | | | | |
| 4525 | -700646481 | 700646481H1 | SOYMON013 | g1658321 | BLASTN | 967 | 1e−71 | 83 |
| 4526 | -700734535 | 700734535H1 | SOYMON010 | g1658321 | BLASTN | 822 | 1e−59 | 82 |
| 4527 | -700865886 | 700865886H1 | SOYMON016 | g1658321 | BLASTN | 568 | 1e−38 | 82 |
| 4528 | -700943688 | 700943688H1 | SOYMON024 | g1658321 | BLASTN | 902 | 1e−66 | 82 |
| 4529 | -700954594 | 700954594H1 | SOYMON022 | g2529342 | BLASTX | 172 | 1e−16 | 75 |
| 4530 | -701064360 | 701064360H1 | SOYMON034 | g664901 | BLASTX | 179 | 1e−17 | 80 |
| 4531 | 1039 | 700662776H1 | SOYMON005 | g1658321 | BLASTN | 755 | 1e−78 | 83 |
| 4532 | 1039 | 700663764H1 | SOYMON005 | g1658321 | BLASTN | 839 | 1e−61 | 82 |
| 4533 | 1039 | 700952282H1 | SOYMON022 | g1658321 | BLASTN | 785 | 1e−56 | 81 |
| 4534 | 1039 | 700835426H1 | SOYMON019 | g1658321 | BLASTN | 748 | 1e−53 | 81 |
| 4535 | 1039 | 700738038H1 | SOYMON012 | g1658321 | BLASTN | 559 | 1e−37 | 80 |
| 4536 | 1040 | 700606230H1 | SOYMON008 | g1658321 | BLASTN | 532 | 1e−69 | 82 |
| 4537 | 1040 | 700681196H2 | SOYMON008 | g1658321 | BLASTN | 866 | 1e−63 | 80 |
| 4538 | 1040 | 700874408H1 | SOYMON018 | g1658321 | BLASTN | 475 | 1e−60 | 82 |
| 4539 | 1040 | 700901259H1 | SOYMON027 | g1658321 | BLASTN | 821 | 1e−59 | 81 |
| 4540 | 1040 | 700996991H1 | SOYMON018 | g1658321 | BLASTN | 450 | 1e−58 | 80 |
| 4541 | 1040 | 700876984H1 | SOYMON018 | g1658321 | BLASTN | 807 | 1e−58 | 81 |
| 4542 | 1040 | 700871885H1 | SOYMON018 | g1658321 | BLASTN | 812 | 1e−58 | 81 |
| 4543 | 1040 | 700740158H1 | SOYMON012 | g1658321 | BLASTN | 767 | 1e−55 | 78 |
| 4544 | 1040 | 700787592H1 | SOYMON011 | g1658321 | BLASTN | 770 | 1e−55 | 80 |
| 4545 | 1040 | 700789355H2 | SOYMON011 | g1658321 | BLASTN | 727 | 1e−51 | 81 |
| 4546 | 1040 | 700786173H2 | SOYMON011 | g1658321 | BLASTN | 523 | 1e−47 | 79 |
| 4547 | 1040 | 700987027H1 | SOYMON009 | g1658321 | BLASTN | 680 | 1e−47 | 78 |
| 4548 | 1040 | 700683335H1 | SOYMON008 | g1658321 | BLASTN | 567 | 1e−38 | 80 |
| 4549 | 1040 | 700742402H1 | SOYMON012 | g1658321 | BLASTN | 521 | 1e−34 | 78 |
| 4550 | 1040 | 700682934H1 | SOYMON008 | g1658322 | BLASTX | 111 | 1e−22 | 79 |
| 4551 | 1040 | 701001535H1 | SOYMON018 | g664900 | BLASTN | 337 | 1e−18 | 85 |
| 4552 | 1381 | 701002017H1 | SOYMON018 | g1658321 | BLASTN | 860 | 1e−62 | 81 |
| 4553 | 1381 | 700680946H1 | SOYMON008 | g1658321 | BLASTN | 848 | 1e−61 | 75 |
| 4554 | 1381 | 700785920H2 | SOYMON011 | g1658321 | BLASTN | 715 | 1e−60 | 80 |
| 4555 | 1381 | 700741325H1 | SOYMON012 | g1658321 | BLASTN | 836 | 1e−60 | 81 |
| 4556 | 1381 | 700737257H1 | SOYMON010 | g1658321 | BLASTN | 783 | 1e−56 | 83 |
| 4557 | 1381 | 700743637H1 | SOYMON012 | g1658321 | BLASTN | 456 | 1e−47 | 79 |
| 4558 | 1381 | 700683536H1 | SOYMON008 | g1658321 | BLASTN | 682 | 1e−47 | 82 |
| 4559 | 1381 | 700899577H1 | SOYMON027 | g1658321 | BLASTN | 632 | 1e−43 | 73 |
| 4560 | 1381 | 700655539H1 | SOYMON004 | g1658321 | BLASTN | 399 | 1e−32 | 77 |
| 4561 | 1381 | 700743117H1 | SOYMON012 | g664901 | BLASTX | 144 | 1e−12 | 88 |
| 4562 | 1381 | 701047167H1 | SOYMON032 | g1658321 | BLASTN | 147 | 1e−10 | 88 |
| 4563 | 1694 | 700557862H1 | SOYMON001 | g1658321 | BLASTN | 918 | 1e−67 | 81 |
| 4564 | 1694 | 701124388H1 | SOYMON037 | g1658321 | BLASTN | 884 | 1e−64 | 84 |
| 4565 | 1694 | 700977906H1 | SOYMON009 | g1658321 | BLASTN | 741 | 1e−60 | 81 |
| 4566 | 1694 | 700741633H1 | SOYMON012 | g1658321 | BLASTN | 753 | 1e−60 | 83 |
| 4567 | 20534 | 701214424H1 | SOYMON035 | g1658321 | BLASTN | 855 | 1e−62 | 80 |
| 4568 | 20534 | 701214345H1 | SOYMON035 | g1658321 | BLASTN | 845 | 1e−61 | 81 |
| 4569 | 20534 | 700737144H1 | SOYMON010 | g1658321 | BLASTN | 743 | 1e−53 | 79 |
| 4570 | 20534 | 700737045H1 | SOYMON010 | g1658321 | BLASTN | 716 | 1e−50 | 80 |
| 4571 | 2081 | 700684191H1 | SOYMON008 | g1658321 | BLASTN | 243 | 1e−11 | 68 |
| 4572 | 2081 | 700871634H1 | SOYMON018 | g1658321 | BLASTN | 243 | 1e−9 | 65 |
| 4573 | 2081 | 700896859H1 | SOYMON027 | g1658321 | BLASTN | 243 | 1e−9 | 65 |
| 4574 | 2081 | 700741968H1 | SOYMON012 | g1658321 | BLASTN | 243 | 1e−9 | 65 |

TABLE A*-continued

| Seq No. | Cluster ID | CloneID | Library | NCBI gi | Method | Score | P-value | % Ident |
|---|---|---|---|---|---|---|---|---|
| 4575 | 2081 | 700743285H1 | SOYMON012 | g1658321 | BLASTN | 234 | 1e−8 | 65 |
| 4576 | 2081 | 701105794H1 | SOYMON036 | g1658321 | BLASTN | 236 | 1e−8 | 65 |
| 4577 | 2081 | 700646243H1 | SOYMON012 | g1658321 | BLASTN | 236 | 1e−8 | 65 |
| 4578 | 2081 | 701104160H1 | SOYMON036 | g1658321 | BLASTN | 236 | 1e−8 | 65 |
| 4579 | 2081 | 700741863H1 | SOYMON012 | g1658321 | BLASTN | 238 | 1e−8 | 65 |
| 4580 | 2091 | 700651076H1 | SOYMON003 | g1658321 | BLASTN | 1055 | 1e−79 | 79 |
| 4581 | 2091 | 700874803H1 | SOYMON018 | g1658321 | BLASTN | 888 | 1e−65 | 82 |
| 4582 | 2091 | 700988611H1 | SOYMON009 | g1658321 | BLASTN | 419 | 1e−61 | 79 |
| 4583 | 2091 | 700657810H1 | SOYMON004 | g1658321 | BLASTN | 805 | 1e−58 | 81 |
| 4584 | 2091 | 700739094H1 | SOYMON012 | g1658321 | BLASTN | 425 | 1e−54 | 82 |
| 4585 | 2091 | 700962626H1 | SOYMON022 | g1658321 | BLASTN | 742 | 1e−52 | 78 |
| 4586 | 2091 | 700990046H1 | SOYMON011 | g1658321 | BLASTN | 376 | 1e−34 | 79 |
| 4587 | 3782 | 700870543H1 | SOYMON018 | g1658322 | BLASTX | 157 | 1e−25 | 68 |
| 4588 | 4096 | 700556949H1 | SOYMON001 | g664901 | BLASTX | 188 | 1e−18 | 92 |
| 4589 | 4096 | 700877014H1 | SOYMON018 | g664901 | BLASTX | 188 | 1e−18 | 92 |
| 4590 | 4096 | 700877022H1 | SOYMON018 | g664901 | BLASTX | 188 | 1e−18 | 92 |
| 4591 | 4096 | 700999039H1 | SOYMON018 | g664901 | BLASTX | 169 | 1e−16 | 91 |
| 4592 | 7870 | 700998419H1 | SOYMON018 | g1658321 | BLASTN | 430 | 1e−51 | 80 |
| 4593 | 7870 | 700557019H1 | SOYMON001 | g1658321 | BLASTN | 685 | 1e−48 | 80 |
| 4594 | 7870 | 700786020H2 | SOYMON011 | g1658321 | BLASTN | 531 | 1e−41 | 78 |
| 4595 | 7870 | 700740475H1 | SOYMON012 | g1658321 | BLASTN | 609 | 1e−41 | 74 |
| 4596 | 7870 | 700875020H1 | SOYMON018 | g1658321 | BLASTN | 525 | 1e−34 | 79 |
| 4597 | 7870 | 700674249H1 | SOYMON007 | g1658321 | BLASTN | 510 | 1e−33 | 82 |
| 4598 | 7870 | 700658256H1 | SOYMON004 | g2529342 | BLASTX | 178 | 1e−22 | 61 |
| 4599 | 7870 | 700677401H1 | SOYMON007 | g664901 | BLASTX | 158 | 1e−14 | 91 |
| 4600 | 9031 | 700874020H1 | SOYMON018 | g1658321 | BLASTN | 789 | 1e−56 | 79 |
| 4601 | 9031 | 700726463H1 | SOYMON009 | g1658321 | BLASTN | 758 | 1e−54 | 76 |
| 4602 | 9031 | 700869017H1 | SOYMON016 | g664900 | BLASTN | 743 | 1e−53 | 77 |
| 4603 | 9031 | 700566216H1 | SOYMON002 | g664901 | BLASTX | 201 | 1e−20 | 92 |
| 4604 | 1039 | LIB3051-053-Q1-K2-F1 | LIB3051 | g1658321 | BLASTN | 1326 | 1e−101 | 80 |
| 4605 | 9031 | LIB3039-045-Q1-E1-D1 | LIB3039 | g1658321 | BLASTN | 1033 | 1e−77 | 79 |
| SOYBEAN PUTATIVE TRANSKETOLASE | | | | | | | | |
| 4606 | 19183 | 700907766H1 | SOYMON022 | g2612940 | BLASTN | 395 | 1e−30 | 68 |
| 4607 | −700764341 | 700764341H1 | SOYMON021 | g2612941 | BLASTX | 247 | 1e−39 | 75 |
| 4608 | −700888745 | 700888745H1 | SOYMON024 | g2612941 | BLASTX | 237 | 1e−27 | 76 |
| 4609 | −700909473 | 700909473H1 | SOYMON022 | g2612941 | BLASTX | 114 | 1e−16 | 53 |
| 4610 | 7224 | 700681472H2 | SOYMON008 | g2612941 | BLASTX | 107 | 1e−12 | 72 |
| 4611 | 19325 | 700751059H1 | SOYMON014 | g2244912 | BLASTX | 160 | 1e−15 | 78 |
| 4612 | −GM40396 | LIB3051-093-Q1-K1-D2 | LIB3051 | g2612941 | BLASTX | 246 | 1e−73 | 90 |
| MAIZE SEDOHEPTULOSE-1,7-BISPHOSPHATASE | | | | | | | | |
| 4613 | 1006 | 700423931H1 | SATMONN01 | g14265 | BLASTX | 128 | 1e−14 | 86 |
| 4614 | 29810 | LIB36-010-Q1-E1-H12 | LIB36 | g2529375 | BLASTN | 911 | 1e−67 | 69 |
| SOYBEAN SEDOHEPTULOSE-1,7-BISPHOSPHATASE | | | | | | | | |
| 4615 | −700895707 | 700895707H1 | SOYMON027 | g2529375 | BLASTN | 696 | 1e−49 | 74 |
| 4616 | 24265 | 701154827H1 | SOYMON031 | g2529375 | BLASTN | 893 | 1e−65 | 83 |
| 4617 | 24265 | 701157439H1 | SOYMON031 | g2529375 | BLASTN | 851 | 1e−62 | 83 |
| 4618 | 3027 | 700988602H1 | SOYMON009 | g2529375 | BLASTN | 911 | 1e−67 | 77 |
| 4619 | 3027 | 701001010H1 | SOYMON018 | g2529375 | BLASTN | 915 | 1e−67 | 79 |
| 4620 | 3027 | 700997516H1 | SOYMON018 | g2529375 | BLASTN | 504 | 1e−60 | 80 |
| 4621 | 3027 | 700788686H1 | SOYMON011 | g2529375 | BLASTN | 837 | 1e−60 | 79 |
| 4622 | 3027 | 700556469H1 | SOYMON001 | g2529375 | BLASTN | 816 | 1e−59 | 76 |
| 4623 | 3027 | 700999494H1 | SOYMON018 | g2529375 | BLASTN | 806 | 1e−58 | 76 |
| 4624 | 3027 | 701106923H1 | SOYMON036 | g2529375 | BLASTN | 812 | 1e−58 | 78 |
| 4625 | 3027 | 700557386H1 | SOYMON001 | g2529375 | BLASTN | 473 | 1e−57 | 78 |
| 4626 | 3027 | 700996203H1 | SOYMON018 | g2529375 | BLASTN | 787 | 1e−56 | 79 |
| 4627 | 3027 | 700951860H1 | SOYMON022 | g2529375 | BLASTN | 771 | 1e−55 | 76 |
| 4628 | 3027 | 700683415H1 | SOYMON008 | g2529375 | BLASTN | 762 | 1e−54 | 79 |
| 4629 | 3027 | 700872306H1 | SOYMON018 | g2529375 | BLASTN | 734 | 1e−52 | 78 |
| 4630 | 3027 | 700876576H1 | SOYMON018 | g2529375 | BLASTN | 739 | 1e−52 | 79 |
| 4631 | 3027 | 700876860H1 | SOYMON018 | g2529375 | BLASTN | 741 | 1e−52 | 78 |
| 4632 | 3027 | 700874809H1 | SOYMON018 | g2529375 | BLASTN | 426 | 1e−50 | 76 |
| 4633 | 3027 | 700992772H1 | SOYMON011 | g2529375 | BLASTN | 707 | 1e−50 | 79 |
| 4634 | 3027 | 700740276H1 | SOYMON012 | g2529375 | BLASTN | 700 | 1e−49 | 76 |
| 4635 | 3027 | 700876171H1 | SOYMON018 | g786465 | BLASTN | 454 | 1e−47 | 80 |
| 4636 | 3027 | 700557859H1 | SOYMON001 | g2529375 | BLASTN | 633 | 1e−43 | 71 |
| 4637 | 3027 | 700556904H1 | SOYMON001 | g2529375 | BLASTN | 523 | 1e−42 | 70 |
| 4638 | 3027 | 701124349H1 | SOYMON037 | g2529375 | BLASTN | 565 | 1e−38 | 74 |
| 4639 | 3027 | 700554878H1 | SOYMON001 | g2529375 | BLASTN | 390 | 1e−36 | 68 |
| 4640 | 3027 | 700556561H1 | SOYMON001 | g2529375 | BLASTN | 540 | 1e−36 | 66 |
| 4641 | 3027 | 701001629H1 | SOYMON018 | g2529375 | BLASTN | 517 | 1e−34 | 66 |

TABLE A*-continued

| Seq No. | Cluster ID | CloneID | Library | NCBI gi | Method | Score | P-value | % Ident |
|---|---|---|---|---|---|---|---|---|
| 4642 | 3027 | 700789624H2 | SOYMON011 | g2529375 | BLASTN | 507 | 1e-33 | 66 |
| 4643 | 3027 | 700993071H1 | SOYMON011 | g2529375 | BLASTN | 511 | 1e-33 | 66 |
| 4644 | 3027 | 700556185H1 | SOYMON001 | g2529375 | BLASTN | 513 | 1e-33 | 66 |
| 4645 | 3027 | 700554166H1 | SOYMON001 | g2529375 | BLASTN | 520 | 1e-33 | 66 |
| 4646 | 3027 | 700680116H2 | SOYMON008 | g2529375 | BLASTN | 486 | 1e-31 | 65 |
| 4647 | 3027 | 700557591H1 | SOYMON001 | g2529375 | BLASTN | 497 | 1e-31 | 66 |
| 4648 | 3027 | 701108330H1 | SOYMON036 | g2529375 | BLASTN | 486 | 1e-30 | 65 |
| 4649 | 3027 | 700875128H1 | SOYMON018 | g2529375 | BLASTN | 460 | 1e-29 | 65 |
| 4650 | 3027 | 700991275H1 | SOYMON011 | g2529375 | BLASTN | 462 | 1e-29 | 64 |
| 4651 | 3027 | 700556249H1 | SOYMON001 | g2529375 | BLASTN | 466 | 1e-28 | 65 |
| 4652 | 3027 | 700559069H1 | SOYMON001 | g2529375 | BLASTN | 467 | 1e-28 | 72 |
| 4653 | 3027 | 700990985H1 | SOYMON011 | g2529375 | BLASTN | 444 | 1e-27 | 62 |
| 4654 | 3027 | 701062648H1 | SOYMON033 | g2529375 | BLASTN | 438 | 1e-26 | 64 |
| 4655 | 3027 | 700560603H1 | SOYMON001 | g2529375 | BLASTN | 441 | 1e-26 | 73 |
| 4656 | 3027 | 701109375H1 | SOYMON036 | g2529376 | BLASTX | 128 | 1e-23 | 59 |
| 4657 | 3027 | 700787023H2 | SOYMON011 | g2529376 | BLASTX | 158 | 1e-21 | 55 |
| 4658 | 3027 | 701053814H1 | SOYMON032 | g2529376 | BLASTX | 127 | 1e-19 | 52 |
| 4659 | 3027 | 701103839H1 | SOYMON036 | g2529376 | BLASTX | 162 | 1e-17 | 60 |
| 4660 | 3027 | 700874009H1 | SOYMON018 | g2529376 | BLASTX | 180 | 1e-17 | 50 |
| 4661 | 3027 | 700557201H1 | SOYMON001 | g14265 | BLASTX | 154 | 1e-16 | 70 |
| 4662 | 3027 | 701001319H1 | SOYMON018 | g2529375 | BLASTN | 324 | 1e-16 | 59 |
| 4663 | 3027 | 701105211H1 | SOYMON036 | g2529376 | BLASTX | 159 | 1e-15 | 62 |
| 4664 | 3027 | 700558314H1 | SOYMON001 | g2529376 | BLASTX | 149 | 1e-13 | 47 |
| 4665 | 3027 | 700786134H2 | SOYMON011 | g2529376 | BLASTX | 76 | 1e-12 | 57 |
| 4666 | 3027 | 700875943H1 | SOYMON018 | g2529376 | BLASTX | 107 | 1e-12 | 42 |
| 4667 | 3027 | 700741681H1 | SOYMON012 | g2529376 | BLASTX | 108 | 1e-10 | 46 |
| 4668 | 3027 | 701001530H1 | SOYMON018 | g14265 | BLASTX | 128 | 1e-10 | 83 |
| 4669 | 3027 | 701109215H1 | SOYMON036 | g2529375 | BLASTN | 257 | 1e-10 | 60 |
| 4670 | 3027 | 700891544H1 | SOYMON024 | g2529376 | BLASTX | 123 | 1e-9 | 44 |
| 4671 | 3027 | LIB3054-002-Q1-N1-B7 | LIB3054 | g2529375 | BLASTN | 1026 | 1e-76 | 71 |
| 4672 | 3027 | LIB3055-004-Q1-N1-B1 | LIB3055 | g2529375 | BLASTN | 423 | 1e-74 | 80 |
| 4673 | 3027 | LIB3053-006-Q1-N1-B2 | LIB3053 | g2529375 | BLASTN | 973 | 1e-72 | 71 |
| 4674 | 3027 | LIB3055-008-Q1-N1-H3 | LIB3055 | g2529375 | BLASTN | 684 | 1e-63 | 69 |
| 4675 | 3027 | LIB3055-011-Q1-N1-F4 | LIB3055 | g2529375 | BLASTN | 483 | 1e-33 | 77 |
| 4676 | 3027 | LIB3030-005-Q1-B1-E5 | LIB3030 | g2529375 | BLASTN | 315 | 1e-31 | 65 |
| 4677 | 3027 | LIB3054-003-Q1-N1-E12 | LIB3054 | g2529375 | BLASTN | 256 | 1e-10 | 60 |
| MAIZE D-RIBULOSE-5-PHOSPHATE-3-EPIMERASE | | | | | | | | |
| 4678 | -700222465 | 700222465H1 | SATMON011 | g1162980 | BLASTX | 149 | 1e-27 | 84 |
| 4679 | -700618106 | 700618106H1 | SATMON033 | g902739 | BLASTX | 80 | 1e-25 | 76 |
| 4680 | 10201 | 700101610H1 | SATMON009 | g902738 | BLASTN | 1009 | 1e-75 | 80 |
| 4681 | 10201 | 700098237H1 | SATMON009 | g902738 | BLASTN | 1000 | 1e-74 | 80 |
| 4682 | 10201 | 700209605H1 | SATMON016 | g1162979 | BLASTN | 976 | 1e-72 | 78 |
| 4683 | 10201 | 700101988H1 | SATMON009 | g902738 | BLASTN | 626 | 1e-69 | 80 |
| 4684 | 10201 | 700091966H1 | SATMON011 | g902738 | BLASTN | 905 | 1e-66 | 80 |
| 4685 | 10201 | 700101445H1 | SATMON009 | g1162979 | BLASTN | 844 | 1e-61 | 80 |
| 4686 | 10201 | 700159349H1 | SATMON012 | g902738 | BLASTN | 681 | 1e-48 | 73 |
| 4687 | 10201 | 700380926H1 | SATMON023 | g902738 | BLASTN | 463 | 1e-45 | 81 |
| 4688 | 17215 | 700048475H1 | SATMON003 | g1008313 | BLASTX | 177 | 1e-17 | 61 |
| 4689 | 17215 | 700105805H1 | SATMON010 | g1008313 | BLASTX | 123 | 1e-10 | 59 |
| 4690 | 1795 | 700432796H1 | SATMONN01 | g902739 | BLASTX | 139 | 1e-12 | 93 |
| 4691 | 6043 | 700104089H1 | SATMON010 | g1162979 | BLASTN | 583 | 1e-39 | 79 |
| 4692 | 6043 | 700099362H1 | SATMON011 | g1162980 | BLASTX | 156 | 1e-29 | 71 |
| 4693 | 6043 | 700042321H1 | SATMON004 | g1162979 | BLASTN | 271 | 1e-27 | 79 |
| 4694 | 6043 | 700457795H1 | SATMON029 | g902739 | BLASTX | 132 | 1e-25 | 64 |
| 4695 | 6043 | 700096215H1 | SATMON008 | g1162980 | BLASTX | 120 | 1e-19 | 65 |
| 4696 | 6043 | 700378379H1 | SATMON019 | g1162980 | BLASTX | 119 | 1e-17 | 86 |
| 4697 | 6043 | 700239692H1 | SATMON010 | g1162980 | BLASTX | 167 | 1e-16 | 63 |
| 4698 | 6043 | 700093535H1 | SATMON008 | g1162980 | BLASTX | 120 | 1e-13 | 61 |
| 4699 | 6043 | 700098183H1 | SATMON009 | g1162980 | BLASTX | 121 | 1e-13 | 60 |
| 4700 | 6043 | 700093175H1 | SATMON008 | g902739 | BLASTX | 126 | 1e-12 | 59 |
| 4701 | 6043 | 700098056H1 | SATMON009 | g1162980 | BLASTX | 120 | 1e-9 | 57 |
| 4702 | 6043 | 700101650H1 | SATMON009 | g1162980 | BLASTX | 120 | 1e-9 | 57 |
| 4703 | 6043 | 700053356H1 | SATMON009 | g1162980 | BLASTX | 121 | 1e-9 | 57 |
| 4704 | 6043 | 700099441H1 | SATMON009 | g902739 | BLASTX | 122 | 1e-9 | 58 |
| 4705 | 7043 | 700162921H1 | SATMON013 | g1008313 | BLASTX | 130 | 1e-17 | 60 |
| 4706 | 7043 | 700552657H1 | SATMON022 | g902739 | BLASTX | 154 | 1e-16 | 51 |
| 4707 | -L1891463 | LIB189-001-Q1-E1-F4 | LIB189 | g1162979 | BLASTN | 596 | 1e-39 | 78 |

TABLE A*-continued

| Seq No. | Cluster ID | CloneID | Library | NCBI gi | Method | Score | P-value | % Ident |
|---|---|---|---|---|---|---|---|---|
| 4708 | -L30781313 | LIB3078-002-Q1-K1-A2 | LIB3078 | g1162979 | BLASTN | 440 | 1e-25 | 79 |
| 4709 | 10201 | LIB3078-034-Q1-K1-E8 | LIB3078 | g1162979 | BLASTN | 1271 | 1e-97 | 78 |
| 4710 | 10201 | LIB189-018-Q1-E1-G1 | LIB189 | g902738 | BLASTN | 1263 | 1e-96 | 79 |
| 4711 | 10201 | LIB3060-022-Q1-K1-G2 | LIB3060 | g902738 | BLASTN | 1228 | 1e-93 | 76 |
| 4712 | 10201 | LIB3060-034-Q1-K1-D3 | LIB3060 | g902738 | BLASTN | 1205 | 1e-91 | 79 |
| 4713 | 10201 | LIB36-007-Q1-E1-D10 | LIB36 | g1162979 | BLASTN | 989 | 1e-83 | 78 |
| 4714 | 10201 | LIB3078-053-Q1-K1-F4 | LIB3078 | g1162979 | BLASTN | 850 | 1e-62 | 68 |
| 4715 | 10201 | LIB189-034-Q1-E1-B12 | LIB189 | g902738 | BLASTN | 761 | 1e-53 | 74 |
| 4716 | 1795 | LIB3067-056-Q1-K1-A4 | LIB3067 | g902738 | BLASTN | 645 | 1e-43 | 80 |
| 4717 | 6043 | LIB189-017-Q1-E1-F12 | LIB189 | g1162979 | BLASTN | 842 | 1e-61 | 78 |
| 4718 | 6043 | LIB36-012-Q1-E1-H11 | LIB36 | g1162979 | BLASTN | 742 | 1e-51 | 78 |
| 4719 | 6043 | LIB3060-018-Q1-K1-B5 | LIB3060 | g1162979 | BLASTN | 653 | 1e-43 | 77 |
| 4720 | 6043 | LIB3062-015-Q1-K1-A11 | LIB3062 | g1162979 | BLASTN | 637 | 1e-42 | 77 |
| 4721 | 6043 | LIB189-031-Q1-E1-D1 | LIB189 | g1162979 | BLASTN | 532 | 1e-33 | 76 |
| 4722 | 6043 | LIB3060-013-Q1-K1-A2 | LIB3060 | g1162979 | BLASTN | 466 | 1e-27 | 75 |
| 4723 | 7043 | LIB148-032-Q1-E1-A4 | LIB148 | g2564973 | BLASTX | 238 | 1e-42 | 48 |
| SOYBEAN D-RIBULOSE-5-PHOSPHATE-3-EPIMERASE | | | | | | | | |
| 4724 | -700677209 | 700677209H1 | SOYMON007 | g1162980 | BLASTX | 130 | 1e-30 | 85 |
| 4725 | 10469 | 700971857H1 | SOYMON005 | g1008313 | BLASTX | 208 | 1e-27 | 55 |
| 4726 | 10469 | 701064495H1 | SOYMON034 | g1008313 | BLASTX | 208 | 1e-27 | 56 |
| 4727 | 10469 | 701007767H1 | SOYMON019 | g1008313 | BLASTX | 129 | 1e-25 | 54 |
| 4728 | 10469 | 700656367H1 | SOYMON004 | g1008313 | BLASTX | 182 | 1e-22 | 57 |
| 4729 | 15209 | 700791582H1 | SOYMON011 | g2388956 | BLASTX | 129 | 1e-10 | 66 |
| 4730 | 15209 | 701001180H1 | SOYMON018 | g1008313 | BLASTX | 122 | 1e-9 | 65 |
| 4731 | 18337 | 700739263H1 | SOYMON012 | g902738 | BLASTN | 481 | 1e-50 | 82 |
| 4732 | 18337 | 700681545H1 | SOYMON008 | g1162979 | BLASTN | 342 | 1e-44 | 83 |
| 4733 | 18818 | 700866167H1 | SOYMON016 | g1162979 | BLASTN | 853 | 1e-62 | 89 |
| 4734 | 18818 | 700983968H1 | SOYMON009 | g1162979 | BLASTN | 422 | 1e-55 | 76 |
| 4735 | 5784 | 700999796H1 | SOYMON018 | g1162979 | BLASTN | 535 | 1e-43 | 78 |
| 4736 | 5784 | 700788240H1 | SOYMON011 | g902738 | BLASTN | 455 | 1e-36 | 77 |
| 4737 | 5784 | 701000905H1 | SOYMON018 | g902738 | BLASTN | 501 | 1e-36 | 77 |
| 4738 | 5784 | 701040171H1 | SOYMON029 | g902738 | BLASTN | 510 | 1e-33 | 78 |
| 4739 | 5784 | 700754807H1 | SOYMON014 | g902738 | BLASTN | 447 | 1e-31 | 72 |
| 4740 | 5784 | 700904930H1 | SOYMON022 | g902738 | BLASTN | 465 | 1e-29 | 77 |
| 4741 | 5784 | 700739828H1 | SOYMON012 | g902738 | BLASTN | 455 | 1e-28 | 76 |
| 4742 | 5784 | 700741008H1 | SOYMON012 | g1162980 | BLASTX | 142 | 1e-16 | 81 |
| 4743 | 5784 | 700738184H1 | SOYMON016 | g1162980 | BLASTX | 167 | 1e-15 | 81 |
| 4744 | 5784 | 700790753H1 | SOYMON011 | g1162980 | BLASTX | 149 | 1e-15 | 79 |
| 4745 | 5784 | 701110183H1 | SOYMON036 | g1162980 | BLASTX | 161 | 1e-15 | 81 |
| 4746 | 5784 | 700876264H1 | SOYMON018 | g1162980 | BLASTX | 140 | 1e-12 | 87 |
| 4747 | 5784 | 700787492H2 | SOYMON011 | g1162980 | BLASTX | 141 | 1e-12 | 76 |
| 4748 | 5784 | 700788242H1 | SOYMON011 | g1162980 | BLASTX | 80 | 1e-11 | 89 |
| 4749 | 5784 | 700741612H1 | SOYMON012 | g1162980 | BLASTX | 103 | 1e-11 | 78 |
| 4750 | 5784 | 700789926H2 | SOYMON011 | g1162980 | BLASTX | 119 | 1e-11 | 74 |
| 4751 | 5784 | 701105542H1 | SOYMON036 | g1162980 | BLASTX | 117 | 1e-10 | 66 |
| 4752 | 5784 | 700741161H1 | SOYMON012 | g1162980 | BLASTX | 101 | 1e-8 | 63 |
| 4753 | 5784 | 700877044H1 | SOYMON018 | g902738 | BLASTN | 236 | 1e-8 | 73 |
| 4754 | 9624 | 700659817H1 | SOYMON004 | g1162979 | BLASTN | 959 | 1e-71 | 85 |
| 4755 | 9624 | 700558457H1 | SOYMON001 | g1162979 | BLASTN | 533 | 1e-64 | 81 |
| 4756 | 9624 | 700898624H1 | SOYMON027 | g1162979 | BLASTN | 867 | 1e-63 | 83 |
| 4757 | 9624 | 700848716H1 | SOYMON021 | g1162979 | BLASTN | 680 | 1e-61 | 83 |
| 4758 | 9624 | 700990488H1 | SOYMON011 | g1162979 | BLASTN | 763 | 1e-54 | 83 |
| 4759 | 9624 | 700980873H1 | SOYMON009 | g1162979 | BLASTN | 722 | 1e-51 | 77 |
| 4760 | 9624 | 700654880H1 | SOYMON004 | g1162979 | BLASTN | 473 | 1e-36 | 71 |
| 4761 | 10469 | LIB3040-057-Q1-E1-C5 | LIB3040 | g1008313 | BLASTX | 205 | 1e-60 | 54 |
| 4762 | 9624 | LIB3030-001-Q1-B1-F10 | LIB3030 | g1162979 | BLASTN | 1185 | 1e-90 | 80 |

TABLE A*-continued

| Seq No. | Cluster ID | CloneID | Library | NCBI gi | Method | Score | P-value | % Ident |
|---|---|---|---|---|---|---|---|---|
| \multicolumn{9}{c}{MAIZE RIBOSE-5-PHOSPHATE ISOMERASE} | | | | | | | | |
| 4763 | 5053 | 700206243H1 | SATMON003 | g1669358 | BLASTX | 165 | 1e−20 | 59 |
| 4764 | 5053 | 700157368H1 | SATMON012 | g1001678 | BLASTX | 188 | 1e−19 | 59 |
| 4765 | -L30672312 | LIB3067-007-Q1-K1-C3 | LIB3067 | g1789280 | BLASTX | 114 | 1e−24 | 54 |
| 4766 | -L841459 | LIB84-028-Q1-E1-A11 | LIB84 | g1789280 | BLASTX | 117 | 1e−25 | 53 |
| 4767 | 5053 | LIB3078-033-Q1-K1-A2 | LIB3078 | g1001678 | BLASTX | 217 | 1e−42 | 50 |
| 4768 | 5053 | LIB3060-054-Q1-K1-G1 | LIB3060 | g2649655 | BLASTX | 100 | 1e−34 | 48 |
| 4769 | 5053 | LIB3078-054-Q1-K1-B9 | LIB3078 | g1669358 | BLASTX | 65 | 1e−24 | 40 |
| \multicolumn{9}{c}{MAIZE PUTATIVE RIBOSE-5-PHOSPHATE ISOMERASE} | | | | | | | | |
| 4770 | -700622640 | 700622640H1 | SATMON034 | g3257798 | BLASTX | 128 | 1e−10 | 63 |
| 4771 | 5053 | 700213140H1 | SATMON016 | g500774 | BLASTX | 195 | 1e−20 | 43 |
| \multicolumn{9}{c}{SOYBEAN RIBOSE-5-PHOSPHATE ISOMERASE} | | | | | | | | |
| 4772 | 17047 | 700737894H1 | SOYMON012 | g1001678 | BLASTX | 93 | 1e−14 | 62 |
| 4773 | 17047 | 700790677H2 | SOYMON011 | g2649655 | BLASTX | 68 | 1e−9 | 47 |
| 4774 | 17047 | 700891079H1 | SOYMON024 | g1001678 | BLASTX | 122 | 1e−9 | 56 |
| 4775 | 8783 | 701120985H1 | SOYMON037 | g1789280 | BLASTX | 115 | 1e−9 | 51 |
| 4776 | 8783 | 700745725H1 | SOYMON013 | g1789280 | BLASTX | 113 | 1e−8 | 51 |
| \multicolumn{9}{c}{SOYBEAN PUTATIVE RIBOSE-5-PHOSPHATE ISOMERASE} | | | | | | | | |
| 4777 | -700840778 | 700840778H1 | SOYMON020 | g500774 | BLASTX | 203 | 1e−21 | 51 |
| 4778 | -700898355 | 700898355H1 | SOYMON027 | g3257798 | BLASTX | 108 | 1e−17 | 60 |
| 4779 | 16333 | 700562390H1 | SOYMON002 | g500774 | BLASTX | 211 | 1e−22 | 44 |
| 4780 | 16333 | 700961206H1 | SOYMON022 | g500774 | BLASTX | 145 | 1e−14 | 51 |
| 4781 | 8873 | 701120413H1 | SOYMON037 | g3257798 | BLASTX | 134 | 1e−11 | 48 |
| \multicolumn{9}{c}{MAIZE RIBOSE-5-PHOSPHATE KINASE} | | | | | | | | |
| 4782 | -700427028 | 700427028H1 | SATMONN01 | g1885326 | BLASTX | 88 | 1e−11 | 60 |
| 4783 | -700441954 | 700441954H1 | SATMON026 | g21840 | BLASTN | 186 | 1e−16 | 72 |
| 4784 | -700448070 | 700448070H1 | SATMON027 | g16440 | BLASTN | 289 | 1e−39 | 75 |
| 4785 | -700581778 | 700581778H1 | SATMON031 | g16441 | BLASTX | 117 | 1e−14 | 76 |
| 4786 | 3680 | 700044442H1 | SATMON004 | g21840 | BLASTN | 1134 | 1e−85 | 89 |
| 4787 | 3680 | 700044434H1 | SATMON004 | g21840 | BLASTN | 1122 | 1e−84 | 89 |
| 4788 | 3680 | 700430775H1 | SATMONN01 | g21840 | BLASTN | 1109 | 1e−83 | 87 |
| 4789 | 3680 | 700043261H1 | SATMON004 | g21840 | BLASTN | 1097 | 1e−82 | 90 |
| 4790 | 3680 | 700101266H1 | SATMON004 | g21840 | BLASTN | 1098 | 1e−82 | 88 |
| 4791 | 3680 | 700440552H1 | SATMON026 | g21840 | BLASTN | 1047 | 1e−78 | 89 |
| 4792 | 3680 | 700430385H1 | SATMONN01 | g21838 | BLASTN | 964 | 1e−71 | 88 |
| 4793 | 3680 | 700441643H1 | SATMON026 | g21840 | BLASTN | 852 | 1e−62 | 84 |
| 4794 | 3680 | 700042294H1 | SATMON004 | g21838 | BLASTN | 842 | 1e−61 | 86 |
| 4795 | 7956 | 700099212H1 | SATMON009 | g21840 | BLASTN | 1192 | 1e−90 | 86 |
| 4796 | 7956 | 700099715H1 | SATMON009 | g21840 | BLASTN | 1066 | 1e−80 | 85 |
| 4797 | 7956 | 700100470H1 | SATMON009 | g21840 | BLASTN | 925 | 1e−68 | 79 |
| 4798 | 7956 | 700438420H1 | SATMON026 | g21840 | BLASTN | 921 | 1e−67 | 84 |
| 4799 | 7956 | 700353611H1 | SATMON024 | g21838 | BLASTN | 812 | 1e−58 | 77 |
| 4800 | 7956 | 700100342H1 | SATMON009 | g21838 | BLASTN | 665 | 1e−46 | 76 |
| 4801 | 7956 | 700043758H1 | SATMON004 | g21840 | BLASTN | 394 | 1e−44 | 74 |
| 4802 | 7956 | 700100269H1 | SATMON009 | g21838 | BLASTN | 510 | 1e−32 | 73 |
| 4803 | 7956 | 700099313H1 | SATMON009 | g21838 | BLASTN | 516 | 1e−32 | 73 |
| 4804 | 7956 | 700097674H1 | SATMON009 | g21839 | BLASTX | 162 | 1e−30 | 76 |
| 4805 | 7956 | 700097907H1 | SATMON009 | g21840 | BLASTN | 455 | 1e−27 | 72 |
| 4806 | 7956 | 700098314H1 | SATMON009 | g21838 | BLASTN | 460 | 1e−27 | 72 |
| 4807 | 7956 | 700098714H1 | SATMON009 | g21840 | BLASTN | 462 | 1e−27 | 72 |
| 4808 | 7956 | 700101077H1 | SATMON009 | g21840 | BLASTN | 417 | 1e−24 | 69 |
| 4809 | 7956 | 700439560H1 | SATMON026 | g21838 | BLASTN | 421 | 1e−24 | 89 |
| 4810 | 7956 | 700094395H1 | SATMON008 | g21840 | BLASTN | 424 | 1e−24 | 70 |
| 4811 | 7956 | 700208768H1 | SATMON016 | g21840 | BLASTN | 424 | 1e−24 | 70 |
| 4812 | 7956 | 700100913H1 | SATMON009 | g21840 | BLASTN | 424 | 1e−24 | 70 |
| 4813 | 7956 | 700042685H1 | SATMON004 | g21840 | BLASTN | 401 | 1e−23 | 75 |
| 4814 | 7956 | 700097183H1 | SATMON009 | g21840 | BLASTN | 407 | 1e−23 | 75 |
| 4815 | 7956 | 700101216H1 | SATMON009 | g21839 | BLASTX | 97 | 1e−15 | 72 |
| 4816 | -L361538 | LIB36-008-Q1-E1-F4 | LIB36 | g21840 | BLASTN | 707 | 1e−48 | 82 |
| 4817 | 3680 | LIB189-012-Q1-E1-H11 | LIB189 | g21840 | BLASTN | 1443 | 1e−130 | 86 |
| 4818 | 3680 | LIB3078-011-Q1-K1-B10 | LIB3078 | g21840 | BLASTN | 1659 | 1e−129 | 88 |
| 4819 | 3680 | LIB3066-004-Q1-K1-D6 | LIB3066 | g21840 | BLASTN | 1648 | 1e−128 | 87 |

TABLE A*-continued

| Seq No. | Cluster ID | CloneID | Library | NCBI gi | Method | Score | P-value | % Ident |
|---|---|---|---|---|---|---|---|---|
| 4820 | 3680 | LIB3060-025-Q1-K1-F6 | LIB3060 | g21840 | BLASTN | 1604 | 1e−127 | 88 |
| 4821 | 3680 | LIB189-006-Q1-E1-A5 | LIB189 | g21840 | BLASTN | 1380 | 1e−106 | 89 |
| 4822 | 3680 | LIB36-001-Q1-E1-G1 | LIB36 | g21840 | BLASTN | 1329 | 1e−101 | 78 |
| 4823 | 3680 | LIB84-013-Q1-E1-B8 | LIB84 | g21840 | BLASTN | 919 | 1e−82 | 85 |
| 4824 | 3680 | LIB36-014-Q1-E1-D8 | LIB36 | g21838 | BLASTN | 870 | 1e−70 | 86 |
| 4825 | 3680 | LIB36-017-Q1-E1-H3 | LIB36 | g21838 | BLASTN | 589 | 1e−43 | 85 |
| 4826 | 7956 | LIB189-029-Q1-E1-D12 | LIB189 | g21840 | BLASTN | 1559 | 1e−121 | 84 |
| 4827 | 7956 | LIB3078-055-Q1-K1-D12 | LIB3078 | g21840 | BLASTN | 1370 | 1e−105 | 82 |
| 4828 | 7956 | LIB36-020-Q1-E1-D1 | LIB36 | g21838 | BLASTN | 908 | 1e−93 | 76 |
| 4829 | 7956 | LIB36-013-Q1-E1-B5 | LIB36 | g21838 | BLASTN | 792 | 1e−83 | 76 |
| 4830 | 7956 | LIB3060-028-Q1-K1-B7 | LIB3060 | g21840 | BLASTN | 470 | 1e−73 | 76 |
| 4831 | 7956 | LIB189-020-Q1-E1-B11 | LIB189 | g21840 | BLASTN | 411 | 1e−45 | 74 |
| 4832 | 7956 | LIB3062-047-Q1-K1-H1 | LIB3062 | g21840 | BLASTN | 419 | 1e−28 | 71 |
| SOYBEAN RIBOSE-5-PHOSPHATE KINASE | | | | | | | | |
| 4833 | -700657358 | 700657358H1 | SOYMON004 | g16441 | BLASTX | 134 | 1e−16 | 95 |
| 4834 | -700790008 | 700790008H2 | SOYMON011 | g1885325 | BLASTN | 725 | 1e−51 | 75 |
| 4835 | -700872439 | 700872439H1 | SOYMON018 | g1885325 | BLASTN | 562 | 1e−38 | 75 |
| 4836 | 4157 | 701055931H1 | SOYMON032 | g1885325 | BLASTN | 1147 | 1e−86 | 91 |
| 4837 | 4157 | 700680979H1 | SOYMON008 | g1885325 | BLASTN | 981 | 1e−84 | 85 |
| 4838 | 4157 | 700990472H1 | SOYMON011 | g1885325 | BLASTN | 1114 | 1e−84 | 88 |
| 4839 | 4157 | 700556547H1 | SOYMON001 | g1885325 | BLASTN | 1079 | 1e−81 | 87 |
| 4840 | 4157 | 700684029H1 | SOYMON008 | g1885325 | BLASTN | 1066 | 1e−80 | 87 |
| 4841 | 4157 | 700684302H1 | SOYMON008 | g1885325 | BLASTN | 1042 | 1e−78 | 89 |
| 4842 | 4157 | 700877162H1 | SOYMON018 | g1885325 | BLASTN | 922 | 1e−76 | 87 |
| 4843 | 4157 | 700875857H1 | SOYMON018 | g1885325 | BLASTN | 1021 | 1e−76 | 90 |
| 4844 | 4157 | 700875895H1 | SOYMON018 | g1885325 | BLASTN | 1027 | 1e−76 | 90 |
| 4845 | 4157 | 700791057H1 | SOYMON011 | g1885325 | BLASTN | 785 | 1e−75 | 89 |
| 4846 | 4157 | 700990257H1 | SOYMON011 | g1885325 | BLASTN | 1003 | 1e−74 | 86 |
| 4847 | 4157 | 700991766H1 | SOYMON011 | g1885325 | BLASTN | 622 | 1e−73 | 86 |
| 4848 | 4157 | 700875789H1 | SOYMON018 | g1885325 | BLASTN | 787 | 1e−71 | 90 |
| 4849 | 4157 | 700791651H1 | SOYMON011 | g1885325 | BLASTN | 949 | 1e−70 | 87 |
| 4850 | 4157 | 701106902H1 | SOYMON036 | g1885325 | BLASTN | 925 | 1e−68 | 85 |
| 4851 | 4157 | 700739192H1 | SOYMON012 | g1885325 | BLASTN | 916 | 1e−67 | 90 |
| 4852 | 4157 | 700681723H1 | SOYMON008 | g1885325 | BLASTN | 902 | 1e−66 | 85 |
| 4853 | 4157 | 700755385H1 | SOYMON014 | g1885325 | BLASTN | 883 | 1e−64 | 84 |
| 4854 | 4157 | 700870864H1 | SOYMON018 | g1885325 | BLASTN | 865 | 1e−63 | 78 |
| 4855 | 4157 | 701107593H1 | SOYMON036 | g1885325 | BLASTN | 872 | 1e−63 | 84 |
| 4856 | 4157 | 701002558H1 | SOYMON018 | g1885325 | BLASTN | 617 | 1e−62 | 84 |
| 4857 | 4157 | 700875430H1 | SOYMON018 | g1885325 | BLASTN | 860 | 1e−62 | 83 |
| 4858 | 4157 | 700654704H1 | SOYMON004 | g1885325 | BLASTN | 535 | 1e−58 | 86 |
| 4859 | 4157 | 701070469H1 | SOYMON034 | g1885325 | BLASTN | 214 | 1e−18 | 92 |
| 4860 | 4157 | 700739393H1 | SOYMON012 | g16441 | BLASTX | 182 | 1e−17 | 94 |
| 4861 | 4157 | 700657046H1 | SOYMON004 | g1885325 | BLASTN | 141 | 1e−10 | 86 |
| 4862 | 6097 | 700984236H1 | SOYMON009 | g1885325 | BLASTN | 1039 | 1e−77 | 87 |
| 4863 | 6097 | 701109839H1 | SOYMON036 | g1885325 | BLASTN | 952 | 1e−70 | 88 |
| 4864 | 6097 | 700731201H1 | SOYMON009 | g1885325 | BLASTN | 885 | 1e−64 | 85 |
| 4865 | 668 | 700959747H1 | SOYMON022 | g1885325 | BLASTN | 414 | 1e−65 | 84 |
| 4866 | 668 | 700994042H1 | SOYMON011 | g1885325 | BLASTN | 863 | 1e−63 | 82 |
| 4867 | 668 | 700899089H1 | SOYMON027 | g1885325 | BLASTN | 849 | 1e−61 | 84 |
| 4868 | 668 | 700787854H2 | SOYMON011 | g167265 | BLASTN | 330 | 1e−47 | 84 |
| 4869 | 668 | 700873392H1 | SOYMON018 | g167265 | BLASTN | 530 | 1e−35 | 85 |
| 4870 | 668 | 700553732H1 | SOYMON001 | g167265 | BLASTN | 483 | 1e−30 | 84 |
| 4871 | 668 | 700560501H1 | SOYMON001 | g167265 | BLASTN | 460 | 1e−27 | 84 |
| 4872 | 668 | 701105881H1 | SOYMON036 | g167265 | BLASTN | 439 | 1e−26 | 84 |
| 4873 | 668 | 700681112H2 | SOYMON008 | g167265 | BLASTN | 395 | 1e−22 | 85 |
| 4874 | 668 | 700997513H1 | SOYMON018 | g167265 | BLASTN | 383 | 1e−21 | 84 |
| 4875 | 668 | 700763831H1 | SOYMON018 | g167266 | BLASTX | 131 | 1e−16 | 84 |
| 4876 | 668 | 701055857H1 | SOYMON032 | g167266 | BLASTX | 163 | 1e−15 | 94 |
| 4877 | 668 | 700559450H1 | SOYMON001 | g167265 | BLASTN | 273 | 1e−15 | 78 |
| 4878 | 668 | 701000176H1 | SOYMON018 | g167266 | BLASTX | 155 | 1e−14 | 93 |
| 4879 | 668 | 700996108H1 | SOYMON018 | g167266 | BLASTX | 158 | 1e−14 | 84 |
| 4880 | 668 | 700791528H1 | SOYMON011 | g167265 | BLASTN | 298 | 1e−14 | 84 |
| 4881 | 668 | 700901050H1 | SOYMON027 | g167265 | BLASTN | 288 | 1e−13 | 83 |

TABLE A*-continued

| Seq No. | Cluster ID | CloneID | Library | NCBI gi | Method | Score | P-value | % Ident |
|---|---|---|---|---|---|---|---|---|
| 4882 | 668 | 700979790H2 | SOYMON009 | g167265 | BLASTN | 288 | 1e-13 | 81 |
| 4883 | 668 | 700877128H1 | SOYMON018 | g167265 | BLASTN | 290 | 1e-13 | 74 |
| 4884 | 668 | 700743001H1 | SOYMON012 | g167266 | BLASTX | 140 | 1e-12 | 78 |
| 4885 | 668 | 700995911H1 | SOYMON018 | g167265 | BLASTN | 197 | 1e-12 | 86 |
| 4886 | 668 | 701106835H1 | SOYMON036 | g167265 | BLASTN | 278 | 1e-12 | 89 |
| 4887 | 668 | 700675621H1 | SOYMON007 | g167265 | BLASTN | 261 | 1e-11 | 75 |
| 4888 | 668 | 701002519H1 | SOYMON018 | g167266 | BLASTX | 125 | 1e-10 | 83 |
| 4889 | 668 | 700686660H1 | SOYMON008 | g167266 | BLASTX | 130 | 1e-10 | 83 |
| 4890 | 668 | 700738677H1 | SOYMON012 | g167265 | BLASTN | 196 | 1e-10 | 89 |
| 4891 | 668 | 700963637H1 | SOYMON022 | g167265 | BLASTN | 196 | 1e-10 | 88 |
| 4892 | 668 | 700791287H1 | SOYMON011 | g167265 | BLASTN | 236 | 1e-10 | 82 |
| 4893 | 668 | 700553943H1 | SOYMON001 | g167265 | BLASTN | 258 | 1e-10 | 83 |
| 4894 | 668 | 700876063H1 | SOYMON018 | g167266 | BLASTX | 116 | 1e-9 | 92 |
| 4895 | 668 | 700555924H1 | SOYMON001 | g167266 | BLASTX | 118 | 1e-9 | 79 |
| 4896 | 668 | 700686037H1 | SOYMON008 | g167265 | BLASTN | 249 | 1e-9 | 81 |
| 4897 | 668 | 700791185H1 | SOYMON011 | g167265 | BLASTN | 249 | 1e-9 | 86 |
| 4898 | 8098 | 700726396H1 | SOYMON009 | g1885325 | BLASTN | 711 | 1e-54 | 87 |
| 4899 | 8098 | 700683768H1 | SOYMON008 | g1885325 | BLASTN | 614 | 1e-45 | 87 |
| 4900 | 8098 | 700741625H1 | SOYMON012 | g1885325 | BLASTN | 479 | 1e-37 | 88 |
| 4901 | 8098 | 700737803H1 | SOYMON012 | g1885325 | BLASTN | 441 | 1e-29 | 86 |
| 4902 | 8098 | 700995703H1 | SOYMON011 | g1885325 | BLASTN | 286 | 1e-14 | 85 |
| 4903 | 4157 | LIB3055-013-Q1-N1-F6 | LIB3055 | g1885325 | BLASTN | 1123 | 1e-131 | 87 |
| 4904 | 4157 | LIB3028-012-Q1-B1-F10 | LIB3028 | g1885325 | BLASTN | 645 | 1e-82 | 81 |
| 4905 | 668 | LIB3039-054-Q1-E1-C11 | LIB3039 | g167265 | BLASTN | 815 | 1e-64 | 80 |
| 4906 | 668 | LIB3055-013-Q1-N1-D11 | LIB3055 | g167265 | BLASTN | 817 | 1e-59 | 83 |
| 4907 | 668 | LIB3055-013-Q1-N1-H7 | LIB3055 | g167265 | BLASTN | 676 | 1e-45 | 79 |
| 4908 | 668 | LIB3055-004-Q1-N1-F5 | LIB3055 | g1885325 | BLASTN | 318 | 1e-36 | 83 |
| MAIZE PHOSPHOENOLPYRUVATE CARBOXYLASE | | | | | | | | |
| 4909 | -700029657 | 700029657H1 | SATMON003 | g22614 | BLASTN | 275 | 1e-13 | 83 |
| 4910 | -700043027 | 700043027H1 | SATMON004 | g22407 | BLASTN | 497 | 1e-38 | 80 |
| 4911 | -700073205 | 700073205H1 | SATMON007 | g3132309 | BLASTN | 1480 | 1e-114 | 100 |
| 4912 | -700073954 | 700073954H1 | SATMON007 | g22614 | BLASTN | 243 | 1e-28 | 79 |
| 4913 | -700075634 | 700075634H1 | SATMON007 | g3132309 | BLASTN | 471 | 1e-75 | 83 |
| 4914 | -700076492 | 700076492H1 | SATMON007 | g429148 | BLASTN | 909 | 1e-109 | 98 |
| 4915 | -700097250 | 700097250H1 | SATMON009 | g22396 | BLASTN | 366 | 1e-21 | 88 |
| 4916 | -700100473 | 700100473H1 | SATMON009 | g22407 | BLASTN | 644 | 1e-63 | 98 |
| 4917 | -700101359 | 700101359H1 | SATMON009 | g22415 | BLASTN | 1530 | 1e-118 | 99 |
| 4918 | -700152625 | 700152625H1 | SATMON007 | g3132309 | BLASTN | 1154 | 1e-87 | 99 |
| 4919 | -700154435 | 700154435H1 | SATMON007 | g3132309 | BLASTN | 761 | 1e-54 | 98 |
| 4920 | -700162895 | 700162895H1 | SATMON013 | g169843 | BLASTN | 438 | 1e-27 | 85 |
| 4921 | -700201740 | 700201740H1 | SATMON003 | g21629 | BLASTN | 498 | 1e-32 | 86 |
| 4922 | -700224677 | 700224677H1 | SATMON011 | g429148 | BLASTN | 729 | 1e-84 | 95 |
| 4923 | -700238706 | 700238706H1 | SATMON010 | g429148 | BLASTN | 1431 | 1e-110 | 99 |
| 4924 | -700257537 | 700257537H1 | SATMON017 | g22409 | BLASTN | 391 | 1e-50 | 91 |
| 4925 | -700331923 | 700331923H1 | SATMON019 | g429148 | BLASTN | 1338 | 1e-102 | 97 |
| 4926 | -700356223 | 700356223H1 | SATMON024 | g21629 | BLASTN | 471 | 1e-79 | 96 |
| 4927 | -700356594 | 700356594H1 | SATMON024 | g21629 | BLASTN | 117 | 1e-8 | 95 |
| 4928 | -700428887 | 700428887H1 | SATMONN01 | g22407 | BLASTN | 303 | 1e-31 | 85 |
| 4929 | -700429388 | 700429388H1 | SATMONN01 | g22468 | BLASTN | 221 | 1e-22 | 89 |
| 4930 | -700441559 | 700441559H1 | SATMON026 | g22396 | BLASTN | 194 | 1e-10 | 90 |
| 4931 | -700552009 | 700552009H1 | SATMON022 | g169843 | BLASTN | 739 | 1e-84 | 94 |
| 4932 | -700578607 | 700578607H1 | SATMON031 | g22390 | BLASTN | 380 | 1e-35 | 99 |
| 4933 | -701169553 | 701169553H1 | SATMONN05 | g18463 | BLASTN | 271 | 1e-13 | 66 |
| 4934 | 10799 | 700074427H1 | SATMON007 | g3132309 | BLASTN | 1458 | 1e-112 | 99 |
| 4935 | 10799 | 700154441H1 | SATMON007 | g3132309 | BLASTN | 1090 | 1e-81 | 100 |
| 4936 | 1418 | 700097963H1 | SATMON009 | g22396 | BLASTN | 1635 | 1e-127 | 100 |
| 4937 | 1418 | 700097754H1 | SATMON009 | g22415 | BLASTN | 1080 | 1e-124 | 100 |
| 4938 | 1418 | 700097792H1 | SATMON009 | g22407 | BLASTN | 1598 | 1e-124 | 99 |
| 4939 | 1418 | 700098551H1 | SATMON009 | g22407 | BLASTN | 1296 | 1e-123 | 97 |
| 4940 | 1418 | 700098302H1 | SATMON009 | g22415 | BLASTN | 1588 | 1e-123 | 99 |
| 4941 | 1418 | 700098121H1 | SATMON009 | g22415 | BLASTN | 1582 | 1e-122 | 99 |
| 4942 | 1418 | 700101619H1 | SATMON009 | g22396 | BLASTN | 1561 | 1e-121 | 99 |
| 4943 | 1418 | 700098581H1 | SATMON009 | g22415 | BLASTN | 1571 | 1e-121 | 98 |
| 4944 | 1418 | 700099632H1 | SATMON009 | g22407 | BLASTN | 1556 | 1e-120 | 99 |
| 4945 | 1418 | 700101969H1 | SATMON009 | g22562 | BLASTN | 1539 | 1e-119 | 99 |
| 4946 | 1418 | 700083104H1 | SATMON011 | g22415 | BLASTN | 1082 | 1e-118 | 97 |
| 4947 | 1418 | 700100275H1 | SATMON009 | g22407 | BLASTN | 1534 | 1e-118 | 99 |
| 4948 | 1418 | 700098816H1 | SATMON009 | g22562 | BLASTN | 926 | 1e-117 | 98 |
| 4949 | 1418 | 700101994H1 | SATMON009 | g22415 | BLASTN | 1512 | 1e-117 | 99 |
| 4950 | 1418 | 700101641H1 | SATMON009 | g22396 | BLASTN | 1515 | 1e-117 | 100 |

TABLE A*-continued

| Seq No. | Cluster ID | CloneID | Library | NCBI gi | Method | Score | P-value | % Ident |
|---|---|---|---|---|---|---|---|---|
| 4951 | 1418 | 700101001H1 | SATMON009 | g22415 | BLASTN | 1500 | 1e−116 | 100 |
| 4952 | 1418 | 700099730H1 | SATMON009 | g22396 | BLASTN | 1500 | 1e−116 | 100 |
| 4953 | 1418 | 700097140H1 | SATMON009 | g22562 | BLASTN | 1506 | 1e−116 | 99 |
| 4954 | 1418 | 700100324H1 | SATMON009 | g22415 | BLASTN | 1260 | 1e−115 | 100 |
| 4955 | 1418 | 700098727H1 | SATMON009 | g22415 | BLASTN | 1487 | 1e−115 | 99 |
| 4956 | 1418 | 700097485H1 | SATMON009 | g22415 | BLASTN | 1496 | 1e−115 | 99 |
| 4957 | 1418 | 700097789H1 | SATMON009 | g22407 | BLASTN | 1479 | 1e−114 | 99 |
| 4958 | 1418 | 700099540H1 | SATMON009 | g22415 | BLASTN | 1485 | 1e−114 | 100 |
| 4959 | 1418 | 700097905H1 | SATMON009 | g22415 | BLASTN | 1224 | 1e−113 | 98 |
| 4960 | 1418 | 700099338H1 | SATMON009 | g22407 | BLASTN | 1248 | 1e−113 | 99 |
| 4961 | 1418 | 700101618H1 | SATMON009 | g22415 | BLASTN | 1395 | 1e−113 | 100 |
| 4962 | 1418 | 700100382H1 | SATMON009 | g22415 | BLASTN | 1465 | 1e−113 | 100 |
| 4963 | 1418 | 700097861H1 | SATMON009 | g22396 | BLASTN | 1473 | 1e−113 | 99 |
| 4964 | 1418 | 700099369H1 | SATMON009 | g22415 | BLASTN | 1457 | 1e−112 | 99 |
| 4965 | 1418 | 700097270H1 | SATMON009 | g22407 | BLASTN | 1383 | 1e−111 | 97 |
| 4966 | 1418 | 700042158H1 | SATMON004 | g22415 | BLASTN | 1440 | 1e−111 | 100 |
| 4967 | 1418 | 700097169H1 | SATMON009 | g22415 | BLASTN | 1427 | 1e−110 | 97 |
| 4968 | 1418 | 700099238H1 | SATMON009 | g22415 | BLASTN | 1428 | 1e−110 | 99 |
| 4969 | 1418 | 700045908H1 | SATMON009 | g22415 | BLASTN | 1424 | 1e−109 | 97 |
| 4970 | 1418 | 700101654H1 | SATMON009 | g22415 | BLASTN | 985 | 1e−108 | 99 |
| 4971 | 1418 | 700041622H1 | SATMON004 | g22415 | BLASTN | 1403 | 1e−108 | 99 |
| 4972 | 1418 | 700099014H1 | SATMON009 | g22415 | BLASTN | 1403 | 1e−108 | 99 |
| 4973 | 1418 | 700045755H1 | SATMON009 | g22415 | BLASTN | 1405 | 1e−108 | 100 |
| 4974 | 1418 | 700097929H1 | SATMON009 | g22415 | BLASTN | 1405 | 1e−108 | 95 |
| 4975 | 1418 | 700101507H1 | SATMON009 | g22415 | BLASTN | 927 | 1e−107 | 98 |
| 4976 | 1418 | 700101139H1 | SATMON009 | g22415 | BLASTN | 1394 | 1e−107 | 97 |
| 4977 | 1418 | 700042011H1 | SATMON004 | g22415 | BLASTN | 1395 | 1e−107 | 100 |
| 4978 | 1418 | 700099449H1 | SATMON009 | g22415 | BLASTN | 1399 | 1e−107 | 98 |
| 4979 | 1418 | 700097495H1 | SATMON009 | g22407 | BLASTN | 1028 | 1e−106 | 99 |
| 4980 | 1418 | 700404862H1 | SATMON026 | g22415 | BLASTN | 1276 | 1e−106 | 99 |
| 4981 | 1418 | 700041640H1 | SATMON004 | g22562 | BLASTN | 1385 | 1e−106 | 100 |
| 4982 | 1418 | 700042815H1 | SATMON004 | g22396 | BLASTN | 1385 | 1e−106 | 100 |
| 4983 | 1418 | 700099760H1 | SATMON009 | g22415 | BLASTN | 751 | 1e−105 | 97 |
| 4984 | 1418 | 700098974H1 | SATMON009 | g22407 | BLASTN | 900 | 1e−105 | 97 |
| 4985 | 1418 | 700046051H1 | SATMON004 | g22396 | BLASTN | 1341 | 1e−105 | 99 |
| 4986 | 1418 | 700098022H1 | SATMON009 | g22415 | BLASTN | 1367 | 1e−105 | 99 |
| 4987 | 1418 | 700044753H1 | SATMON004 | g22407 | BLASTN | 1370 | 1e−105 | 100 |
| 4988 | 1418 | 700044255H1 | SATMON004 | g22415 | BLASTN | 1370 | 1e−105 | 100 |
| 4989 | 1418 | 700043411H1 | SATMON004 | g22396 | BLASTN | 1375 | 1e−105 | 100 |
| 4990 | 1418 | 700046087H1 | SATMON004 | g22415 | BLASTN | 1375 | 1e−105 | 100 |
| 4991 | 1418 | 700041663H1 | SATMON004 | g22407 | BLASTN | 1378 | 1e−105 | 99 |
| 4992 | 1418 | 700099451H1 | SATMON009 | g22415 | BLASTN | 1301 | 1e−104 | 95 |
| 4993 | 1418 | 700043646H1 | SATMON004 | g22407 | BLASTN | 1350 | 1e−103 | 100 |
| 4994 | 1418 | 700045303H1 | SATMON004 | g22415 | BLASTN | 1350 | 1e−103 | 100 |
| 4995 | 1418 | 700223981H1 | SATMON011 | g22407 | BLASTN | 1352 | 1e−103 | 99 |
| 4996 | 1418 | 700043601H1 | SATMON004 | g22396 | BLASTN | 1115 | 1e−102 | 100 |
| 4997 | 1418 | 700043020H1 | SATMON004 | g22415 | BLASTN | 1331 | 1e−102 | 99 |
| 4998 | 1418 | 700046435H1 | SATMON004 | g22415 | BLASTN | 1335 | 1e−102 | 100 |
| 4999 | 1418 | 700100821H1 | SATMON009 | g22415 | BLASTN | 1340 | 1e−102 | 100 |
| 5000 | 1418 | 700044311H1 | SATMON004 | g22396 | BLASTN | 1290 | 1e−101 | 100 |
| 5001 | 1418 | 700042492H1 | SATMON004 | g22415 | BLASTN | 1325 | 1e−101 | 100 |
| 5002 | 1418 | 700045679H1 | SATMON004 | g22562 | BLASTN | 1326 | 1e−101 | 99 |
| 5003 | 1418 | 700043854H1 | SATMON004 | g22396 | BLASTN | 1328 | 1e−101 | 99 |
| 5004 | 1418 | 700097174H1 | SATMON009 | g22407 | BLASTN | 579 | 1e−100 | 97 |
| 5005 | 1418 | 700043617H1 | SATMON004 | g22415 | BLASTN | 1172 | 1e−100 | 98 |
| 5006 | 1418 | 700043213H1 | SATMON004 | g22415 | BLASTN | 1307 | 1e−100 | 99 |
| 5007 | 1418 | 700044283H1 | SATMON004 | g22562 | BLASTN | 1315 | 1e−100 | 100 |
| 5008 | 1418 | 700044758H1 | SATMON004 | g22562 | BLASTN | 1317 | 1e−100 | 99 |
| 5009 | 1418 | 700045971H1 | SATMON004 | g22415 | BLASTN | 1318 | 1e−100 | 99 |
| 5010 | 1418 | 700045753H1 | SATMON004 | g22415 | BLASTN | 1268 | 1e−99 | 95 |
| 5011 | 1418 | 700044982H1 | SATMON004 | g22415 | BLASTN | 1300 | 1e−99 | 100 |
| 5012 | 1418 | 700045990H1 | SATMON004 | g22415 | BLASTN | 1303 | 1e−99 | 99 |
| 5013 | 1418 | 700222578H1 | SATMON011 | g22415 | BLASTN | 1286 | 1e−98 | 97 |
| 5014 | 1418 | 700101090H1 | SATMON009 | g22396 | BLASTN | 1152 | 1e−97 | 99 |
| 5015 | 1418 | 700044587H1 | SATMON004 | g22396 | BLASTN | 1279 | 1e−97 | 99 |
| 5016 | 1418 | 700100745H1 | SATMON009 | g22396 | BLASTN | 1280 | 1e−97 | 100 |
| 5017 | 1418 | 700043547H1 | SATMON004 | g22562 | BLASTN | 1281 | 1e−97 | 95 |
| 5018 | 1418 | 700428356H1 | SATMONN01 | g22407 | BLASTN | 1035 | 1e−96 | 98 |
| 5019 | 1418 | 700219747H1 | SATMON011 | g22562 | BLASTN | 1261 | 1e−96 | 99 |
| 5020 | 1418 | 700045081H1 | SATMON004 | g22396 | BLASTN | 1263 | 1e−96 | 99 |
| 5021 | 1418 | 700101816H1 | SATMON009 | g22396 | BLASTN | 1250 | 1e−95 | 100 |
| 5022 | 1418 | 700042889H1 | SATMON004 | g22562 | BLASTN | 722 | 1e−94 | 98 |
| 5023 | 1418 | 700041694H1 | SATMON004 | g22415 | BLASTN | 831 | 1e−94 | 98 |
| 5024 | 1418 | 700098977H1 | SATMON009 | g22562 | BLASTN | 933 | 1e−94 | 97 |
| 5025 | 1418 | 700423950H1 | SATMONN01 | g22396 | BLASTN | 1187 | 1e−94 | 99 |
| 5026 | 1418 | 700053467H1 | SATMON009 | g22415 | BLASTN | 821 | 1e−92 | 93 |
| 5027 | 1418 | 700042228H1 | SATMON004 | g22415 | BLASTN | 841 | 1e−91 | 98 |

TABLE A*-continued

| Seq No. | Cluster ID | CloneID | Library | NCBI gi | Method | Score | P-value | % Ident |
|---|---|---|---|---|---|---|---|---|
| 5028 | 1418 | 700044924H1 | SATMON004 | g22396 | BLASTN | 1205 | 1e−91 | 100 |
| 5029 | 1418 | 700438595H1 | SATMON026 | g22407 | BLASTN | 620 | 1e−90 | 99 |
| 5030 | 1418 | 700422253H1 | SATMONN01 | g22396 | BLASTN | 781 | 1e−89 | 95 |
| 5031 | 1418 | 700044946H1 | SATMON004 | g22396 | BLASTN | 1170 | 1e−88 | 100 |
| 5032 | 1418 | 700025647H1 | SATMON004 | g22407 | BLASTN | 1128 | 1e−87 | 98 |
| 5033 | 1418 | 700213665H1 | SATMON016 | g22415 | BLASTN | 1161 | 1e−87 | 99 |
| 5034 | 1418 | 700100741H1 | SATMON009 | g22407 | BLASTN | 1137 | 1e−85 | 95 |
| 5035 | 1418 | 700045039H1 | SATMON004 | g22562 | BLASTN | 722 | 1e−84 | 99 |
| 5036 | 1418 | 700042588H1 | SATMON004 | g22396 | BLASTN | 1119 | 1e−84 | 99 |
| 5037 | 1418 | 700209485H1 | SATMON016 | g22415 | BLASTN | 771 | 1e−82 | 95 |
| 5038 | 1418 | 700198048H1 | SATMON016 | g22407 | BLASTN | 812 | 1e−80 | 97 |
| 5039 | 1418 | 700424537H1 | SATMONN01 | g22396 | BLASTN | 1070 | 1e−80 | 87 |
| 5040 | 1418 | 700439340H1 | SATMON026 | g22415 | BLASTN | 725 | 1e−76 | 97 |
| 5041 | 1418 | 700439420H1 | SATMON026 | g22415 | BLASTN | 1017 | 1e−75 | 94 |
| 5042 | 1418 | 700098640H1 | SATMON009 | g22562 | BLASTN | 991 | 1e−73 | 99 |
| 5043 | 1418 | 700427059H1 | SATMONN01 | g22396 | BLASTN | 523 | 1e−69 | 92 |
| 5044 | 1418 | 700099478H1 | SATMON009 | g22415 | BLASTN | 721 | 1e−69 | 100 |
| 5045 | 1418 | 700425005H1 | SATMONN01 | g22415 | BLASTN | 939 | 1e−69 | 97 |
| 5046 | 1418 | 700101925H1 | SATMON009 | g22562 | BLASTN | 878 | 1e−64 | 99 |
| 5047 | 1418 | 700099430H1 | SATMON009 | g22415 | BLASTN | 824 | 1e−59 | 98 |
| 5048 | 1418 | 700429358H1 | SATMONN01 | g22407 | BLASTN | 548 | 1e−57 | 98 |
| 5049 | 1418 | 700447220H1 | SATMON027 | g22562 | BLASTN | 799 | 1e−57 | 98 |
| 5050 | 1418 | 700100706H1 | SATMON009 | g22407 | BLASTN | 770 | 1e−55 | 100 |
| 5051 | 1418 | 700209112H1 | SATMON016 | g22415 | BLASTN | 593 | 1e−54 | 98 |
| 5052 | 1418 | 700098367H1 | SATMON009 | g22415 | BLASTN | 698 | 1e−49 | 99 |
| 5053 | 1418 | 700045489H1 | SATMON004 | g22407 | BLASTN | 642 | 1e−44 | 92 |
| 5054 | 1418 | 700043353H1 | SATMON004 | g22396 | BLASTN | 645 | 1e−44 | 100 |
| 5055 | 1418 | 700097654H1 | SATMON009 | g22407 | BLASTN | 618 | 1e−42 | 99 |
| 5056 | 1418 | 700423550H1 | SATMONN01 | g22396 | BLASTN | 599 | 1e−41 | 88 |
| 5057 | 1418 | 700439981H1 | SATMON026 | g22407 | BLASTN | 590 | 1e−40 | 96 |
| 5058 | 1418 | 700097894H1 | SATMON009 | g22407 | BLASTN | 570 | 1e−38 | 100 |
| 5059 | 1418 | 700423563H1 | SATMONN01 | g22407 | BLASTN | 516 | 1e−34 | 99 |
| 5060 | 1418 | 700213765H1 | SATMON016 | g22407 | BLASTN | 484 | 1e−31 | 97 |
| 5061 | 1418 | 700043914H1 | SATMON004 | g22407 | BLASTN | 261 | 1e−26 | 93 |
| 5062 | 1418 | 700434554H1 | SATMONN01 | g22396 | BLASTN | 397 | 1e−24 | 87 |
| 5063 | 1418 | 700088748H1 | SATMON011 | g22396 | BLASTN | 292 | 1e−15 | 89 |
| 5064 | 1418 | 700097692H1 | SATMON009 | g22396 | BLASTN | 255 | 1e−13 | 98 |
| 5065 | 16592 | 700098887H1 | SATMON009 | g22415 | BLASTN | 1526 | 1e−118 | 99 |
| 5066 | 16592 | 700101171H1 | SATMON009 | g22415 | BLASTN | 1481 | 1e−114 | 99 |
| 5067 | 16592 | 700098335H1 | SATMON009 | g22415 | BLASTN | 1455 | 1e−112 | 100 |
| 5068 | 16592 | 700101419H1 | SATMON009 | g22415 | BLASTN | 1450 | 1e−111 | 100 |
| 5069 | 16592 | 700098187H1 | SATMON009 | g22562 | BLASTN | 877 | 1e−110 | 98 |
| 5070 | 16592 | 700099874H1 | SATMON009 | g22562 | BLASTN | 1427 | 1e−109 | 97 |
| 5071 | 16592 | 700098983H1 | SATMON009 | g22415 | BLASTN | 1355 | 1e−104 | 98 |
| 5072 | 16592 | 700045302H1 | SATMON004 | g22412 | BLASTN | 704 | 1e−99 | 96 |
| 5073 | 16592 | 700218247H1 | SATMON016 | g22412 | BLASTN | 710 | 1e−99 | 98 |
| 5074 | 16592 | 700100826H1 | SATMON009 | g22412 | BLASTN | 710 | 1e−98 | 97 |
| 5075 | 16592 | 700098774H1 | SATMON009 | g22562 | BLASTN | 1190 | 1e−97 | 93 |
| 5076 | 16592 | 700101312H1 | SATMON009 | g22562 | BLASTN | 1210 | 1e−96 | 91 |
| 5077 | 16592 | 700053403H1 | SATMON009 | g22415 | BLASTN | 1260 | 1e−96 | 94 |
| 5078 | 16592 | 700045034H1 | SATMON009 | g22562 | BLASTN | 1189 | 1e−90 | 99 |
| 5079 | 16592 | 700097293H1 | SATMON009 | g22412 | BLASTN | 667 | 1e−86 | 92 |
| 5080 | 17901 | 700578474H1 | SATMON031 | g22415 | BLASTN | 979 | 1e−72 | 98 |
| 5081 | 17901 | 700578374H1 | SATMON031 | g22415 | BLASTN | 491 | 1e−63 | 98 |
| 5082 | 1943 | 700549932H1 | SATMON022 | g429148 | BLASTN | 914 | 1e−67 | 80 |
| 5083 | 1943 | 700020030H1 | SATMON001 | g429148 | BLASTN | 686 | 1e−48 | 79 |
| 5084 | 19736 | 700264360H1 | SATMON017 | g429148 | BLASTN | 1519 | 1e−117 | 98 |
| 5085 | 19736 | 700238856H1 | SATMON010 | g429148 | BLASTN | 754 | 1e−102 | 99 |
| 5086 | 201 | 700074903H1 | SATMON007 | g3132309 | BLASTN | 820 | 1e−119 | 100 |
| 5087 | 201 | 700620292H1 | SATMON034 | g3132309 | BLASTN | 940 | 1e−113 | 100 |
| 5088 | 201 | 700616392H1 | SATMON033 | g3132309 | BLASTN | 1008 | 1e−107 | 99 |
| 5089 | 201 | 700049716H1 | SATMON003 | g3132309 | BLASTN | 1018 | 1e−107 | 99 |
| 5090 | 201 | 700028563H1 | SATMON003 | g3132309 | BLASTN | 1361 | 1e−104 | 99 |
| 5091 | 201 | 700105527H1 | SATMON010 | g3132309 | BLASTN | 1319 | 1e−100 | 99 |
| 5092 | 201 | 700615230H1 | SATMON033 | g3132309 | BLASTN | 955 | 1e−99 | 99 |
| 5093 | 201 | 700550579H1 | SATMON022 | g3132309 | BLASTN | 737 | 1e−98 | 99 |
| 5094 | 201 | 700381592H1 | SATMON023 | g3132309 | BLASTN | 974 | 1e−97 | 92 |
| 5095 | 201 | 701186231H1 | SATMONN06 | g3132309 | BLASTN | 918 | 1e−96 | 97 |
| 5096 | 201 | 700572736H1 | SATMON030 | g3132309 | BLASTN | 963 | 1e−96 | 96 |
| 5097 | 201 | 700158658H1 | SATMON012 | g3132309 | BLASTN | 936 | 1e−93 | 99 |
| 5098 | 201 | 701186212H1 | SATMONN06 | g3132309 | BLASTN | 971 | 1e−92 | 98 |
| 5099 | 201 | 700616621H1 | SATMON033 | g3132309 | BLASTN | 780 | 1e−87 | 92 |
| 5100 | 201 | 701161255H1 | SATMONN04 | g3132309 | BLASTN | 856 | 1e−87 | 98 |
| 5101 | 201 | 700222259H1 | SATMON011 | g3132309 | BLASTN | 1148 | 1e−86 | 92 |
| 5102 | 201 | 701161671H1 | SATMONN04 | g3132309 | BLASTN | 886 | 1e−81 | 98 |
| 5103 | 201 | 700028609H1 | SATMON003 | g21629 | BLASTN | 525 | 1e−75 | 92 |
| 5104 | 201 | 700570011H1 | SATMON030 | g3132309 | BLASTN | 696 | 1e−75 | 98 |

TABLE A*-continued

| Seq No. | Cluster ID | CloneID | Library | NCBI gi | Method | Score | P-value | % Ident |
|---|---|---|---|---|---|---|---|---|
| 5105 | 201 | 700467579H1 | SATMON025 | g3132309 | BLASTN | 901 | 1e-70 | 96 |
| 5106 | 201 | 700020751H1 | SATMON001 | g3132309 | BLASTN | 489 | 1e-44 | 89 |
| 5107 | 201 | 700612494H1 | SATMON033 | g3132309 | BLASTN | 341 | 1e-28 | 97 |
| 5108 | 20363 | 700028168H1 | SATMON003 | g429148 | BLASTN | 891 | 1e-109 | 98 |
| 5109 | 20363 | 700150081H1 | SATMON007 | g429148 | BLASTN | 660 | 1e-75 | 99 |
| 5110 | 21797 | 700104081H1 | SATMON010 | g22468 | BLASTN | 1240 | 1e-96 | 100 |
| 5111 | 21797 | 700258244H1 | SATMON017 | g3132309 | BLASTN | 1115 | 1e-84 | 100 |
| 5112 | 21797 | 700206542H1 | SATMON003 | g22468 | BLASTN | 1000 | 1e-76 | 100 |
| 5113 | 22719 | 700238111H1 | SATMON010 | g3132309 | BLASTN | 1286 | 1e-105 | 98 |
| 5114 | 22719 | 700804782H1 | SATMON036 | g3132309 | BLASTN | 725 | 1e-90 | 100 |
| 5115 | 23787 | 700050530H1 | SATMON003 | g169843 | BLASTN | 1266 | 1e-96 | 92 |
| 5116 | 23787 | 701180159H1 | SATMONN05 | g169843 | BLASTN | 1108 | 1e-83 | 92 |
| 5117 | 2554 | 700160214H1 | SATMON012 | g429148 | BLASTN | 1310 | 1e-100 | 100 |
| 5118 | 2554 | 700553034H1 | SATMON022 | g429148 | BLASTN | 1111 | 1e-83 | 99 |
| 5119 | 2554 | 700168584H1 | SATMON013 | g429148 | BLASTN | 1075 | 1e-80 | 100 |
| 5120 | 2594 | 700257383H1 | SATMON017 | g3132309 | BLASTN | 469 | 1e-51 | 91 |
| 5121 | 2594 | 700263133H1 | SATMON017 | g3132309 | BLASTN | 545 | 1e-42 | 97 |
| 5122 | 2724 | 700213133H1 | SATMON016 | g429148 | BLASTN | 1190 | 1e-106 | 98 |
| 5123 | 2724 | 700087946H1 | SATMON011 | g429148 | BLASTN | 1103 | 1e-83 | 99 |
| 5124 | 30586 | 700170629H1 | SATMON013 | g169843 | BLASTN | 880 | 1e-64 | 88 |
| 5125 | 3591 | 700451602H1 | SATMON028 | g429148 | BLASTN | 730 | 1e-102 | 99 |
| 5126 | 3591 | 700243536H1 | SATMON010 | g429148 | BLASTN | 926 | 1e-90 | 99 |
| 5127 | 3591 | 700104327H1 | SATMON010 | g429148 | BLASTN | 1038 | 1e-77 | 97 |
| 5128 | 3591 | 701160410H1 | SATMONN04 | g429148 | BLASTN | 568 | 1e-65 | 85 |
| 5129 | 4329 | 700051281H1 | SATMON003 | g3132309 | BLASTN | 1520 | 1e-117 | 100 |
| 5130 | 4329 | 700075340H1 | SATMON007 | g3132309 | BLASTN | 1490 | 1e-115 | 100 |
| 5131 | 4329 | 700259374H1 | SATMON017 | g3132309 | BLASTN | 1451 | 1e-111 | 99 |
| 5132 | 4329 | 700026464H1 | SATMON003 | g3132309 | BLASTN | 1405 | 1e-108 | 100 |
| 5133 | 4329 | 700075594H1 | SATMON007 | g3132309 | BLASTN | 1395 | 1e-107 | 100 |
| 5134 | 4329 | 700074584H1 | SATMON007 | g3132309 | BLASTN | 1397 | 1e-107 | 97 |
| 5135 | 4329 | 700211639H1 | SATMON016 | g3132309 | BLASTN | 1310 | 1e-100 | 95 |
| 5136 | 4329 | 700477352H1 | SATMON025 | g3132309 | BLASTN | 685 | 1e-98 | 99 |
| 5137 | 4329 | 700212885H1 | SATMON016 | g3132309 | BLASTN | 1262 | 1e-96 | 97 |
| 5138 | 4329 | 700150132H1 | SATMON007 | g3132309 | BLASTN | 1193 | 1e-90 | 99 |
| 5139 | 4329 | 700150124H1 | SATMON007 | g3132309 | BLASTN | 1175 | 1e-89 | 100 |
| 5140 | 4329 | 700382807H1 | SATMON024 | g3132309 | BLASTN | 785 | 1e-87 | 98 |
| 5141 | 4329 | 700219884H1 | SATMON011 | g3132309 | BLASTN | 905 | 1e-81 | 98 |
| 5142 | 4329 | 700203986H1 | SATMON003 | g3132309 | BLASTN | 1078 | 1e-80 | 99 |
| 5143 | 4329 | 700155306H1 | SATMON013 | g21629 | BLASTN | 838 | 1e-60 | 92 |
| 5144 | 4329 | 700474781H1 | SATMON025 | g3132309 | BLASTN | 353 | 1e-39 | 94 |
| 5145 | 4530 | 700574802H1 | SATMON030 | g429148 | BLASTN | 1236 | 1e-113 | 98 |
| 5146 | 4530 | 700049340H1 | SATMON003 | g429148 | BLASTN | 1185 | 1e-110 | 100 |
| 5147 | 4530 | 701180032H1 | SATMONN05 | g429148 | BLASTN | 954 | 1e-95 | 99 |
| 5148 | 4530 | 700611642H1 | SATMON022 | g429148 | BLASTN | 1059 | 1e-84 | 94 |
| 5149 | 4530 | 700203138H1 | SATMON003 | g429148 | BLASTN | 883 | 1e-71 | 96 |
| 5150 | 4530 | 700029976H1 | SATMON003 | g429148 | BLASTN | 805 | 1e-68 | 97 |
| 5151 | 7486 | 700614328H1 | SATMON033 | g169843 | BLASTN | 1437 | 1e-110 | 96 |
| 5152 | 7486 | 700352909H1 | SATMON024 | g169843 | BLASTN | 1035 | 1e-77 | 96 |
| 5153 | 8267 | 700073585H1 | SATMON007 | g429148 | BLASTN | 1395 | 1e-107 | 100 |
| 5154 | 8267 | 700023118H1 | SATMON003 | g429148 | BLASTN | 1266 | 1e-96 | 99 |
| 5155 | 8267 | 700456524H1 | SATMON029 | g429148 | BLASTN | 743 | 1e-92 | 95 |
| 5156 | 8267 | 700030070H1 | SATMON003 | g429148 | BLASTN | 890 | 1e-70 | 95 |
| 5157 | 8340 | 700077313H1 | SATMON007 | g3132309 | BLASTN | 1575 | 1e-122 | 100 |
| 5158 | 8340 | 700381893H1 | SATMON023 | g21629 | BLASTN | 1329 | 1e-101 | 96 |
| 5159 | 8340 | 700574357H2 | SATMON030 | g3132309 | BLASTN | 1040 | 1e-100 | 100 |
| 5160 | 8340 | 700548421H1 | SATMON022 | g3132309 | BLASTN | 1217 | 1e-99 | 94 |
| 5161 | 8340 | 700029043H1 | SATMON003 | g3132309 | BLASTN | 1273 | 1e-97 | 99 |
| 5162 | 8340 | 700553323H1 | SATMON022 | g3132309 | BLASTN | 1276 | 1e-97 | 99 |
| 5163 | 8340 | 700167824H1 | SATMON013 | g3132309 | BLASTN | 1190 | 1e-90 | 100 |
| 5164 | 8340 | 700153945H1 | SATMON007 | g3132309 | BLASTN | 1113 | 1e-83 | 99 |
| 5165 | 8340 | 700615517H1 | SATMON033 | g3132309 | BLASTN | 874 | 1e-76 | 96 |
| 5166 | 8340 | 700265822H1 | SATMON017 | g3132309 | BLASTN | 755 | 1e-54 | 100 |
| 5167 | 9226 | 700223020H1 | SATMON011 | g169843 | BLASTN | 1098 | 1e-82 | 92 |
| 5168 | 9226 | 700613182H1 | SATMON033 | g169843 | BLASTN | 936 | 1e-76 | 91 |
| 5169 | -L1437153 | LIB143-036-Q1-E1-D6 | LIB143 | g18463 | BLASTN | 262 | 1e-12 | 66 |
| 5170 | -L1482958 | LIB148-011-Q1-E1-D6 | LIB148 | g18463 | BLASTN | 211 | 1e-8 | 72 |
| 5171 | -L1893647 | LIB189-031-Q1-E1-H12 | LIB189 | g22407 | BLASTN | 888 | 1e-76 | 81 |
| 5172 | -L30596200 | LIB3059-060-Q1-K1-G6 | LIB3059 | g169843 | BLASTN | 276 | 1e-11 | 76 |
| 5173 | -L30602129 | LIB3060-009-Q1-K1-C3 | LIB3060 | g22415 | BLASTN | 369 | 1e-70 | 91 |
| 5174 | -L30602452 | LIB3060-011-Q1-K1-F9 | LIB3060 | g22396 | BLASTN | 198 | 1e-15 | 82 |

TABLE A*-continued

| Seq No. | Cluster ID | CloneID | Library | NCBI gi | Method | Score | P-value | % Ident |
|---|---|---|---|---|---|---|---|---|
| 5175 | -L30603203 | LIB3060-029-Q1-K1-A8 | LIB3060 | g22407 | BLASTN | 1486 | 1e-114 | 83 |
| 5176 | -L30604116 | LIB3060-040-Q1-K1-D7 | LIB3060 | g18463 | BLASTN | 260 | 1e-12 | 64 |
| 5177 | -L30604857 | LIB3060-020-Q1-K1-G9 | LIB3060 | g22407 | BLASTN | 459 | 1e-40 | 86 |
| 5178 | -L30606181 | LIB3060-019-Q1-K1-B5 | LIB3060 | g22407 | BLASTN | 254 | 1e-38 | 69 |
| 5179 | -L30684867 | LIB3068-040-Q1-K1-A3 | LIB3068 | g18463 | BLASTN | 216 | 1e-9 | 69 |
| 5180 | -L30684926 | LIB3068-040-Q1-K1-H6 | LIB3068 | g18463 | BLASTN | 264 | 1e-11 | 64 |
| 5181 | -L30686577 | LIB3068-010-Q1-K1-E2 | LIB3068 | g18463 | BLASTN | 209 | 1e-8 | 71 |
| 5182 | -L30695246 | LIB3069-036-Q1-K1-G3 | LIB3069 | g169843 | BLASTN | 257 | 1e-10 | 79 |
| 5183 | -L30695363 | LIB3069-035-Q1-K1-D7 | LIB3069 | g429148 | BLASTN | 371 | 1e-35 | 91 |
| 5184 | -L30782259 | LIB3078-007-Q1-K1-E3 | LIB3078 | g22415 | BLASTN | 548 | 1e-46 | 72 |
| 5185 | -L30783285 | LIB3078-051-Q1-K1-F1 | LIB3078 | g22415 | BLASTN | 941 | 1e-84 | 78 |
| 5186 | -L361508 | LIB36-008-Q1-E1-B4 | LIB36 | g22415 | BLASTN | 825 | 1e-59 | 90 |
| 5187 | -L362677 | LIB36-007-Q1-E1-G11 | LIB36 | g22614 | BLASTN | 235 | 1e-8 | 77 |
| 5188 | -L841179 | LIB84-013-Q1-E1-A10 | LIB84 | g22415 | BLASTN | 594 | 1e-40 | 81 |
| 5189 | -L841868 | LIB84-029-Q1-E1-F12 | LIB84 | g18463 | BLASTN | 237 | 1e-10 | 66 |
| 5190 | 1418 | LIB36-002-Q1-E1-G4 | LIB36 | g22562 | BLASTN | 2116 | 1e-177 | 99 |
| 5191 | 1418 | LIB36-002-Q1-E1-E9 | LIB36 | g22562 | BLASTN | 2184 | 1e-173 | 98 |
| 5192 | 1418 | LIB36-002-Q1-E1-D11 | LIB36 | g22415 | BLASTN | 2175 | 1e-172 | 98 |
| 5193 | 1418 | LIB3060-035-Q1-K1-E11 | LIB3060 | g22415 | BLASTN | 2143 | 1e-169 | 98 |
| 5194 | 1418 | LIB3060-003-Q1-K1-E12 | LIB3060 | g22407 | BLASTN | 2003 | 1e-168 | 98 |
| 5195 | 1418 | LIB3060-012-Q1-K1-F9 | LIB3060 | g22407 | BLASTN | 2127 | 1e-168 | 98 |
| 5196 | 1418 | LIB36-009-Q1-E1-D9 | LIB36 | g22396 | BLASTN | 2133 | 1e-168 | 99 |
| 5197 | 1418 | LIB3078-014-Q1-K1-G9 | LIB3078 | g22415 | BLASTN | 2117 | 1e-167 | 99 |
| 5198 | 1418 | LIB36-003-Q1-E1-G4 | LIB36 | g22396 | BLASTN | 2107 | 1e-166 | 98 |
| 5199 | 1418 | LIB3060-016-Q1-K1-A6 | LIB3060 | g22407 | BLASTN | 2096 | 1e-165 | 99 |
| 5200 | 1418 | LIB3060-021-Q1-K1-E1 | LIB3060 | g22415 | BLASTN | 1532 | 1e-164 | 97 |
| 5201 | 1418 | LIB36-013-Q1-E1-A10 | LIB36 | g22415 | BLASTN | 2067 | 1e-163 | 98 |
| 5202 | 1418 | LIB36-012-Q1-E1-E3 | LIB36 | g22415 | BLASTN | 1865 | 1e-161 | 97 |
| 5203 | 1418 | LIB36-003-Q1-E1-B9 | LIB36 | g22415 | BLASTN | 2048 | 1e-161 | 97 |
| 5204 | 1418 | LIB3078-015-Q1-K1-F11 | LIB3078 | g22396 | BLASTN | 2005 | 1e-158 | 99 |
| 5205 | 1418 | LIB189-024-Q1-E1-A11 | LIB189 | g22396 | BLASTN | 2007 | 1e-158 | 99 |
| 5206 | 1418 | LIB36-002-Q1-E1-C1 | LIB36 | g22415 | BLASTN | 2013 | 1e-158 | 92 |
| 5207 | 1418 | LIB3078-056-Q1-K1-B2 | LIB3078 | g22562 | BLASTN | 1612 | 1e-157 | 90 |
| 5208 | 1418 | LIB3060-048-Q1-K1-A9 | LIB3060 | g22415 | BLASTN | 1824 | 1e-156 | 92 |
| 5209 | 1418 | LIB189-011-Q1-E1-F6 | LIB189 | g22415 | BLASTN | 1849 | 1e-156 | 96 |
| 5210 | 1418 | LIB3060-054-Q1-K1-E7 | LIB3060 | g22415 | BLASTN | 1912 | 1e-156 | 96 |
| 5211 | 1418 | LIB3078-016-Q1-K1-C2 | LIB3078 | g22562 | BLASTN | 1960 | 1e-156 | 99 |
| 5212 | 1418 | LIB3060-009-Q1-K1-C11 | LIB3060 | g22562 | BLASTN | 1626 | 1e-155 | 94 |

TABLE A*-continued

| Seq No. | Cluster ID | CloneID | Library | NCBI gi | Method | Score | P-value | % Ident |
|---|---|---|---|---|---|---|---|---|
| 5213 | 1418 | LIB36-003-Q1-E1-F7 | LIB36 | g22562 | BLASTN | 1841 | 1e-154 | 97 |
| 5214 | 1418 | LIB3060-045-Q1-K1-B2 | LIB3060 | g22407 | BLASTN | 1353 | 1e-153 | 95 |
| 5215 | 1418 | LIB3060-052-Q1-K1-B6 | LIB3060 | g22407 | BLASTN | 1041 | 1e-152 | 95 |
| 5216 | 1418 | LIB36-018-Q1-E1-D4 | LIB36 | g22415 | BLASTN | 1637 | 1e-152 | 92 |
| 5217 | 1418 | LIB189-024-Q1-E1-E3 | LIB189 | g22396 | BLASTN | 1939 | 1e-152 | 93 |
| 5218 | 1418 | LIB36-010-Q1-E1-H4 | LIB36 | g22396 | BLASTN | 1004 | 1e-151 | 94 |
| 5219 | 1418 | LIB3060-012-Q1-K1-B10 | LIB3060 | g22415 | BLASTN | 1532 | 1e-150 | 90 |
| 5220 | 1418 | LIB3060-019-Q1-K1-G7 | LIB3060 | g22415 | BLASTN | 1919 | 1e-150 | 97 |
| 5221 | 1418 | LIB36-022-Q1-E1-E7 | LIB36 | g22562 | BLASTN | 1851 | 1e-149 | 95 |
| 5222 | 1418 | LIB3060-021-Q1-K1-C2 | LIB3060 | g22562 | BLASTN | 869 | 1e-147 | 94 |
| 5223 | 1418 | LIB3060-053-Q1-K1-D6 | LIB3060 | g22415 | BLASTN | 1578 | 1e-145 | 93 |
| 5224 | 1418 | LIB189-006-Q1-E1-D4 | LIB189 | g22415 | BLASTN | 1682 | 1e-145 | 99 |
| 5225 | 1418 | LIB3060-011-Q1-K1-A5 | LIB3060 | g22415 | BLASTN | 1712 | 1e-144 | 96 |
| 5226 | 1418 | LIB189-022-Q1-E1-H8 | LIB189 | g22562 | BLASTN | 1774 | 1e-144 | 96 |
| 5227 | 1418 | LIB3061-017-Q1-K1-E11 | LIB3061 | g22562 | BLASTN | 1533 | 1e-142 | 93 |
| 5228 | 1418 | LIB83-002-Q1-E1-E1 | LIB83 | g22415 | BLASTN | 1122 | 1e-140 | 95 |
| 5229 | 1418 | LIB3060-020-Q1-K1-C10 | LIB3060 | g22415 | BLASTN | 1542 | 1e-139 | 93 |
| 5230 | 1418 | LIB3060-041-Q1-K1-G7 | LIB3060 | g22407 | BLASTN | 1602 | 1e-136 | 98 |
| 5231 | 1418 | LIB189-016-Q1-E1-C1 | LIB189 | g22562 | BLASTN | 1318 | 1e-135 | 95 |
| 5232 | 1418 | LIB189-031-Q1-E1-H11 | LIB189 | g22415 | BLASTN | 1613 | 1e-134 | 95 |
| 5233 | 1418 | LIB189-028-Q1-E1-B6 | LIB189 | g22562 | BLASTN | 1600 | 1e-130 | 100 |
| 5234 | 1418 | LIB36-019-Q1-E1-A5 | LIB36 | g22415 | BLASTN | 1245 | 1e-129 | 96 |
| 5235 | 1418 | LIB3060-023-Q1-K1-G11 | LIB3060 | g22415 | BLASTN | 1650 | 1e-128 | 81 |
| 5236 | 1418 | LIB36-018-Q1-E1-A4 | LIB36 | g22396 | BLASTN | 1228 | 1e-127 | 96 |
| 5237 | 1418 | LIB3060-008-Q1-K1-B10 | LIB3060 | g22396 | BLASTN | 1570 | 1e-126 | 99 |
| 5238 | 1418 | LIB83-009-Q1-E1-A11 | LIB83 | g22562 | BLASTN | 1421 | 1e-123 | 98 |
| 5239 | 1418 | LIB189-002-Q1-E1-B7 | LIB189 | g22562 | BLASTN | 1477 | 1e-122 | 99 |
| 5240 | 1418 | LIB3060-045-Q1-K1-B1 | LIB3060 | g22562 | BLASTN | 1078 | 1e-121 | 90 |
| 5241 | 1418 | LIB36-007-Q1-E1-A11 | LIB36 | g22415 | BLASTN | 1536 | 1e-119 | 98 |
| 5242 | 1418 | LIB36-006-Q1-E1-D3 | LIB36 | g22407 | BLASTN | 1304 | 1e-117 | 97 |
| 5243 | 1418 | LIB36-002-Q1-E1-E7 | LIB36 | g22396 | BLASTN | 1505 | 1e-116 | 94 |
| 5244 | 1418 | LIB36-012-Q1-E1-F6 | LIB36 | g22396 | BLASTN | 1241 | 1e-113 | 97 |
| 5245 | 1418 | LIB189-032-Q1-E1-E4 | LIB189 | g22407 | BLASTN | 803 | 1e-106 | 92 |
| 5246 | 1418 | LIB36-018-Q1-E1-H1 | LIB36 | g22396 | BLASTN | 916 | 1e-104 | 92 |
| 5247 | 1418 | LIB3078-023-Q1-K1-H1 | LIB3078 | g22396 | BLASTN | 1052 | 1e-96 | 84 |
| 5248 | 1418 | LIB3060-019-Q1-K1-E7 | LIB3060 | g22415 | BLASTN | 1109 | 1e-96 | 88 |
| 5249 | 1418 | LIB3060-042-Q1-K1-E5 | LIB3060 | g22407 | BLASTN | 1236 | 1e-94 | 94 |
| 5250 | 1418 | LIB3060-019-Q1-K1-B3 | LIB3060 | g22415 | BLASTN | 978 | 1e-92 | 75 |

TABLE A*-continued

| Seq No. | Cluster ID | CloneID | Library | NCBI gi | Method | Score | P-value | % Ident |
|---|---|---|---|---|---|---|---|---|
| 5251 | 1418 | LIB36-009-Q1-E1-D2 | LIB36 | g22396 | BLASTN | 1128 | 1e-90 | 98 |
| 5252 | 1418 | LIB189-009-Q1-E1-G7 | LIB189 | g22407 | BLASTN | 1107 | 1e-89 | 96 |
| 5253 | 1418 | LIB83-007-Q1-E1-G12 | LIB83 | g22396 | BLASTN | 1151 | 1e-86 | 99 |
| 5254 | 1418 | LIB36-007-Q1-E1-G7 | LIB36 | g22396 | BLASTN | 1136 | 1e-85 | 99 |
| 5255 | 1418 | LIB3060-004-Q1-K1-C8 | LIB3060 | g22415 | BLASTN | 521 | 1e-82 | 92 |
| 5256 | 1418 | LIB3060-026-Q1-K1-C11 | LIB3060 | g22407 | BLASTN | 339 | 1e-76 | 81 |
| 5257 | 1418 | LIB3060-022-Q1-K1-G9 | LIB3060 | g22407 | BLASTN | 845 | 1e-72 | 88 |
| 5258 | 1418 | LIB189-029-Q1-E1-C4 | LIB189 | g22407 | BLASTN | 611 | 1e-67 | 93 |
| 5259 | 1418 | LIB3060-019-Q1-K1-E3 | LIB3060 | g22407 | BLASTN | 389 | 1e-66 | 87 |
| 5260 | 1418 | LIB36-004-Q1-E1-E2 | LIB36 | g22407 | BLASTN | 649 | 1e-62 | 83 |
| 5261 | 1418 | LIB83-005-Q1-E1-A6 | LIB83 | g22396 | BLASTN | 656 | 1e-45 | 99 |
| 5262 | 1418 | LIB84-026-Q1-E1-F1 | LIB84 | g22407 | BLASTN | 337 | 1e-43 | 89 |
| 5263 | 1418 | LIB84-014-Q1-E1-A8 | LIB84 | g22396 | BLASTN | 435 | 1e-27 | 100 |
| 5264 | 1418 | LIB36-021-Q1-E1-H5 | LIB36 | g22396 | BLASTN | 346 | 1e-19 | 99 |
| 5265 | 16592 | LIB3060-041-Q1-K1-A12 | LIB3060 | g22415 | BLASTN | 1550 | 1e-173 | 99 |
| 5266 | 16592 | LIB3060-007-Q1-K1-C8 | LIB3060 | g22562 | BLASTN | 2092 | 1e-165 | 98 |
| 5267 | 16592 | LIB3060-014-Q1-K1-D4 | LIB3060 | g22562 | BLASTN | 2034 | 1e-160 | 96 |
| 5268 | 16592 | LIB3060-029-Q1-K1-H6 | LIB3060 | g22562 | BLASTN | 1998 | 1e-157 | 97 |
| 5269 | 16592 | LIB3060-011-Q1-K1-G8 | LIB3060 | g22562 | BLASTN | 1805 | 1e-155 | 96 |
| 5270 | 16592 | LIB3060-007-Q1-K1-E2 | LIB3060 | g22562 | BLASTN | 1875 | 1e-155 | 94 |
| 5271 | 16592 | LIB3060-003-Q1-K1-E9 | LIB3060 | g22415 | BLASTN | 1266 | 1e-135 | 89 |
| 5272 | 16592 | LIB3060-026-Q1-K1-H9 | LIB3060 | g22415 | BLASTN | 1712 | 1e-133 | 91 |
| 5273 | 16592 | LIB3060-020-Q1-K1-F11 | LIB3060 | g22412 | BLASTN | 699 | 1e-113 | 95 |
| 5274 | 201 | LIB3067-017-Q1-K1-H10 | LIB3067 | g3132309 | BLASTN | 905 | 1e-98 | 81 |
| 5275 | 21797 | LIB3067-036-Q1-K1-C4 | LIB3067 | g3132309 | BLASTN | 993 | 1e-117 | 89 |
| 5276 | 26948 | LIB3069-056-Q1-K1-C9 | LIB3069 | g21629 | BLASTN | 273 | 1e-15 | 85 |
| 5277 | 26948 | LIB36-004-Q1-E1-E1 | LIB36 | g21629 | BLASTN | 273 | 1e-14 | 83 |
| 5278 | 30586 | LIB3067-044-Q1-K1-F10 | LIB3067 | g467551 | BLASTN | 1151 | 1e-87 | 79 |
| 5279 | 3591 | LIB3059-005-Q1-K1-A6 | LIB3059 | g429148 | BLASTN | 2207 | 1e-174 | 99 |
| 5280 | 4329 | LIB3060-051-Q1-K1-H4 | LIB3060 | g21629 | BLASTN | 1872 | 1e-147 | 91 |
| 5281 | 4530 | LIB3059-014-Q1-K1-E8 | LIB3059 | g429148 | BLASTN | 2071 | 1e-163 | 98 |
| 5282 | 9226 | LIB3069-044-Q1-K1-F2 | LIB3069 | g169843 | BLASTN | 1596 | 1e-123 | 89 |
| SOYBEAN PHOSPHOENOLPYRUVATE CARBOXYLASE | | | | | | | | |
| 5283 | -700564927 | 700564927H1 | SOYMON002 | g218266 | BLASTN | 522 | 1e-79 | 95 |
| 5284 | -700567858 | 700567858H1 | SOYMON002 | g2266946 | BLASTN | 892 | 1e-69 | 83 |
| 5285 | -700648673 | 700648673H1 | SOYMON003 | g467551 | BLASTN | 1020 | 1e-106 | 97 |
| 5286 | -700659068 | 700659068H1 | SOYMON004 | g218266 | BLASTN | 1095 | 1e-95 | 100 |
| 5287 | -700728930 | 700728930H1 | SOYMON009 | g166416 | BLASTX | 114 | 1e-12 | 49 |
| 5288 | -700739901 | 700739901H1 | SOYMON012 | g2266946 | BLASTN | 868 | 1e-63 | 81 |
| 5289 | -700741179 | 700741179H1 | SOYMON012 | g2959439 | BLASTX | 190 | 1e-20 | 88 |
| 5290 | -700742902 | 700742902H1 | SOYMON012 | g147341 | BLASTX | 71 | 1e-9 | 46 |
| 5291 | -700751669 | 700751669H1 | SOYMON014 | g169844 | BLASTX | 263 | 1e-29 | 58 |
| 5292 | -700753587 | 700753587H1 | SOYMON014 | g2266946 | BLASTN | 750 | 1e-53 | 81 |
| 5293 | -700755512 | 700755512H1 | SOYMON014 | g218266 | BLASTN | 1173 | 1e-88 | 99 |

TABLE A*-continued

| Seq No. | Cluster ID | CloneID | Library | NCBI gi | Method | Score | P-value | % Ident |
|---|---|---|---|---|---|---|---|---|
| 5294 | -700755528 | 700755528H1 | SOYMON014 | g218266 | BLASTN | 623 | 1e-48 | 88 |
| 5295 | -700834546 | 700834546H1 | SOYMON019 | g2266946 | BLASTN | 826 | 1e-59 | 85 |
| 5296 | -700864136 | 700864136H1 | SOYMON016 | g2266946 | BLASTN | 637 | 1e-44 | 79 |
| 5297 | -700876401 | 700876401H1 | SOYMON018 | g22560 | BLASTN | 540 | 1e-64 | 84 |
| 5298 | -700890236 | 700890236H1 | SOYMON024 | g467551 | BLASTN | 491 | 1e-63 | 94 |
| 5299 | -700955462 | 700955462H1 | SOYMON022 | g467551 | BLASTN | 521 | 1e-74 | 95 |
| 5300 | -700959358 | 700959358H1 | SOYMON022 | g218266 | BLASTN | 1245 | 1e-94 | 100 |
| 5301 | -700971291 | 700971291H1 | SOYMON005 | g218266 | BLASTN | 1307 | 1e-100 | 99 |
| 5302 | -700979408 | 700979408H1 | SOYMON009 | g2266946 | BLASTN | 798 | 1e-70 | 85 |
| 5303 | -700987250 | 700987250H1 | SOYMON009 | g2266946 | BLASTN | 656 | 1e-58 | 78 |
| 5304 | -700987503 | 700987503H1 | SOYMON009 | g218266 | BLASTN | 890 | 1e-65 | 80 |
| 5305 | -700991194 | 700991194H1 | SOYMON011 | g2266946 | BLASTN | 600 | 1e-41 | 78 |
| 5306 | -701002203 | 701002203H1 | SOYMON018 | g2626748 | BLASTN | 420 | 1e-57 | 94 |
| 5307 | -701043122 | 701043122H1 | SOYMON029 | g467551 | BLASTN | 823 | 1e-59 | 96 |
| 5308 | -701043454 | 701043454H1 | SOYMON029 | g218266 | BLASTN | 631 | 1e-75 | 98 |
| 5309 | -701046608 | 701046608H1 | SOYMON032 | g218266 | BLASTN | 891 | 1e-87 | 95 |
| 5310 | -701062388 | 701062388H1 | SOYMON033 | g2626744 | BLASTN | 476 | 1e-40 | 93 |
| 5311 | -701119910 | 701119910H1 | SOYMON037 | g2626742 | BLASTN | 630 | 1e-49 | 78 |
| 5312 | -701213104 | 701213104H1 | SOYMON035 | g2266946 | BLASTN | 475 | 1e-57 | 78 |
| 5313 | 10663 | 700732365H1 | SOYMON010 | g2266946 | BLASTN | 875 | 1e-64 | 82 |
| 5314 | 10663 | 700981524H1 | SOYMON009 | g2266946 | BLASTN | 596 | 1e-62 | 80 |
| 5315 | 11125 | 700663617H1 | SOYMON005 | g218266 | BLASTN | 410 | 1e-38 | 98 |
| 5316 | 11125 | 700663717H1 | SOYMON005 | g218266 | BLASTN | 410 | 1e-35 | 85 |
| 5317 | 11125 | 700870993H1 | SOYMON018 | g218266 | BLASTN | 231 | 1e-9 | 96 |
| 5318 | 11227 | 700686116H1 | SOYMON008 | g2266946 | BLASTN | 995 | 1e-74 | 85 |
| 5319 | 11227 | 700944212H1 | SOYMON024 | g2266946 | BLASTN | 936 | 1e-69 | 85 |
| 5320 | 12325 | 700985848H1 | SOYMON009 | g2626742 | BLASTN | 1275 | 1e-97 | 94 |
| 5321 | 12325 | 701120339H1 | SOYMON037 | g467551 | BLASTN | 1210 | 1e-91 | 100 |
| 5322 | 12325 | 701214949H1 | SOYMON035 | g2626742 | BLASTN | 1175 | 1e-89 | 100 |
| 5323 | 12325 | 701096990H1 | SOYMON028 | g467551 | BLASTN | 1054 | 1e-78 | 94 |
| 5324 | 12325 | 701038039H1 | SOYMON029 | g467551 | BLASTN | 666 | 1e-77 | 98 |
| 5325 | 12325 | 701006212H2 | SOYMON019 | g467551 | BLASTN | 716 | 1e-62 | 95 |
| 5326 | 14728 | 700730704H1 | SOYMON009 | g2145426 | BLASTX | 147 | 1e-17 | 54 |
| 5327 | 14728 | 700685609H1 | SOYMON008 | g3341490 | BLASTX | 177 | 1e-17 | 43 |
| 5328 | 15298 | 701041573H1 | SOYMON029 | g2626742 | BLASTN | 1325 | 1e-101 | 100 |
| 5329 | 15298 | 701099785H1 | SOYMON028 | g2626742 | BLASTN | 1145 | 1e-100 | 100 |
| 5330 | 15298 | 700897382H1 | SOYMON027 | g2626742 | BLASTN | 972 | 1e-81 | 98 |
| 5331 | 17279 | 700874273H1 | SOYMON018 | g218266 | BLASTN | 980 | 1e-92 | 100 |
| 5332 | 17279 | 700684541H1 | SOYMON008 | g218266 | BLASTN | 328 | 1e-79 | 98 |
| 5333 | 18846 | 700836067H1 | SOYMON019 | g2626746 | BLASTN | 687 | 1e-97 | 99 |
| 5334 | 18846 | 700567643H1 | SOYMON002 | g2626746 | BLASTN | 1082 | 1e-83 | 99 |
| 5335 | 21305 | 700744392H1 | SOYMON013 | g19535 | BLASTN | 330 | 1e-33 | 78 |
| 5336 | 21305 | 700747092H1 | SOYMON013 | g19535 | BLASTN | 264 | 1e-28 | 80 |
| 5337 | 21695 | 700666285H1 | SOYMON005 | g218266 | BLASTN | 1251 | 1e-95 | 99 |
| 5338 | 21695 | 700945580H1 | SOYMON024 | g218266 | BLASTN | 1079 | 1e-81 | 88 |
| 5339 | 21940 | 701068565H1 | SOYMON034 | g218266 | BLASTN | 1334 | 1e-102 | 98 |
| 5340 | 21940 | 700943287H1 | SOYMON024 | g218266 | BLASTN | 945 | 1e-74 | 96 |
| 5341 | 22008 | 701040960H1 | SOYMON029 | g2626742 | BLASTN | 1321 | 1e-101 | 99 |
| 5342 | 22008 | 701038869H1 | SOYMON029 | g2626742 | BLASTN | 711 | 1e-66 | 99 |
| 5343 | 25805 | 700834887H1 | SOYMON019 | g2626742 | BLASTN | 1132 | 1e-85 | 95 |
| 5344 | 25805 | 701127019H1 | SOYMON037 | g467551 | BLASTN | 748 | 1e-80 | 96 |
| 5345 | 26379 | 701154209H1 | SOYMON031 | g2266946 | BLASTN | 799 | 1e-57 | 81 |
| 5346 | 26379 | 701154248H1 | SOYMON031 | g2626742 | BLASTN | 735 | 1e-52 | 81 |
| 5347 | 27397 | 701122563H1 | SOYMON037 | g2266946 | BLASTN | 753 | 1e-53 | 85 |
| 5348 | 27397 | 701122647H1 | SOYMON037 | g2266946 | BLASTN | 602 | 1e-41 | 76 |
| 5349 | 28129 | 701123443H1 | SOYMON037 | g1146155 | BLASTX | 102 | 1e-14 | 58 |
| 5350 | 6467 | 700648723H1 | SOYMON003 | g1213341 | BLASTX | 165 | 1e-19 | 68 |
| 5351 | 6467 | 700648341H1 | SOYMON003 | g1146154 | BLASTN | 257 | 1e-12 | 74 |
| 5352 | 7471 | 700889346H1 | SOYMON024 | g2266946 | BLASTN | 921 | 1e-67 | 85 |
| 5353 | 7471 | 700741422H1 | SOYMON012 | g2266946 | BLASTN | 891 | 1e-65 | 85 |
| 5354 | 7951 | 700962862H1 | SOYMON022 | g467551 | BLASTN | 1236 | 1e-94 | 99 |
| 5355 | 7951 | 700729127H1 | SOYMON009 | g467551 | BLASTN | 665 | 1e-93 | 100 |
| 5356 | 7951 | 700962754H1 | SOYMON022 | g467551 | BLASTN | 1127 | 1e-87 | 94 |
| 5357 | 9942 | 701042717H1 | SOYMON029 | g2626742 | BLASTN | 1275 | 1e-97 | 100 |
| 5358 | 9942 | 700943121H1 | SOYMON024 | g467551 | BLASTN | 1243 | 1e-94 | 99 |
| 5359 | -GM12190 | LIB3049-036-Q1-E1-F5 | LIB3049 | g18463 | BLASTN | 319 | 1e-16 | 69 |
| 5360 | -GM13015 | LIB3049-037-Q1-E1-D7 | LIB3049 | g18463 | BLASTN | 248 | 1e-11 | 74 |
| 5361 | -GM13035 | LIB3049-037-Q1-E1-A8 | LIB3049 | g18463 | BLASTN | 250 | 1e-11 | 65 |
| 5362 | -GM13114 | LIB3049-037-Q1-E1-E12 | LIB3049 | g18463 | BLASTN | 239 | 1e-9 | 63 |
| 5363 | -GM13510 | LIB3049-046-Q1-E1-A2 | LIB3049 | g2959438 | BLASTN | 531 | 1e-33 | 88 |
| 5364 | -GM13784 | LIB3049-048-Q1-E1-E12 | LIB3049 | g18463 | BLASTN | 242 | 1e-9 | 62 |

TABLE A*-continued

| Seq No. | Cluster ID | CloneID | Library | NCBI gi | Method | Score | P-value | % Ident |
|---|---|---|---|---|---|---|---|---|
| 5365 | -GM13839 | LIB3049-051-Q1-E1-C6 | LIB3049 | g18463 | BLASTN | 230 | 1e-10 | 60 |
| 5366 | -GM14450 | LIB3049-056-Q1-E1-D1 | LIB3049 | g18463 | BLASTN | 231 | 1e-8 | 61 |
| 5367 | -GM24091 | LIB3040-011-Q1-E1-G3 | LIB3040 | g18463 | BLASTN | 221 | 1e-9 | 66 |
| 5368 | -GM2515 | LIB3028-013-Q1-B1-H1 | LIB3028 | g18463 | BLASTN | 242 | 1e-11 | 66 |
| 5369 | -GM6973 | LIB3039-025-Q1-E1-C6 | LIB3039 | g18463 | BLASTN | 240 | 1e-11 | 66 |
| 5370 | -GM7231 | LIB3039-024-Q1-E1-C7 | LIB3039 | g18463 | BLASTN | 264 | 1e-12 | 65 |
| 5371 | 12325 | LIB3056-009-Q1-N1-H12 | LIB3056 | g467551 | BLASTN | 1487 | 1e-123 | 93 |
| MAIZE NADP-DEPENDENT MALATE DEHYDROGENASE | | | | | | | | |
| 5372 | -700579267 | 700579267H1 | SATMON031 | g22367 | BLASTN | 472 | 1e-43 | 88 |
| 5373 | 4577 | 700098054H1 | SATMON009 | g22367 | BLASTN | 835 | 1e-121 | 100 |
| 5374 | 4577 | 700097706H1 | SATMON009 | g22367 | BLASTN | 1536 | 1e-119 | 98 |
| 5375 | 4577 | 700097409H1 | SATMON009 | g22367 | BLASTN | 1497 | 1e-116 | 98 |
| 5376 | 4577 | 700100389H1 | SATMON009 | g22367 | BLASTN | 1431 | 1e-110 | 98 |
| 5377 | 4577 | 700098228H1 | SATMON009 | g22367 | BLASTN | 1405 | 1e-108 | 93 |
| 5378 | 4577 | 700042625H1 | SATMON004 | g22367 | BLASTN | 1366 | 1e-105 | 99 |
| 5379 | 4577 | 700044532H1 | SATMON004 | g22367 | BLASTN | 1366 | 1e-105 | 99 |
| 5380 | 4577 | 700426221H1 | SATMONN01 | g22367 | BLASTN | 761 | 1e-103 | 98 |
| 5381 | 4577 | 700045403H1 | SATMON004 | g22367 | BLASTN | 1145 | 1e-103 | 100 |
| 5382 | 4577 | 700100550H1 | SATMON009 | g22367 | BLASTN | 747 | 1e-101 | 97 |
| 5383 | 4577 | 700439608H1 | SATMON026 | g22367 | BLASTN | 1187 | 1e-100 | 97 |
| 5384 | 4577 | 700578318H1 | SATMON031 | g22367 | BLASTN | 755 | 1e-97 | 98 |
| 5385 | 4577 | 700084313H1 | SATMON011 | g22367 | BLASTN | 589 | 1e-96 | 98 |
| 5386 | 4577 | 700434067H1 | SATMONN01 | g22367 | BLASTN | 697 | 1e-95 | 98 |
| 5387 | 4577 | 700578011H1 | SATMON031 | g22367 | BLASTN | 1125 | 1e-93 | 99 |
| 5388 | 4577 | 700099962H1 | SATMON009 | g22367 | BLASTN | 1231 | 1e-93 | 87 |
| 5389 | 4577 | 700445309H1 | SATMON027 | g22367 | BLASTN | 452 | 1e-92 | 96 |
| 5390 | 4577 | 700213872H1 | SATMON016 | g22367 | BLASTN | 1181 | 1e-89 | 92 |
| 5391 | 4577 | 700578418H1 | SATMON031 | g22367 | BLASTN | 981 | 1e-85 | 95 |
| 5392 | 4577 | 700429351H1 | SATMONN01 | g22367 | BLASTN | 624 | 1e-84 | 96 |
| 5393 | 4577 | 700045012H1 | SATMON004 | g22367 | BLASTN | 1125 | 1e-84 | 94 |
| 5394 | 4577 | 700197938H1 | SATMON016 | g22367 | BLASTN | 1108 | 1e-83 | 99 |
| 5395 | 4577 | 700433880H1 | SATMONN01 | g22367 | BLASTN | 755 | 1e-73 | 97 |
| 5396 | 4577 | 700043693H1 | SATMON004 | g22367 | BLASTN | 886 | 1e-73 | 95 |
| 5397 | 4577 | 700581629H1 | SATMON031 | g22367 | BLASTN | 335 | 1e-69 | 91 |
| 5398 | 4577 | 700422827H1 | SATMONN01 | g22367 | BLASTN | 831 | 1e-69 | 96 |
| 5399 | 4577 | 700167037H1 | SATMON013 | g22367 | BLASTN | 889 | 1e-65 | 94 |
| 5400 | 4577 | 700438770H1 | SATMON026 | g22367 | BLASTN | 666 | 1e-53 | 94 |
| 5401 | 4577 | 700425253H1 | SATMONN01 | g22367 | BLASTN | 436 | 1e-50 | 95 |
| 5402 | 4577 | 700423354H1 | SATMONN01 | g22367 | BLASTN | 462 | 1e-50 | 97 |
| 5403 | 4577 | 700211538H1 | SATMON016 | g22367 | BLASTN | 540 | 1e-43 | 100 |
| 5404 | 4577 | 700097126H1 | SATMON009 | g22367 | BLASTN | 504 | 1e-33 | 97 |
| 5405 | 4577 | 700098826H1 | SATMON009 | g22367 | BLASTN | 488 | 1e-31 | 90 |
| 5406 | 4577 | 700100862H1 | SATMON009 | g22367 | BLASTN | 189 | 1e-13 | 92 |
| 5407 | -L30602059 | LIB3060-016-Q1-K1-C12 | LIB3060 | g22367 | BLASTN | 838 | 1e-128 | 87 |
| 5408 | 4577 | LIB36-016-Q2-E2-D10 | LIB36 | g22367 | BLASTN | 2081 | 1e-164 | 98 |
| 5409 | 4577 | LIB3078-033-Q1-K1-F11 | LIB3078 | g22367 | BLASTN | 2048 | 1e-162 | 93 |
| 5410 | 4577 | LIB36-013-Q1-E1-D5 | LIB36 | g22367 | BLASTN | 2051 | 1e-162 | 97 |
| 5411 | 4577 | LIB3060-021-Q1-K1-F9 | LIB3060 | g22367 | BLASTN | 1589 | 1e-156 | 96 |
| 5412 | 4577 | LIB36-015-Q1-E1-A7 | LIB36 | g22367 | BLASTN | 1805 | 1e-153 | 98 |
| 5413 | 4577 | LIB36-002-Q1-E1-D3 | LIB36 | g22367 | BLASTN | 1723 | 1e-149 | 91 |
| 5414 | 4577 | LIB3060-013-Q1-K1-G5 | LIB3060 | g22367 | BLASTN | 1836 | 1e-149 | 96 |
| 5415 | 4577 | LIB3060-013-Q1-K1-G2 | LIB3060 | g22367 | BLASTN | 1091 | 1e-135 | 95 |
| 5416 | 4577 | LIB36-020-Q1-E1-F1 | LIB36 | g22367 | BLASTN | 1400 | 1e-130 | 96 |
| 5417 | 4577 | LIB3079-013-Q1-K1-G10 | LIB3079 | g22367 | BLASTN | 1474 | 1e-128 | 98 |
| 5418 | 4577 | LIB189-018-Q1-E1-C10 | LIB189 | g22367 | BLASTN | 1427 | 1e-125 | 93 |
| 5419 | 4577 | LIB3078-052-Q1-K1-B9 | LIB3078 | g22367 | BLASTN | 1306 | 1e-114 | 90 |

TABLE A*-continued

| Seq No. | Cluster ID | CloneID | Library | NCBI gi | Method | Score | P-value | % Ident |
|---|---|---|---|---|---|---|---|---|
| SOYBEAN NADP-DEPENDENT MALATE DEHYDROGENASE ||||||||||
| 5420 | -701120823 | 701120823H1 | SOYMON037 | g397474 | BLASTN | 410 | 1e-52 | 84 |
| 5421 | 13458 | 700897079H1 | SOYMON027 | g397474 | BLASTN | 874 | 1e-64 | 83 |
| 5422 | 5228 | 701139976H1 | SOYMON038 | g397474 | BLASTN | 1145 | 1e-86 | 92 |
| 5423 | 5228 | 700738591H1 | SOYMON012 | g397474 | BLASTN | 991 | 1e-73 | 91 |
| MAIZE ASPARTATE AMINOTRANSFERASE ||||||||||
| 5424 | -700028003 | 700028003H1 | SATMON003 | g63066 | BLASTX | 125 | 1e-10 | 79 |
| 5425 | -700072842 | 700072842H1 | SATMON007 | g1001121 | BLASTX | 259 | 1e-28 | 50 |
| 5426 | -700194011 | 700194011H1 | SATMON014 | g435456 | BLASTN | 324 | 1e-18 | 73 |
| 5427 | -700196486 | 700196486H1 | SATMON014 | g20599 | BLASTX | 68 | 1e-10 | 74 |
| 5428 | -700331820 | 700331820H1 | SATMON019 | g20600 | BLASTN | 1192 | 1e-90 | 90 |
| 5429 | -700454550 | 700454550H1 | SATMON029 | g435458 | BLASTN | 198 | 1e-20 | 82 |
| 5430 | -700454567 | 700454567H1 | SATMON029 | g435458 | BLASTN | 333 | 1e-24 | 82 |
| 5431 | -700454642 | 700454642H1 | SATMON029 | g435458 | BLASTN | 269 | 1e-23 | 89 |
| 5432 | -700454849 | 700454849H1 | SATMON029 | g435458 | BLASTN | 318 | 1e-26 | 87 |
| 5433 | -700468560 | 700468560H1 | SATMON025 | g3328816 | BLASTN | 139 | 1e-19 | 58 |
| 5434 | -700476413 | 700476413H1 | SATMON025 | g2984217 | BLASTX | 156 | 1e-22 | 52 |
| 5435 | -700615109 | 700615109H1 | SATMON033 | g20598 | BLASTN | 256 | 1e-17 | 81 |
| 5436 | -701161385 | 701161385H1 | SATMONN04 | g435458 | BLASTN | 523 | 1e-45 | 80 |
| 5437 | 10165 | 700341126H1 | SATMON020 | g20596 | BLASTN | 743 | 1e-71 | 91 |
| 5438 | 10165 | 700160220H1 | SATMON012 | g20596 | BLASTN | 769 | 1e-55 | 92 |
| 5439 | 10165 | 700158802H1 | SATMON012 | g20596 | BLASTN | 617 | 1e-42 | 94 |
| 5440 | 10192 | 700204319H1 | SATMON003 | g2984217 | BLASTX | 148 | 1e-13 | 55 |
| 5441 | 10329 | 700095671H1 | SATMON008 | g20600 | BLASTN | 816 | 1e-59 | 87 |
| 5442 | 10329 | 700214146H1 | SATMON016 | g20596 | BLASTN | 610 | 1e-42 | 88 |
| 5443 | 10329 | 700041823H1 | SATMON004 | g20596 | BLASTN | 615 | 1e-42 | 78 |
| 5444 | 10329 | 700094321H1 | SATMON008 | g20596 | BLASTN | 559 | 1e-40 | 88 |
| 5445 | 1148 | 700089060H1 | SATMON011 | g633094 | BLASTN | 1397 | 1e-107 | 92 |
| 5446 | 1148 | 700044414H1 | SATMON004 | g633094 | BLASTN | 1272 | 1e-97 | 92 |
| 5447 | 1148 | 700101429H1 | SATMON009 | g633094 | BLASTN | 1221 | 1e-92 | 91 |
| 5448 | 1148 | 700221366H1 | SATMON011 | g633094 | BLASTN | 1205 | 1e-91 | 94 |
| 5449 | 1148 | 700101604H1 | SATMON009 | g633094 | BLASTN | 1167 | 1e-88 | 89 |
| 5450 | 1148 | 700041864H1 | SATMON004 | g633094 | BLASTN | 1159 | 1e-87 | 91 |
| 5451 | 1148 | 700157048H1 | SATMON012 | g633094 | BLASTN | 1121 | 1e-84 | 93 |
| 5452 | 1148 | 700581463H1 | SATMON031 | g633094 | BLASTN | 1124 | 1e-84 | 90 |
| 5453 | 1148 | 700579938H1 | SATMON031 | g633094 | BLASTN | 661 | 1e-83 | 91 |
| 5454 | 1148 | 700432477H1 | SATMONN01 | g633094 | BLASTN | 1050 | 1e-78 | 90 |
| 5455 | 1148 | 700154706H1 | SATMON007 | g633094 | BLASTN | 997 | 1e-74 | 90 |
| 5456 | 1148 | 700043761H1 | SATMON004 | g633094 | BLASTN | 905 | 1e-66 | 92 |
| 5457 | 1148 | 700423679H1 | SATMONN01 | g633094 | BLASTN | 555 | 1e-54 | 81 |
| 5458 | 1148 | 700424076H1 | SATMONN01 | g633094 | BLASTN | 228 | 1e-19 | 87 |
| 5459 | 1148 | 701166426H1 | SATMONN04 | g633094 | BLASTN | 221 | 1e-16 | 79 |
| 5460 | 16872 | 700211160H1 | SATMON016 | g633094 | BLASTN | 482 | 1e-56 | 88 |
| 5461 | 16872 | 700043705H1 | SATMON004 | g633094 | BLASTN | 293 | 1e-42 | 85 |
| 5462 | 16872 | 700208983H1 | SATMON016 | g633094 | BLASTN | 250 | 1e-15 | 84 |
| 5463 | 16872 | 700101375H1 | SATMON009 | g633094 | BLASTN | 154 | 1e-11 | 87 |
| 5464 | 17829 | 700581970H1 | SATMON031 | g1001309 | BLASTX | 107 | 1e-11 | 53 |
| 5465 | 17829 | 700194282H1 | SATMON014 | g1001309 | BLASTX | 107 | 1e-11 | 53 |
| 5466 | 18047 | 700206971H1 | SATMON003 | g1103380 | BLASTX | 107 | 1e-12 | 53 |
| 5467 | 19241 | 700472363H1 | SATMON025 | g20598 | BLASTN | 1010 | 1e-81 | 89 |
| 5468 | 19241 | 700472263H1 | SATMON025 | g20598 | BLASTN | 916 | 1e-78 | 89 |
| 5469 | 19241 | 700806145H1 | SATMON036 | g20598 | BLASTN | 947 | 1e-74 | 92 |
| 5470 | 319 | 700076939H1 | SATMON007 | g20598 | BLASTN | 1102 | 1e-83 | 89 |
| 5471 | 319 | 700349974H1 | SATMON023 | g20598 | BLASTN | 1018 | 1e-80 | 84 |
| 5472 | 319 | 700235923H1 | SATMON010 | g20598 | BLASTN | 1017 | 1e-79 | 88 |
| 5473 | 319 | 700206180H1 | SATMON003 | g20598 | BLASTN | 838 | 1e-78 | 86 |
| 5474 | 319 | 700476547H1 | SATMON025 | g20598 | BLASTN | 794 | 1e-76 | 88 |
| 5475 | 319 | 700258893H1 | SATMON017 | g20598 | BLASTN | 897 | 1e-73 | 89 |
| 5476 | 319 | 700612236H1 | SATMON022 | g20598 | BLASTN | 820 | 1e-72 | 86 |
| 5477 | 319 | 700806537H1 | SATMON036 | g20598 | BLASTN | 949 | 1e-70 | 87 |
| 5478 | 319 | 700450338H1 | SATMON028 | g20598 | BLASTN | 912 | 1e-67 | 85 |
| 5479 | 319 | 700806243H1 | SATMON036 | g20598 | BLASTN | 782 | 1e-66 | 87 |
| 5480 | 319 | 700263732H1 | SATMON017 | g435456 | BLASTN | 662 | 1e-61 | 86 |
| 5481 | 319 | 700806094H1 | SATMON036 | g20598 | BLASTN | 375 | 1e-59 | 91 |
| 5482 | 319 | 700152610H1 | SATMON007 | g20598 | BLASTN | 806 | 1e-58 | 85 |
| 5483 | 319 | 700614581H1 | SATMON033 | g20598 | BLASTN | 729 | 1e-51 | 89 |
| 5484 | 319 | 700349161H1 | SATMON023 | g20598 | BLASTN | 270 | 1e-30 | 87 |
| 5485 | 319 | 700805964H1 | SATMON036 | g20598 | BLASTN | 463 | 1e-29 | 79 |
| 5486 | 319 | 700450544H1 | SATMON028 | g20598 | BLASTN | 280 | 1e-27 | 86 |
| 5487 | 319 | 700618252H1 | SATMON033 | g20598 | BLASTN | 407 | 1e-26 | 86 |
| 5488 | 319 | 700615189H1 | SATMON033 | g20598 | BLASTN | 309 | 1e-25 | 87 |
| 5489 | 319 | 700264196H1 | SATMON017 | g20598 | BLASTN | 412 | 1e-25 | 84 |
| 5490 | 4431 | 700211615H1 | SATMON016 | g1001309 | BLASTX | 96 | 1e-9 | 32 |
| 5491 | 541 | 700073508H1 | SATMON007 | g633094 | BLASTN | 1388 | 1e-106 | 91 |
| 5492 | 541 | 700098793H1 | SATMON009 | g633094 | BLASTN | 1329 | 1e-101 | 90 |

TABLE A*-continued

| Seq No. | Cluster ID | CloneID | Library | NCBI gi | Method | Score | P-value | % Ident |
|---|---|---|---|---|---|---|---|---|
| 5493 | 541 | 700101956H1 | SATMON009 | g633094 | BLASTN | 1307 | 1e−100 | 89 |
| 5494 | 541 | 700100132H1 | SATMON009 | g633094 | BLASTN | 1314 | 1e−100 | 93 |
| 5495 | 541 | 700799335H1 | SATMON036 | g633094 | BLASTN | 1216 | 1e−92 | 95 |
| 5496 | 541 | 700446909H1 | SATMON027 | g633094 | BLASTN | 1154 | 1e−87 | 91 |
| 5497 | 541 | 700444305H1 | SATMON027 | g633094 | BLASTN | 988 | 1e−86 | 97 |
| 5498 | 541 | 700222187H1 | SATMON011 | g633094 | BLASTN | 1116 | 1e−84 | 89 |
| 5499 | 541 | 700093340H1 | SATMON008 | g633094 | BLASTN | 1121 | 1e−84 | 90 |
| 5500 | 541 | 700576310H1 | SATMON030 | g633094 | BLASTN | 1107 | 1e−83 | 91 |
| 5501 | 541 | 700443474H1 | SATMON027 | g633094 | BLASTN | 584 | 1e−82 | 93 |
| 5502 | 541 | 700440955H1 | SATMON026 | g633094 | BLASTN | 803 | 1e−82 | 92 |
| 5503 | 541 | 700446111H1 | SATMON027 | g633094 | BLASTN | 939 | 1e−81 | 87 |
| 5504 | 541 | 700259835H1 | SATMON017 | g633094 | BLASTN | 1073 | 1e−80 | 87 |
| 5505 | 541 | 700551206H1 | SATMON022 | g633094 | BLASTN | 968 | 1e−76 | 89 |
| 5506 | 541 | 700445905H1 | SATMON027 | g633094 | BLASTN | 464 | 1e−75 | 89 |
| 5507 | 541 | 700446192H1 | SATMON027 | g633094 | BLASTN | 774 | 1e−55 | 92 |
| 5508 | 541 | 700614693H1 | SATMON033 | g633094 | BLASTN | 600 | 1e−54 | 80 |
| 5509 | 7402 | 700439746H1 | SATMON026 | g20596 | BLASTN | 1353 | 1e−103 | 97 |
| 5510 | 7402 | 700621225H1 | SATMON034 | g20596 | BLASTN | 709 | 1e−72 | 97 |
| 5511 | 7402 | 700456918H1 | SATMON029 | g20596 | BLASTN | 968 | 1e−71 | 95 |
| 5512 | 7402 | 700453876H1 | SATMON029 | g20600 | BLASTN | 761 | 1e−54 | 96 |
| 5513 | 7402 | 700623616H1 | SATMON034 | g20596 | BLASTN | 432 | 1e−39 | 96 |
| 5514 | 7402 | 700454592H1 | SATMON029 | g20600 | BLASTN | 380 | 1e−30 | 81 |
| 5515 | 7402 | 700454593H1 | SATMON029 | g20600 | BLASTN | 310 | 1e−28 | 96 |
| 5516 | 7482 | 700197666H1 | SATMON014 | g2621088 | BLASTX | 145 | 1e−24 | 55 |
| 5517 | 7482 | 700615228H1 | SATMON033 | g3328816 | BLASTX | 201 | 1e−20 | 61 |
| 5518 | 7482 | 700030129H1 | SATMON003 | g3328816 | BLASTX | 178 | 1e−17 | 56 |
| 5519 | 7482 | 700579227H1 | SATMON031 | g2621088 | BLASTX | 132 | 1e−15 | 44 |
| 5520 | 786 | 700476002H1 | SATMON025 | g20598 | BLASTN | 1119 | 1e−90 | 92 |
| 5521 | 786 | 700461103H1 | SATMON033 | g20598 | BLASTN | 1196 | 1e−90 | 91 |
| 5522 | 786 | 700240702H1 | SATMON010 | g20598 | BLASTN | 1174 | 1e−89 | 91 |
| 5523 | 786 | 700470851H1 | SATMON025 | g20598 | BLASTN | 1138 | 1e−86 | 91 |
| 5524 | 786 | 700262654H1 | SATMON017 | g20598 | BLASTN | 1138 | 1e−86 | 91 |
| 5525 | 786 | 700452647H1 | SATMON028 | g20598 | BLASTN | 1115 | 1e−84 | 88 |
| 5526 | 786 | 700194349H1 | SATMON014 | g20598 | BLASTN | 1115 | 1e−84 | 92 |
| 5527 | 786 | 700472225H1 | SATMON025 | g20598 | BLASTN | 645 | 1e−82 | 86 |
| 5528 | 786 | 700461203H1 | SATMON033 | g20598 | BLASTN | 1019 | 1e−82 | 90 |
| 5529 | 786 | 700581588H1 | SATMON031 | g20598 | BLASTN | 561 | 1e−79 | 90 |
| 5530 | 786 | 700194330H1 | SATMON014 | g20598 | BLASTN | 1043 | 1e−78 | 90 |
| 5531 | 786 | 700194016H1 | SATMON014 | g20598 | BLASTN | 1044 | 1e−78 | 90 |
| 5532 | 786 | 700157347H1 | SATMON012 | g20598 | BLASTN | 1049 | 1e−78 | 90 |
| 5533 | 786 | 700195805H1 | SATMON014 | g20598 | BLASTN | 1049 | 1e−78 | 90 |
| 5534 | 786 | 700160255H1 | SATMON012 | g20598 | BLASTN | 1040 | 1e−77 | 93 |
| 5535 | 786 | 700582138H1 | SATMON031 | g20598 | BLASTN | 885 | 1e−75 | 88 |
| 5536 | 786 | 700197148H1 | SATMON014 | g20598 | BLASTN | 1007 | 1e−75 | 90 |
| 5537 | 786 | 700159366H1 | SATMON012 | g20598 | BLASTN | 1016 | 1e−75 | 91 |
| 5538 | 786 | 701184326H1 | SATMONN06 | g20598 | BLASTN | 815 | 1e−72 | 89 |
| 5539 | 786 | 700159491H1 | SATMON012 | g20598 | BLASTN | 979 | 1e−72 | 93 |
| 5540 | 786 | 700104663H1 | SATMON010 | g20598 | BLASTN | 966 | 1e−71 | 86 |
| 5541 | 786 | 700195003H1 | SATMON014 | g20598 | BLASTN | 779 | 1e−69 | 86 |
| 5542 | 786 | 700218254H1 | SATMON016 | g20598 | BLASTN | 942 | 1e−69 | 89 |
| 5543 | 786 | 700802451H1 | SATMON036 | g20598 | BLASTN | 581 | 1e−68 | 90 |
| 5544 | 786 | 700157772H1 | SATMON012 | g20598 | BLASTN | 887 | 1e−65 | 90 |
| 5545 | 786 | 700473425H1 | SATMON025 | g20598 | BLASTN | 466 | 1e−64 | 85 |
| 5546 | 786 | 700800486H1 | SATMON036 | g20598 | BLASTN | 868 | 1e−63 | 91 |
| 5547 | 786 | 700185039H1 | SATMON014 | g20598 | BLASTN | 859 | 1e−62 | 86 |
| 5548 | 786 | 700800057H1 | SATMON036 | g20598 | BLASTN | 567 | 1e−59 | 85 |
| 5549 | 786 | 700451832H1 | SATMON028 | g20598 | BLASTN | 501 | 1e−58 | 88 |
| 5550 | 786 | 700799994H1 | SATMON036 | g20598 | BLASTN | 570 | 1e−55 | 91 |
| 5551 | 786 | 700801486H1 | SATMON036 | g20598 | BLASTN | 750 | 1e−53 | 91 |
| 5552 | 786 | 700802086H1 | SATMON036 | g20598 | BLASTN | 459 | 1e−51 | 89 |
| 5553 | 786 | 700477105H1 | SATMON025 | g20598 | BLASTN | 708 | 1e−50 | 90 |
| 5554 | 786 | 700260426H1 | SATMON017 | g20598 | BLASTN | 702 | 1e−49 | 84 |
| 5555 | 786 | 700799811H1 | SATMON036 | g20598 | BLASTN | 409 | 1e−48 | 84 |
| 5556 | 786 | 700427005H1 | SATMONN01 | g20598 | BLASTN | 691 | 1e−48 | 89 |
| 5557 | 786 | 700803487H1 | SATMON036 | g20598 | BLASTN | 423 | 1e−46 | 83 |
| 5558 | 786 | 700262695H1 | SATMON017 | g20598 | BLASTN | 367 | 1e−43 | 89 |
| 5559 | 786 | 700471602H1 | SATMON025 | g20598 | BLASTN | 601 | 1e−41 | 90 |
| 5560 | 786 | 701185813H2 | SATMONN06 | g20598 | BLASTN | 320 | 1e−39 | 83 |
| 5561 | 786 | 700196744H1 | SATMON014 | g20598 | BLASTN | 490 | 1e−32 | 92 |
| 5562 | 786 | 701184204H1 | SATMONN06 | g20598 | BLASTN | 247 | 1e−10 | 78 |
| 5563 | 786 | 700622453H1 | SATMON034 | g20598 | BLASTN | 230 | 1e−8 | 79 |
| 5564 | 786 | 700618768H1 | SATMON034 | g20598 | BLASTN | 230 | 1e−8 | 79 |
| 5565 | −L30591931 | LIB3059-009-Q1-K1-C12 | LIB3059 | g20596 | BLASTN | 1989 | 1e−157 | 95 |
| 5566 | −L30593805 | LIB3059-022-Q1-K1-H6 | LIB3059 | g20596 | BLASTN | 377 | 1e−56 | 79 |

TABLE A*-continued

| Seq No. | Cluster ID | CloneID | Library | NCBI gi | Method | Score | P-value | % Ident |
|---|---|---|---|---|---|---|---|---|
| 5567 | -L30596704 | LIB3059-055-Q1-K1-E5 | LIB3059 | g20596 | BLASTN | 733 | 1e-52 | 89 |
| 5568 | -L30624957 | LIB3062-040-Q1-K1-H1 | LIB3062 | g633095 | BLASTX | 112 | 1e-27 | 56 |
| 5569 | -L30671766 | LIB3067-014-Q1-K1-B8 | LIB3067 | g20596 | BLASTN | 1132 | 1e-122 | 86 |
| 5570 | -L30693715 | LIB3069-012-Q1-K1-F3 | LIB3069 | g142538 | BLASTX | 98 | 1e-24 | 47 |
| 5571 | 10329 | LIB3079-007-Q1-K1-B3 | LIB3079 | g20596 | BLASTN | 1201 | 1e-97 | 87 |
| 5572 | 10329 | LIB143-052-Q1-E1-E4 | LIB143 | g20596 | BLASTN | 751 | 1e-53 | 86 |
| 5573 | 1148 | LIB3078-040-Q1-K1-H1 | LIB3078 | g633094 | BLASTN | 1675 | 1e-130 | 87 |
| 5574 | 1148 | LIB3062-040-Q1-K1-H3 | LIB3062 | g633094 | BLASTN | 1310 | 1e-100 | 88 |
| 5575 | 1148 | LIB143-054-Q1-E1-F1 | LIB143 | g633094 | BLASTN | 1234 | 1e-94 | 88 |
| 5576 | 1148 | LIB83-001-Q1-E1-A10 | LIB83 | g633094 | BLASTN | 1030 | 1e-77 | 81 |
| 5577 | 16872 | LIB36-018-Q1-E1-D12 | LIB36 | g633094 | BLASTN | 542 | 1e-69 | 85 |
| 5578 | 25099 | LIB3059-012-Q1-K1-G3 | LIB3059 | g1001309 | BLASTX | 130 | 1e-36 | 38 |
| 5579 | 319 | LIB143-022-Q1-E1-G3 | LIB143 | g20598 | BLASTN | 1698 | 1e-135 | 89 |
| 5580 | 319 | LIB143-048-Q1-E1-G12 | LIB143 | g20598 | BLASTN | 1562 | 1e-126 | 87 |
| 5581 | 319 | LIB143-001-Q1-E1-H6 | LIB143 | g20598 | BLASTN | 1462 | 1e-113 | 90 |
| 5582 | 319 | LIB143-002-Q1-E1-H2 | LIB143 | g20598 | BLASTN | 484 | 1e-66 | 88 |
| 5583 | 32047 | LIB148-034-Q1-E1-F3 | LIB148 | g435456 | BLASTN | 262 | 1e-12 | 68 |
| 5584 | 32047 | LIB148-032-Q1-E1-H8 | LIB148 | g435456 | BLASTN | 255 | 1e-11 | 71 |
| 5585 | 541 | LIB3062-033-Q1-K1-G2 | LIB3062 | g633094 | BLASTN | 1706 | 1e-133 | 90 |
| 5586 | 541 | LIB3062-033-Q1-K1-G3 | LIB3062 | g633094 | BLASTN | 1123 | 1e-94 | 84 |
| 5587 | 541 | LIB3060-005-Q1-K1-C1 | LIB3060 | g633094 | BLASTN | 1061 | 1e-90 | 84 |
| 5588 | 7402 | LIB3059-004-Q1-K1-F4 | LIB3059 | g20596 | BLASTN | 1461 | 1e-142 | 92 |
| 5589 | 786 | LIB3061-042-Q1-K1-E8 | LIB3061 | g20598 | BLASTN | 1811 | 1e-142 | 88 |
| 5590 | 786 | LIB143-040-Q1-E1-D11 | LIB143 | g20598 | BLASTN | 1462 | 1e-113 | 92 |
| 5591 | 786 | LIB143-030-Q1-E1-D9 | LIB143 | g20598 | BLASTN | 1141 | 1e-101 | 90 |
| 5592 | 786 | LIB3068-035-Q1-K1-A4 | LIB3068 | g20598 | BLASTN | 533 | 1e-99 | 78 |
| 5593 | 786 | LIB143-017-Q1-E1-C8 | LIB143 | g20598 | BLASTN | 678 | 1e-92 | 82 |
| 5594 | 786 | LIB143-030-Q1-E1-D11 | LIB143 | g20598 | BLASTN | 1165 | 1e-88 | 86 |
| 5595 | 786 | LIB3061-048-Q1-K1-D7 | LIB3061 | g20598 | BLASTN | 299 | 1e-15 | 78 |
| 5596 | 786 | LIB3059-056-Q1-K1-B1 | LIB3059 | g20598 | BLASTN | 283 | 1e-12 | 74 |
| MAIZE PUTATIVE ASPARTATE AMINOTRANSFERASE | | | | | | | | |
| 5597 | -700201453 | 700201453H1 | SATMON003 | g1049345 | BLASTX | 178 | 1e-17 | 64 |
| 5598 | 23836 | 700243862H1 | SATMON010 | g1778518 | BLASTX | 133 | 1e-11 | 49 |
| 5599 | 23836 | 701169557H1 | SATMONN05 | g1778518 | BLASTX | 126 | 1e-10 | 54 |
| 5600 | 7482 | LIB3059-049-Q1-K1-E5 | LIB3059 | g2621088 | BLASTX | 138 | 1e-48 | 51 |
| SOYBEAN ASPARTATE AMINOTRANSFERASE | | | | | | | | |
| 5601 | -700668054 | 700668054H1 | SOYMON006 | g3328816 | BLASTX | 172 | 1e-16 | 53 |
| 5602 | -700685655 | 700685655H1 | SOYMON008 | g387106 | BLASTX | 165 | 1e-15 | 62 |
| 5603 | -700729138 | 700729138H1 | SOYMON009 | g2621088 | BLASTX | 136 | 1e-17 | 47 |
| 5604 | -700734818 | 700734818H1 | SOYMON010 | g3201622 | BLASTX | 234 | 1e-25 | 54 |
| 5605 | -700787411 | 700787411H2 | SOYMON011 | g20598 | BLASTN | 908 | 1e-66 | 90 |
| 5606 | -700868646 | 700868646H1 | SOYMON016 | g435458 | BLASTN | 513 | 1e-33 | 75 |
| 5607 | -700874369 | 700874369H1 | SOYMON018 | g2654093 | BLASTN | 808 | 1e-63 | 90 |
| 5608 | -700974412 | 700974412H1 | SOYMON005 | g169914 | BLASTN | 249 | 1e-11 | 83 |

TABLE A*-continued

| Seq No. | Cluster ID | CloneID | Library | NCBI gi | Method | Score | P-value | % Ident |
|---|---|---|---|---|---|---|---|---|
| 5609 | -701009475 | 701009475H1 | SOYMON019 | g1001309 | BLASTX | 111 | 1e-15 | 49 |
| 5610 | -701050301 | 701050301H1 | SOYMON032 | g169914 | BLASTX | 263 | 1e-11 | 75 |
| 5611 | -701061267 | 701061267H1 | SOYMON033 | g169914 | BLASTN | 235 | 1e-35 | 88 |
| 5612 | -701129551 | 701129551H1 | SOYMON037 | g169914 | BLASTN | 1232 | 1e-93 | 93 |
| 5613 | 13413 | 700904367H1 | SOYMON022 | g1001121 | BLASTX | 231 | 1e-24 | 52 |
| 5614 | 13413 | 700895714H1 | SOYMON027 | g2266762 | BLASTX | 175 | 1e-22 | 49 |
| 5615 | 13413 | 700727795H1 | SOYMON009 | g1001121 | BLASTX | 190 | 1e-19 | 48 |
| 5616 | 13503 | 700974712H1 | SOYMON005 | g169914 | BLASTN | 1358 | 1e-104 | 99 |
| 5617 | 13503 | 700895483H1 | SOYMON027 | g169914 | BLASTN | 1236 | 1e-94 | 97 |
| 5618 | 13503 | 700846207H1 | SOYMON021 | g169914 | BLASTN | 1136 | 1e-85 | 94 |
| 5619 | 14358 | 700909477H1 | SOYMON022 | g710595 | BLASTN | 1309 | 1e-100 | 98 |
| 5620 | 14358 | 700732673H1 | SOYMON010 | g710595 | BLASTN | 1296 | 1e-99 | 98 |
| 5621 | 14358 | 700890192H1 | SOYMON024 | g710595 | BLASTN | 913 | 1e-83 | 98 |
| 5622 | 14358 | 700727008H1 | SOYMON009 | g710595 | BLASTN | 553 | 1e-55 | 99 |
| 5623 | 15432 | 700567458H1 | SOYMON002 | g1001309 | BLASTX | 115 | 1e-8 | 31 |
| 5624 | 15529 | 701045375H1 | SOYMON032 | g3201622 | BLASTX | 189 | 1e-19 | 55 |
| 5625 | 15529 | 700567374H1 | SOYMON002 | g3201622 | BLASTX | 186 | 1e-18 | 55 |
| 5626 | 15529 | 701102885H1 | SOYMON028 | g3201622 | BLASTX | 172 | 1e-16 | 56 |
| 5627 | 15529 | 701213187H1 | SOYMON035 | g3201622 | BLASTX | 174 | 1e-16 | 55 |
| 5628 | 15529 | 701055675H1 | SOYMON032 | g3201622 | BLASTX | 166 | 1e-15 | 60 |
| 5629 | 15529 | 701052631H1 | SOYMON032 | g3201622 | BLASTX | 159 | 1e-14 | 53 |
| 5630 | 15529 | 701213639H1 | SOYMON035 | g3201622 | BLASTX | 110 | 1e-13 | 59 |
| 5631 | 1566 | 700651242H1 | SOYMON003 | g2654093 | BLASTN | 1433 | 1e-146 | 98 |
| 5632 | 1566 | 700661083H1 | SOYMON005 | g2654093 | BLASTN | 898 | 1e-102 | 95 |
| 5633 | 1566 | 700668434H1 | SOYMON006 | g2654093 | BLASTN | 1289 | 1e-98 | 99 |
| 5634 | 1566 | 700677640H1 | SOYMON007 | g2654093 | BLASTN | 758 | 1e-97 | 99 |
| 5635 | 1566 | 700655909H1 | SOYMON004 | g2654093 | BLASTN | 730 | 1e-95 | 100 |
| 5636 | 1566 | 700660728H1 | SOYMON005 | g2654093 | BLASTN | 634 | 1e-81 | 90 |
| 5637 | 1566 | 700807523H1 | SOYMON016 | g2654093 | BLASTN | 478 | 1e-31 | 87 |
| 5638 | 16634 | 700660070H1 | SOYMON004 | g2621088 | BLASTX | 111 | 1e-20 | 54 |
| 5639 | 16634 | 700746670H1 | SOYMON013 | g2621088 | BLASTX | 118 | 1e-18 | 53 |
| 5640 | 1703 | 700749933H1 | SOYMON013 | g2654093 | BLASTN | 1385 | 1e-106 | 100 |
| 5641 | 1703 | 700793749H1 | SOYMON017 | g2654093 | BLASTN | 1370 | 1e-105 | 100 |
| 5642 | 1703 | 701127031H1 | SOYMON037 | g2654093 | BLASTN | 716 | 1e-94 | 96 |
| 5643 | 1703 | 700997259H1 | SOYMON018 | g2654093 | BLASTN | 1089 | 1e-81 | 97 |
| 5644 | 1703 | 700670783H1 | SOYMON006 | g2654093 | BLASTN | 767 | 1e-79 | 93 |
| 5645 | 25132 | 700678487H1 | SOYMON007 | g2654093 | BLASTN | 1175 | 1e-104 | 98 |
| 5646 | 25132 | 701049020H1 | SOYMON032 | g2654093 | BLASTN | 1260 | 1e-96 | 100 |
| 5647 | 25542 | 701151325H1 | SOYMON031 | g1001309 | BLASTX | 96 | 1e-15 | 51 |
| 5648 | 25542 | 700964436H1 | SOYMON022 | g1001309 | BLASTX | 107 | 1e-13 | 51 |
| 5649 | 26671 | 701106241H1 | SOYMON036 | g1001309 | BLASTX | 121 | 1e-9 | 39 |
| 5650 | 26671 | 701149504H1 | SOYMON031 | g1001309 | BLASTX | 122 | 1e-9 | 36 |
| 5651 | 27066 | 700605347H2 | SOYMON004 | g169914 | BLASTN | 1147 | 1e-104 | 99 |
| 5652 | 27066 | 701053078H1 | SOYMON032 | g169914 | BLASTN | 833 | 1e-87 | 96 |
| 5653 | 6297 | 700971234H1 | SOYMON005 | g169914 | BLASTN | 1303 | 1e-99 | 99 |
| 5654 | 6297 | 701205146H1 | SOYMON035 | g169914 | BLASTN | 1269 | 1e-96 | 94 |
| 5655 | 6297 | 701137753H1 | SOYMON038 | g169914 | BLASTN | 335 | 1e-85 | 93 |
| 5656 | 6297 | 700741154H1 | SOYMON012 | g169914 | BLASTN | 1135 | 1e-85 | 100 |
| 5657 | 6297 | 700954813H1 | SOYMON022 | g169914 | BLASTN | 1095 | 1e-84 | 100 |
| 5658 | 6297 | 701000832H1 | SOYMON018 | g169914 | BLASTN | 410 | 1e-83 | 95 |
| 5659 | 6297 | 701039262H1 | SOYMON029 | g169914 | BLASTN | 650 | 1e-82 | 97 |
| 5660 | 6297 | 701108365H1 | SOYMON036 | g169914 | BLASTN | 1032 | 1e-80 | 97 |
| 5661 | 6297 | 700953963H1 | SOYMON022 | g169914 | BLASTN | 1058 | 1e-79 | 92 |
| 5662 | 6297 | 700971364H1 | SOYMON005 | g169914 | BLASTN | 865 | 1e-63 | 95 |
| 5663 | 6297 | 701002832H1 | SOYMON019 | g169914 | BLASTN | 599 | 1e-62 | 90 |
| 5664 | 6297 | 700650013H1 | SOYMON003 | g169914 | BLASTN | 686 | 1e-61 | 88 |
| 5665 | 6297 | 701139166H1 | SOYMON038 | g169914 | BLASTN | 632 | 1e-43 | 83 |
| 5666 | 6297 | 701055975H1 | SOYMON032 | g169914 | BLASTN | 611 | 1e-42 | 99 |
| 5667 | 6297 | 701131513H1 | SOYMON038 | g169914 | BLASTN | 600 | 1e-41 | 96 |
| 5668 | 6297 | 701065138H1 | SOYMON034 | g169914 | BLASTN | 432 | 1e-38 | 89 |
| 5669 | 6297 | 701010254H2 | SOYMON019 | g169914 | BLASTN | 427 | 1e-36 | 88 |
| 5670 | 7549 | 700666429H1 | SOYMON005 | g169914 | BLASTN | 1249 | 1e-95 | 96 |
| 5671 | 7549 | 701001911H1 | SOYMON018 | g169914 | BLASTN | 819 | 1e-59 | 98 |
| 5672 | 7585 | 701127651H1 | SOYMON037 | g2654093 | BLASTN | 1360 | 1e-104 | 100 |
| 5673 | 7585 | 700668614H1 | SOYMON006 | g2654093 | BLASTN | 1341 | 1e-102 | 99 |
| 5674 | 7585 | 701054030H1 | SOYMON032 | g2654093 | BLASTN | 1341 | 1e-102 | 99 |
| 5675 | 7585 | 700890128H1 | SOYMON024 | g2654093 | BLASTN | 1285 | 1e-98 | 100 |
| 5676 | 7585 | 701056607H1 | SOYMON032 | g2654093 | BLASTN | 1069 | 1e-96 | 96 |
| 5677 | 7585 | 700973306H1 | SOYMON005 | g2654093 | BLASTN | 1250 | 1e-95 | 100 |
| 5678 | 7585 | 700845404H1 | SOYMON021 | g2654093 | BLASTN | 890 | 1e-94 | 96 |
| 5679 | 7585 | 700650253H1 | SOYMON003 | g2654093 | BLASTN | 1232 | 1e-93 | 98 |
| 5680 | 7585 | 700672829H1 | SOYMON006 | g2654093 | BLASTN | 1188 | 1e-90 | 99 |
| 5681 | 7585 | 700664509H1 | SOYMON005 | g2654093 | BLASTN | 1074 | 1e-87 | 97 |
| 5682 | 7585 | 701056892H1 | SOYMON032 | g2654093 | BLASTN | 1158 | 1e-87 | 93 |
| 5683 | 7585 | 700605686H2 | SOYMON005 | g2654093 | BLASTN | 1048 | 1e-86 | 97 |
| 5684 | 7585 | 700894006H1 | SOYMON024 | g2654093 | BLASTN | 1052 | 1e-85 | 96 |
| 5685 | 7585 | 700955412H1 | SOYMON022 | g2654093 | BLASTN | 625 | 1e-84 | 95 |

TABLE A*-continued

| Seq No. | Cluster ID | CloneID | Library | NCBI gi | Method | Score | P-value | % Ident |
|---|---|---|---|---|---|---|---|---|
| 5686 | 7585 | 700560909H1 | SOYMON001 | g2654093 | BLASTN | 1119 | 1e−84 | 93 |
| 5687 | 7585 | 700895972H1 | SOYMON027 | g2654093 | BLASTN | 1105 | 1e−83 | 100 |
| 5688 | 7585 | 700663309H1 | SOYMON005 | g2654093 | BLASTN | 888 | 1e−82 | 95 |
| 5689 | 7585 | 700787774H2 | SOYMON011 | g2654093 | BLASTN | 943 | 1e−82 | 96 |
| 5690 | 7585 | 701069589H1 | SOYMON034 | g2654093 | BLASTN | 539 | 1e−81 | 93 |
| 5691 | 7585 | 700663096H1 | SOYMON005 | g2654093 | BLASTN | 498 | 1e−80 | 95 |
| 5692 | 7585 | 700836390H1 | SOYMON020 | g2654093 | BLASTN | 898 | 1e−80 | 95 |
| 5693 | 7585 | 700967858H1 | SOYMON033 | g2654093 | BLASTN | 978 | 1e−80 | 92 |
| 5694 | 7585 | 701101575H1 | SOYMON028 | g2654093 | BLASTN | 1032 | 1e−80 | 97 |
| 5695 | 7585 | 700750565H1 | SOYMON014 | g2654093 | BLASTN | 812 | 1e−79 | 95 |
| 5696 | 7585 | 701064276H1 | SOYMON034 | g2654093 | BLASTN | 820 | 1e−75 | 90 |
| 5697 | 7585 | 700995223H1 | SOYMON011 | g2654093 | BLASTN | 765 | 1e−68 | 89 |
| 5698 | 7585 | 700756072H1 | SOYMON014 | g2654093 | BLASTN | 899 | 1e−66 | 93 |
| 5699 | 7585 | 701147945H1 | SOYMON031 | g2654093 | BLASTN | 648 | 1e−64 | 95 |
| 5700 | 7585 | 700888603H1 | SOYMON024 | g2654093 | BLASTN | 865 | 1e−63 | 96 |
| 5701 | 9138 | 700562918H1 | SOYMON002 | g152149 | BLASTX | 195 | 1e−26 | 61 |
| 5702 | 9138 | 700654444H1 | SOYMON004 | g152149 | BLASTX | 191 | 1e−24 | 60 |
| 5703 | 9138 | 701037102H1 | SOYMON029 | g152149 | BLASTX | 123 | 1e−16 | 53 |
| 5704 | -GM17331 | LIB3055-010-Q1-N1-G4 | LIB3055 | g169914 | BLASTN | 456 | 1e−27 | 85 |
| 5705 | -GM25144 | LIB3040-027-Q1-E1-F2 | LIB3040 | g2654093 | BLASTN | 526 | 1e−65 | 85 |
| 5706 | -GM41298 | LIB3051-109-Q1-K1-F6 | LIB3051 | g2654093 | BLASTN | 207 | 1e−29 | 83 |
| 5707 | 14358 | LIB3051-106-Q1-K1-G8 | LIB3051 | g710595 | BLASTN | 2246 | 1e−178 | 99 |
| 5708 | 25132 | LIB3051-063-Q1-K1-D12 | LIB3051 | g2654093 | BLASTN | 1347 | 1e−103 | 96 |
| 5709 | 3196 | LIB3065-006-Q1-N1-B10 | LIB3065 | g1778518 | BLASTX | 170 | 1e−32 | 50 |
| 5710 | 32509 | LIB3056-012-Q1-N1-C3 | LIB3056 | g2648397 | BLASTX | 152 | 1e−29 | 43 |
| 5711 | 6297 | LIB3055-010-Q1-N1-G6 | LIB3055 | g169914 | BLASTN | 1721 | 1e−134 | 99 |
| 5712 | 6297 | LIB3055-010-Q1-N1-G7 | LIB3055 | g169914 | BLASTN | 1246 | 1e−123 | 97 |
| 5713 | 6297 | LIB3055-010-Q1-N1-G8 | LIB3055 | g169914 | BLASTN | 1120 | 1e−84 | 93 |
| 5714 | 6297 | LIB3049-021-Q1-E1-C8 | LIB3049 | g169914 | BLASTN | 864 | 1e−63 | 91 |
| 5715 | 7585 | LIB3051-105-Q1-K1-F8 | LIB3051 | g2654093 | BLASTN | 2108 | 1e−167 | 99 |
| 5716 | 7585 | LIB3028-010-Q1-B1-C7 | LIB3028 | g2654093 | BLASTN | 1973 | 1e−158 | 97 |
| 5717 | 7585 | LIB3030-001-Q1-B1-B7 | LIB3030 | g2654093 | BLASTN | 1117 | 1e−138 | 95 |
| 5718 | 7585 | LIB3051-040-Q1-K1-D4 | LIB3051 | g2654093 | BLASTN | 1166 | 1e−116 | 94 |
| 5719 | 9138 | LIB3065-001-Q1-N1-G1 | LIB3065 | g152149 | BLASTX | 168 | 1e−38 | 52 |
| SOYBEAN PUTATIVE ASPARTATE AMINOTRANSFERASE | | | | | | | | |
| 5720 | 9138 | 700830720H1 | SOYMON019 | g3257794 | BLASTX | 186 | 1e−27 | 58 |
| 5721 | 9138 | 701100721H1 | SOYMON028 | g3257794 | BLASTX | 206 | 1e−23 | 56 |
| 5722 | 9138 | 700958391H1 | SOYMON022 | g3257794 | BLASTX | 217 | 1e−23 | 60 |
| 5723 | 9138 | 701119543H1 | SOYMON037 | g3257794 | BLASTX | 152 | 1e−13 | 58 |
| 5724 | -700669394 | 700669394H1 | SOYMON006 | g1778518 | BLASTX | 75 | 1e−9 | 50 |
| 5725 | 3196 | 700753821H1 | SOYMON014 | g1778518 | BLASTX | 117 | 1e−9 | 59 |
| 5726 | -700999272 | 700999272H1 | SOYMON018 | g1326254 | BLASTX | 153 | 1e−15 | 57 |
| 5727 | 32509 | LIB3055-011-Q1-N1-G1 | LIB3055 | g1778518 | BLASTX | 124 | 1e−27 | 35 |
| MAIZE ALANINE AMINOTRANSFERASE | | | | | | | | |
| 5728 | -700049393 | 700049393H1 | SATMON003 | g296204 | BLASTX | 143 | 1e−12 | 100 |
| 5729 | -700104304 | 700104304H1 | SATMON010 | g1353351 | BLASTN | 655 | 1e−45 | 70 |
| 5730 | -700172189 | 700172189H1 | SATMON013 | g1353352 | BLASTX | 211 | 1e−22 | 70 |
| 5731 | -700222553 | 700222553H1 | SATMON011 | g1353352 | BLASTX | 292 | 1e−33 | 54 |
| 5732 | -700257069 | 700257069H1 | SATMON017 | g469147 | BLASTN | 610 | 1e−42 | 70 |
| 5733 | -700264090 | 700264090H1 | SATMON017 | g296203 | BLASTN | 798 | 1e−57 | 77 |
| 5734 | -700264413 | 700264413H1 | SATMON017 | g296204 | BLASTX | 319 | 1e−37 | 59 |
| 5735 | -700457290 | 700457290H1 | SATMON029 | g296203 | BLASTN | 640 | 1e−44 | 70 |
| 5736 | -700461128 | 700461128H1 | SATMON033 | g469147 | BLASTN | 482 | 1e−31 | 65 |
| 5737 | -700461228 | 700461228H1 | SATMON033 | g296204 | BLASTX | 120 | 1e−19 | 61 |
| 5738 | -700579019 | 700579019H1 | SATMON031 | g1353352 | BLASTX | 149 | 1e−16 | 39 |
| 5739 | -700584206 | 700584206H1 | SATMON031 | g1353352 | BLASTX | 175 | 1e−17 | 62 |
| 5740 | -700617436 | 700617436H1 | SATMON033 | g296204 | BLASTX | 206 | 1e−24 | 51 |
| 5741 | -700624223 | 700624223H1 | SATMON034 | g1353351 | BLASTN | 476 | 1e−29 | 72 |

TABLE A*-continued

| Seq No. | Cluster ID | CloneID | Library | NCBI gi | Method | Score | P-value | % Ident |
|---|---|---|---|---|---|---|---|---|
| 5742 | −701164032 | 701164032H1 | SATMONN04 | g296204 | BLASTX | 85 | 1e−11 | 65 |
| 5743 | −701166826 | 701166826H1 | SATMONN04 | g296204 | BLASTN | 219 | 1e−12 | 84 |
| 5744 | 15087 | 700801716H1 | SATMON036 | g296203 | BLASTN | 434 | 1e−25 | 91 |
| 5745 | 15087 | 700806781H1 | SATMON036 | g469147 | BLASTN | 198 | 1e−11 | 87 |
| 5746 | 15418 | 700102926H1 | SATMON010 | g1353351 | BLASTN | 550 | 1e−35 | 65 |
| 5747 | 15418 | 700423101H1 | SATMON01 | g1353351 | BLASTN | 475 | 1e−29 | 66 |
| 5748 | 22920 | 701172883H2 | SATMONN05 | g469147 | BLASTN | 778 | 1e−56 | 77 |
| 5749 | 22920 | 701172884H2 | SATMONN05 | g469147 | BLASTN | 460 | 1e−51 | 77 |
| 5750 | 2698 | 700099203H1 | SATMON009 | g1353352 | BLASTX | 192 | 1e−18 | 82 |
| 5751 | 29667 | 700210632H1 | SATMON016 | g1353352 | BLASTX | 260 | 1e−28 | 57 |
| 5752 | 31650 | 700580511H1 | SATMON031 | g1353352 | BLASTX | 192 | 1e−35 | 68 |
| 5753 | 3823 | 700217635H1 | SATMON016 | g296203 | BLASTN | 650 | 1e−45 | 76 |
| 5754 | 3823 | 700349242H1 | SATMON023 | g296203 | BLASTN | 524 | 1e−34 | 76 |
| 5755 | 414 | 700473110H1 | SATMON025 | g296204 | BLASTX | 204 | 1e−35 | 57 |
| 5756 | 414 | 700264510H1 | SATMON017 | g469147 | BLASTN | 456 | 1e−27 | 60 |
| 5757 | 414 | 700262355H1 | SATMON017 | g469148 | BLASTX | 241 | 1e−26 | 55 |
| 5758 | 414 | 700263001H1 | SATMON017 | g469148 | BLASTX | 230 | 1e−24 | 56 |
| 5759 | 414 | 700474691H1 | SATMON025 | g296204 | BLASTX | 179 | 1e−17 | 44 |
| 5760 | 414 | 700615134H1 | SATMON033 | g469148 | BLASTX | 127 | 1e−10 | 62 |
| 5761 | 6080 | 700218182H1 | SATMON016 | g296203 | BLASTN | 684 | 1e−48 | 74 |
| 5762 | 6080 | 700239054H1 | SATMON010 | g296203 | BLASTN | 649 | 1e−45 | 74 |
| 5763 | 6080 | 700207743H1 | SATMON016 | g296203 | BLASTN | 592 | 1e−40 | 74 |
| 5764 | 6080 | 700049234H1 | SATMON003 | g296204 | BLASTX | 144 | 1e−12 | 64 |
| 5765 | 8847 | 700257223H1 | SATMON017 | g296204 | BLASTX | 218 | 1e−23 | 54 |
| 5766 | 8847 | 700267629H1 | SATMON017 | g296204 | BLASTX | 184 | 1e−18 | 50 |
| 5767 | 8847 | 700267912H1 | SATMON017 | g296204 | BLASTX | 184 | 1e−18 | 50 |
| 5768 | 8847 | 700265819H1 | SATMON017 | g296204 | BLASTX | 136 | 1e−11 | 43 |
| 5769 | 923 | 700047471H1 | SATMON003 | g296203 | BLASTN | 1211 | 1e−103 | 92 |
| 5770 | 923 | 700446631H1 | SATMON027 | g296203 | BLASTN | 766 | 1e−102 | 92 |
| 5771 | 923 | 700263484H1 | SATMON017 | g296203 | BLASTN | 1332 | 1e−102 | 94 |
| 5772 | 923 | 700076095H1 | SATMON007 | g296203 | BLASTN | 1284 | 1e−98 | 93 |
| 5773 | 923 | 700042264H1 | SATMON004 | g296203 | BLASTN | 1267 | 1e−96 | 93 |
| 5774 | 923 | 700041605H1 | SATMON004 | g296203 | BLASTN | 1245 | 1e−94 | 92 |
| 5775 | 923 | 700258238H1 | SATMON017 | g296203 | BLASTN | 933 | 1e−93 | 89 |
| 5776 | 923 | 700620967H1 | SATMON034 | g296203 | BLASTN | 1011 | 1e−92 | 91 |
| 5777 | 923 | 700046079H1 | SATMON004 | g296203 | BLASTN | 1211 | 1e−92 | 94 |
| 5778 | 923 | 700073909H1 | SATMON007 | g296203 | BLASTN | 1203 | 1e−91 | 91 |
| 5779 | 923 | 701179662H1 | SATMONN05 | g296203 | BLASTN | 1194 | 1e−90 | 93 |
| 5780 | 923 | 700045425H1 | SATMON004 | g296203 | BLASTN | 1196 | 1e−90 | 92 |
| 5781 | 923 | 700043325H1 | SATMON004 | g296203 | BLASTN | 1178 | 1e−89 | 93 |
| 5782 | 923 | 700042080H1 | SATMON004 | g296203 | BLASTN | 1061 | 1e−86 | 92 |
| 5783 | 923 | 700799695H1 | SATMON036 | g296203 | BLASTN | 1139 | 1e−86 | 92 |
| 5784 | 923 | 700347121H1 | SATMON021 | g296203 | BLASTN | 1017 | 1e−85 | 88 |
| 5785 | 923 | 700194649H1 | SATMON014 | g296203 | BLASTN | 1129 | 1e−85 | 91 |
| 5786 | 923 | 700803015H1 | SATMON036 | g296203 | BLASTN | 959 | 1e−84 | 91 |
| 5787 | 923 | 700046202H1 | SATMON004 | g296203 | BLASTN | 1118 | 1e−84 | 94 |
| 5788 | 923 | 700621382H1 | SATMON034 | g296203 | BLASTN | 648 | 1e−83 | 92 |
| 5789 | 923 | 700194809H1 | SATMON014 | g296203 | BLASTN | 1083 | 1e−81 | 94 |
| 5790 | 923 | 700194576H1 | SATMON014 | g296203 | BLASTN | 1089 | 1e−81 | 92 |
| 5791 | 923 | 700045006H1 | SATMON004 | g296203 | BLASTN | 1076 | 1e−80 | 91 |
| 5792 | 923 | 700195835H1 | SATMON014 | g296203 | BLASTN | 1057 | 1e−79 | 91 |
| 5793 | 923 | 700194814H1 | SATMON014 | g296203 | BLASTN | 1058 | 1e−79 | 92 |
| 5794 | 923 | 700046245H1 | SATMON004 | g296203 | BLASTN | 1046 | 1e−78 | 94 |
| 5795 | 923 | 700161109H1 | SATMON012 | g296203 | BLASTN | 1047 | 1e−78 | 94 |
| 5796 | 923 | 700194345H1 | SATMON014 | g296203 | BLASTN | 1037 | 1e−77 | 94 |
| 5797 | 923 | 700472892H1 | SATMON025 | g296203 | BLASTN | 505 | 1e−76 | 88 |
| 5798 | 923 | 700617757H1 | SATMON033 | g296203 | BLASTN | 863 | 1e−76 | 90 |
| 5799 | 923 | 700805426H1 | SATMON036 | g296203 | BLASTN | 523 | 1e−74 | 93 |
| 5800 | 923 | 700801191H1 | SATMON036 | g296203 | BLASTN | 724 | 1e−74 | 90 |
| 5801 | 923 | 700472860H1 | SATMON025 | g296203 | BLASTN | 876 | 1e−74 | 86 |
| 5802 | 923 | 700100107H1 | SATMON009 | g296203 | BLASTN | 999 | 1e−74 | 88 |
| 5803 | 923 | 700465264H1 | SATMON025 | g296203 | BLASTN | 784 | 1e−72 | 92 |
| 5804 | 923 | 700455079H1 | SATMON029 | g296203 | BLASTN | 930 | 1e−72 | 89 |
| 5805 | 923 | 700620492H1 | SATMON034 | g296203 | BLASTN | 718 | 1e−71 | 92 |
| 5806 | 923 | 700801419H1 | SATMON036 | g296203 | BLASTN | 909 | 1e−71 | 92 |
| 5807 | 923 | 700155082H1 | SATMON007 | g296203 | BLASTN | 949 | 1e−70 | 93 |
| 5808 | 923 | 700045844H1 | SATMON004 | g296203 | BLASTN | 808 | 1e−69 | 90 |
| 5809 | 923 | 700477823H1 | SATMON025 | g296203 | BLASTN | 922 | 1e−68 | 88 |
| 5810 | 923 | 700475452H1 | SATMON025 | g296203 | BLASTN | 824 | 1e−65 | 91 |
| 5811 | 923 | 700802280H1 | SATMON036 | g296203 | BLASTN | 874 | 1e−64 | 92 |
| 5812 | 923 | 700156653H1 | SATMON012 | g296203 | BLASTN | 780 | 1e−63 | 87 |
| 5813 | 923 | 700444754H1 | SATMON027 | g296203 | BLASTN | 831 | 1e−60 | 89 |
| 5814 | 923 | 700099483H1 | SATMON009 | g296203 | BLASTN | 724 | 1e−59 | 88 |
| 5815 | 923 | 700101871H1 | SATMON009 | g296203 | BLASTN | 821 | 1e−59 | 91 |
| 5816 | 923 | 700076559H1 | SATMON007 | g296203 | BLASTN | 765 | 1e−57 | 89 |
| 5817 | 923 | 700442606H1 | SATMON026 | g296203 | BLASTN | 791 | 1e−57 | 91 |
| 5818 | 923 | 700800871H1 | SATMON036 | g296203 | BLASTN | 494 | 1e−56 | 86 |

TABLE A*-continued

| Seq No. | Cluster ID | CloneID | Library | NCBI gi | Method | Score | P-value | % Ident |
|---|---|---|---|---|---|---|---|---|
| 5819 | 923 | 700197582H1 | SATMON014 | g296203 | BLASTN | 786 | 1e−56 | 90 |
| 5820 | 923 | 700100451H1 | SATMON009 | g296203 | BLASTN | 476 | 1e−54 | 90 |
| 5821 | 923 | 700405018H1 | SATMON027 | g296203 | BLASTN | 597 | 1e−54 | 86 |
| 5822 | 923 | 700099885H1 | SATMON009 | g296203 | BLASTN | 653 | 1e−53 | 91 |
| 5823 | 923 | 700043273H1 | SATMON004 | g296203 | BLASTN | 721 | 1e−51 | 90 |
| 5824 | 923 | 700476434H1 | SATMON025 | g296203 | BLASTN | 449 | 1e−47 | 91 |
| 5825 | 923 | 700438820H1 | SATMON026 | g296203 | BLASTN | 671 | 1e−47 | 89 |
| 5826 | 923 | 700428681H1 | SATMONN01 | g296203 | BLASTN | 673 | 1e−47 | 91 |
| 5827 | 923 | 700042259H1 | SATMON004 | g296203 | BLASTN | 675 | 1e−47 | 93 |
| 5828 | 923 | 700801436H1 | SATMON036 | g296203 | BLASTN | 677 | 1e−47 | 86 |
| 5829 | 923 | 700257814H1 | SATMON017 | g296203 | BLASTN | 647 | 1e−45 | 85 |
| 5830 | 923 | 700044879H1 | SATMON004 | g296203 | BLASTN | 648 | 1e−45 | 91 |
| 5831 | 923 | 700207027H1 | SATMON003 | g296203 | BLASTN | 595 | 1e−42 | 87 |
| 5832 | 923 | 700257265H1 | SATMON017 | g296203 | BLASTN | 610 | 1e−42 | 87 |
| 5833 | 923 | 700571949H1 | SATMON030 | g296203 | BLASTN | 576 | 1e−39 | 91 |
| 5834 | 923 | 701166609H1 | SATMONN04 | g296203 | BLASTN | 514 | 1e−38 | 83 |
| 5835 | 923 | 701182932H1 | SATMONN06 | g296203 | BLASTN | 383 | 1e−37 | 88 |
| 5836 | 923 | 700281788H1 | SATMON020 | g296203 | BLASTN | 398 | 1e−37 | 88 |
| 5837 | 923 | 700151478H1 | SATMON007 | g296203 | BLASTN | 554 | 1e−37 | 89 |
| 5838 | 923 | 700423955H1 | SATMONN01 | g296203 | BLASTN | 539 | 1e−36 | 85 |
| 5839 | 923 | 700472592H1 | SATMON025 | g296203 | BLASTN | 291 | 1e−34 | 87 |
| 5840 | 923 | 700621067H2 | SATMON034 | g296203 | BLASTN | 480 | 1e−31 | 84 |
| 5841 | 923 | 700621082H2 | SATMON034 | g296203 | BLASTN | 457 | 1e−29 | 90 |
| 5842 | 923 | 700426976H1 | SATMONN01 | g296203 | BLASTN | 431 | 1e−27 | 93 |
| 5843 | 923 | 700098538H1 | SATMON009 | g296204 | BLASTX | 117 | 1e−9 | 69 |
| 5844 | 9316 | 700263427H1 | SATMON017 | g1353352 | BLASTX | 318 | 1e−36 | 63 |
| 5845 | 9316 | 700222070H1 | SATMON011 | g1353352 | BLASTX | 296 | 1e−33 | 61 |
| 5846 | 9316 | 700085696H1 | SATMON011 | g1353352 | BLASTX | 259 | 1e−28 | 67 |
| 5847 | -L30601398 | LIB3060-001-Q1-K2-F11 | LIB3060 | g296203 | BLASTN | 610 | 1e−67 | 88 |
| 5848 | -L30603921 | LIB3060-042-Q1-K1-E6 | LIB3060 | g296203 | BLASTN | 740 | 1e−63 | 83 |
| 5849 | -L30672268 | LIB3067-007-Q1-K1-H12 | LIB3067 | g296203 | BLASTN | 601 | 1e−41 | 85 |
| 5850 | -L30695453 | LIB3069-036-Q1-K1-C10 | LIB3069 | g296203 | BLASTN | 868 | 1e−63 | 75 |
| 5851 | -L832403 | LIB83-005-Q1-E1-A7 | LIB83 | g469148 | BLASTX | 210 | 1e−37 | 81 |
| 5852 | 29667 | LIB3060-015-Q1-K1-B3 | LIB3060 | g1353351 | BLASTN | 631 | 1e−42 | 61 |
| 5853 | 31650 | LIB148-034-Q1-E1-A6 | LIB148 | g1353352 | BLASTX | 127 | 1e−53 | 63 |
| 5854 | 923 | LIB3067-040-Q1-K1-B11 | LIB3067 | g296203 | BLASTN | 1949 | 1e−153 | 94 |
| 5855 | 923 | LIB3060-017-Q1-K1-F12 | LIB3060 | g296203 | BLASTN | 1832 | 1e−143 | 92 |
| 5856 | 923 | LIB143-053-Q1-E1-G9 | LIB143 | g296203 | BLASTN | 1814 | 1e−142 | 91 |
| 5857 | 923 | LIB148-002-Q1-E1-B9 | LIB148 | g296203 | BLASTN | 1821 | 1e−142 | 94 |
| 5858 | 923 | LIB36-012-Q1-E1-B11 | LIB36 | g296203 | BLASTN | 1766 | 1e−140 | 92 |
| 5859 | 923 | LIB84-004-Q1-E1-F6 | LIB84 | g296203 | BLASTN | 1797 | 1e−140 | 91 |
| 5860 | 923 | LIB3066-019-Q1-K1-E9 | LIB3066 | g296203 | BLASTN | 1520 | 1e−139 | 94 |
| 5861 | 923 | LIB3059-045-Q1-K1-G1 | LIB3059 | g296203 | BLASTN | 1777 | 1e−139 | 92 |
| 5862 | 923 | LIB3059-014-Q1-K1-H7 | LIB3059 | g296203 | BLASTN | 1785 | 1e−139 | 91 |
| 5863 | 923 | LIB3060-044-Q1-K1-E2 | LIB3060 | g296203 | BLASTN | 1007 | 1e−136 | 92 |
| 5864 | 923 | LIB3060-012-Q1-K1-C8 | LIB3060 | g296203 | BLASTN | 1662 | 1e−134 | 91 |
| 5865 | 923 | LIB189-019-Q1-E1-D11 | LIB189 | g296203 | BLASTN | 1642 | 1e−131 | 92 |
| 5866 | 923 | LIB3059-014-Q1-K1-A8 | LIB305 | g296203 | BLASTN | 1232 | 1e−129 | 88 |
| 5867 | 923 | LIB143-053-Q1-E1-G10 | LIB143 | g296203 | BLASTN | 1377 | 1e−129 | 90 |
| 5868 | 923 | LIB3059-006-Q1-K1-H5 | LIB3059 | g296203 | BLASTN | 1532 | 1e−124 | 88 |
| 5869 | 923 | LIB3060-023-Q1-K1-E6 | LIB3060 | g296203 | BLASTN | 1176 | 1e−122 | 85 |
| 5870 | 923 | LIB36-017-Q1-E1-D3 | LIB36 | g296203 | BLASTN | 1545 | 1e−119 | 91 |

TABLE A*-continued

| Seq No. | Cluster ID | CloneID | Library | NCBI gi | Method | Score | P-value | % Ident |
|---|---|---|---|---|---|---|---|---|
| 5871 | 923 | LIB3060-023-Q1-K1-E7 | LIB3060 | g296203 | BLASTN | 1418 | 1e−109 | 79 |
| 5872 | 923 | LIB3060-036-Q1-K1-D2 | LIB3060 | g296203 | BLASTN | 1410 | 1e−108 | 92 |
| 5873 | 923 | LIB3060-002-Q1-K2-C11 | LIB3060 | g296203 | BLASTN | 1400 | 1e−107 | 91 |
| 5874 | 923 | LIB36-013-Q1-E1-C3 | LIB36 | g296203 | BLASTN | 1202 | 1e−100 | 87 |
| 5875 | 923 | LIB3079-021-Q1-K1-D8 | LIB3079 | g296203 | BLASTN | 1236 | 1e−100 | 90 |
| 5876 | 923 | LIB3060-051-Q1-K1-B8 | LIB3060 | g296203 | BLASTN | 1281 | 1e−97 | 88 |
| 5877 | 923 | LIB3059-048-Q1-K1-A4 | LIB3059 | g296203 | BLASTN | 1224 | 1e−93 | 94 |
| 5878 | 923 | LIB3060-043-Q1-K1-G9 | LIB3060 | g296203 | BLASTN | 816 | 1e−90 | 92 |
| 5879 | 923 | LIB3060-034-Q1-K1-A5 | LIB3060 | g296203 | BLASTN | 816 | 1e−87 | 88 |
| 5880 | 923 | LIB3060-042-Q1-K1-E4 | LIB3060 | g296203 | BLASTN | 1126 | 1e−85 | 91 |
| 5881 | 923 | LIB3060-011-Q1-K1-A9 | LIB3060 | g296203 | BLASTN | 790 | 1e−78 | 86 |
| 5882 | 923 | LIB189-033-Q1-E1-F2 | LIB189 | g296203 | BLASTN | 566 | 1e−74 | 83 |
| 5883 | 923 | LIB3061-041-Q1-K1-B2 | LIB3061 | g296203 | BLASTN | 809 | 1e−68 | 89 |
| 5884 | 923 | LIB3060-030-Q1-K1-E1 | LIB3060 | g296203 | BLASTN | 472 | 1e−65 | 73 |
| 5885 | 923 | LIB3060-004-Q1-K1-A8 | LIB3060 | g296203 | BLASTN | 407 | 1e−38 | 78 |
| 5886 | 9316 | LIB3062-014-Q1-K1-A12 | LIB3062 | g1353352 | BLASTX | 448 | 1e−71 | 60 |
| 5887 | 9316 | LIB3060-041-Q1-K1-C8 | LIB3060 | g1353352 | BLASTX | 393 | 1e−68 | 58 |
| 5888 | 9316 | LIB84-028-Q1-E1-119 | LIB84 | g1353352 | BLASTX | 202 | 1e−61 | 61 |
| | | SOYBEAN ALANINE AMINOTRANSFERASE | | | | | | |
| 5889 | −700743719 | 700743719H1 | SOYMON012 | g1353352 | BLASTX | 78 | 1e−8 | 61 |
| 5890 | −700959696 | 700959696H1 | SOYMON022 | g296204 | BLASTX | 195 | 1e−20 | 79 |
| 5891 | −700996510 | 700996510H1 | SOYMON018 | g296204 | BLASTX | 187 | 1e−18 | 71 |
| 5892 | −701069323 | 701069323H1 | SOYMON034 | g296204 | BLASTX | 116 | 1e−21 | 63 |
| 5893 | 10017 | 700605618H2 | SOYMON005 | g296203 | BLASTN | 496 | 1e−32 | 73 |
| 5894 | 10017 | 700682253H1 | SOYMON008 | g296204 | BLASTX | 143 | 1e−16 | 71 |
| 5895 | 10017 | 700990421H1 | SOYMON011 | g296204 | BLASTX | 160 | 1e−15 | 69 |
| 5896 | 10017 | 700747761H1 | SOYMON013 | g296204 | BLASTX | 164 | 1e−15 | 70 |
| 5897 | 10017 | 701038703H1 | SOYMON029 | g296204 | BLASTX | 164 | 1e−15 | 70 |
| 5898 | 10017 | 700975277H1 | SOYMON009 | g296204 | BLASTX | 140 | 1e−14 | 67 |
| 5899 | 10017 | 700984821H1 | SOYMON009 | g296204 | BLASTX | 155 | 1e−14 | 69 |
| 5900 | 10017 | 700756842H1 | SOYMON014 | g296204 | BLASTX | 139 | 1e−12 | 68 |
| 5901 | 10017 | 700746942H1 | SOYMON013 | g469147 | BLASTN | 241 | 1e−9 | 76 |
| 5902 | 10118 | 701120663H1 | SOYMON037 | g296204 | BLASTX | 350 | 1e−41 | 85 |
| 5903 | 10118 | 701049525H1 | SOYMON032 | g296204 | BLASTX | 355 | 1e−41 | 88 |
| 5904 | 10118 | 701119423H1 | SOYMON037 | g296203 | BLASTN | 575 | 1e−39 | 67 |
| 5905 | 10118 | 700872879H1 | SOYMON018 | g296204 | BLASTX | 312 | 1e−35 | 82 |
| 5906 | 10118 | 700973420H1 | SOYMON005 | g296204 | BLASTX | 260 | 1e−31 | 66 |
| 5907 | 12859 | 700562950H1 | SOYMON002 | g296203 | BLASTN | 685 | 1e−48 | 74 |
| 5908 | 12859 | 700971319H1 | SOYMON005 | g296204 | BLASTX | 273 | 1e−38 | 76 |
| 5909 | 17267 | 700555074H1 | SOYMON001 | g1353352 | BLASTX | 378 | 1e−45 | 79 |
| 5910 | 17267 | 700555060H1 | SOYMON001 | g1353352 | BLASTX | 378 | 1e−45 | 79 |
| 5911 | 17267 | 700743751H1 | SOYMON012 | g1353352 | BLASTX | 133 | 1e−11 | 61 |
| 5912 | 19812 | 700896952H1 | SOYMON027 | g296203 | BLASTN | 468 | 1e−30 | 67 |
| 5913 | 19812 | 700659743H1 | SOYMON004 | g296203 | BLASTN | 451 | 1e−27 | 67 |
| 5914 | 31650 | 700874484H1 | SOYMON018 | g1353352 | BLASTX | 118 | 1e−9 | 59 |
| 5915 | 5883 | 701001504H1 | SOYMON018 | g296203 | BLASTN | 714 | 1e−50 | 73 |
| 5916 | 5883 | 700969537H1 | SOYMON005 | g296203 | BLASTN | 598 | 1e−41 | 70 |
| 5917 | 5883 | 700672092H1 | SOYMON006 | g296203 | BLASTN | 601 | 1e−41 | 72 |
| 5918 | 5883 | 700961520H1 | SOYMON022 | g296203 | BLASTN | 584 | 1e−39 | 72 |
| 5919 | 5883 | 701141195H1 | SOYMON038 | g296204 | BLASTX | 153 | 1e−14 | 75 |
| 5920 | 6292 | 700559647H1 | SOYMON001 | g1353352 | BLASTX | 292 | 1e−33 | 51 |
| 5921 | 6292 | 700556715H1 | SOYMON001 | g1353352 | BLASTX | 292 | 1e−33 | 53 |
| 5922 | 6292 | 701001051H1 | SOYMON018 | g1353352 | BLASTX | 293 | 1e−33 | 58 |
| 5923 | 6292 | 700682468H2 | SOYMON008 | g1353352 | BLASTX | 261 | 1e−29 | 51 |
| 5924 | 6292 | 700973534H1 | SOYMON005 | g1353352 | BLASTX | 263 | 1e−29 | 54 |
| 5925 | 6292 | 700874672H1 | SOYMON018 | g1353352 | BLASTX | 150 | 1e−28 | 55 |
| 5926 | 6292 | 700893193H1 | SOYMON024 | g296204 | BLASTX | 256 | 1e−28 | 58 |
| 5927 | 6292 | 700681610H1 | SOYMON008 | g296204 | BLASTX | 259 | 1e−28 | 58 |

TABLE A*-continued

| Seq No. | Cluster ID | CloneID | Library | NCBI gi | Method | Score | P-value | % Ident |
|---|---|---|---|---|---|---|---|---|
| 5928 | 6292 | 701002246H1 | SOYMON018 | g296204 | BLASTX | 159 | 1e−27 | 56 |
| 5929 | 6292 | 700956467H1 | SOYMON022 | g1353352 | BLASTX | 238 | 1e−27 | 58 |
| 5930 | 6292 | 700888645H1 | SOYMON024 | g296204 | BLASTX | 196 | 1e−20 | 60 |
| 5931 | 6292 | 701002201H1 | SOYMON018 | g296204 | BLASTX | 156 | 1e−16 | 57 |
| 5932 | 6292 | 700680675H1 | SOYMON008 | g469148 | BLASTX | 119 | 1e−9 | 63 |
| 5933 | 6292 | 701050803H1 | SOYMON032 | g296204 | BLASTX | 120 | 1e−9 | 58 |
| 5934 | 6594 | 700684722H1 | SOYMON008 | g1353352 | BLASTX | 157 | 1e−22 | 69 |
| 5935 | 6594 | 700872191H1 | SOYMON018 | g1353352 | BLASTX | 129 | 1e−16 | 61 |
| 5936 | 698 | 700738627H1 | SOYMON012 | g1353352 | BLASTX | 333 | 1e−39 | 73 |
| 5937 | 698 | 700681703H1 | SOYMON008 | g1353352 | BLASTX | 319 | 1e−37 | 76 |
| 5938 | 698 | 700961778H1 | SOYMON022 | g1353352 | BLASTX | 316 | 1e−36 | 79 |
| 5939 | 698 | 700666316H1 | SOYMON005 | g1353352 | BLASTX | 298 | 1e−34 | 77 |
| 5940 | 698 | 700685706H1 | SOYMON008 | g1353352 | BLASTX | 293 | 1e−33 | 72 |
| 5941 | 698 | 700739093H1 | SOYMON012 | g1353352 | BLASTX | 172 | 1e−29 | 73 |
| 5942 | 698 | 700666387H1 | SOYMON005 | g1353352 | BLASTX | 267 | 1e−29 | 76 |
| 5943 | 698 | 700993520H1 | SOYMON011 | g1353352 | BLASTX | 255 | 1e−28 | 63 |
| 5944 | 698 | 700896371H1 | SOYMON027 | g1353352 | BLASTX | 255 | 1e−28 | 80 |
| 5945 | 698 | 700997253H1 | SOYMON018 | g1353352 | BLASTX | 260 | 1e−28 | 65 |
| 5946 | 698 | 700995571H1 | SOYMON011 | g1353352 | BLASTX | 260 | 1e−28 | 63 |
| 5947 | 698 | 700648011H1 | SOYMON003 | g1353352 | BLASTX | 239 | 1e−25 | 66 |
| 5948 | 698 | 700850732H1 | SOYMON023 | g1353352 | BLASTX | 204 | 1e−21 | 78 |
| 5949 | 698 | 700557773H1 | SOYMON001 | g1353352 | BLASTX | 208 | 1e−21 | 81 |
| 5950 | 698 | 700874138H1 | SOYMON018 | g1353352 | BLASTX | 208 | 1e−21 | 81 |
| 5951 | 698 | 700559725H1 | SOYMON001 | g1353352 | BLASTX | 201 | 1e−20 | 82 |
| 5952 | 698 | 701105639H1 | SOYMON036 | g1353352 | BLASTX | 202 | 1e−20 | 80 |
| 5953 | 698 | 700994494H1 | SOYMON011 | g1353352 | BLASTX | 186 | 1e−18 | 83 |
| 5954 | 698 | 700738237H1 | SOYMON012 | g1353352 | BLASTX | 186 | 1e−18 | 78 |
| 5955 | 698 | 700555071H1 | SOYMON001 | g1353352 | BLASTX | 186 | 1e−18 | 83 |
| 5956 | 698 | 700786177H2 | SOYMON011 | g1353352 | BLASTX | 171 | 1e−17 | 54 |
| 5957 | 698 | 700554414H1 | SOYMON001 | g1353352 | BLASTX | 176 | 1e−17 | 84 |
| 5958 | 698 | 700741128H1 | SOYMON012 | g1353352 | BLASTX | 176 | 1e−17 | 82 |
| 5959 | 698 | 700965158H1 | SOYMON022 | g1353352 | BLASTX | 176 | 1e−17 | 82 |
| 5960 | 698 | 700685250H1 | SOYMON008 | g1353352 | BLASTX | 179 | 1e−17 | 80 |
| 5961 | 698 | 700991457H1 | SOYMON011 | g1353352 | BLASTX | 180 | 1e−17 | 82 |
| 5962 | 698 | 700684192H1 | SOYMON008 | g1353352 | BLASTX | 180 | 1e−17 | 82 |
| 5963 | 698 | 700871122H1 | SOYMON018 | g1353352 | BLASTX | 180 | 1e−17 | 82 |
| 5964 | 698 | 700997304H1 | SOYMON018 | g1353352 | BLASTX | 182 | 1e−17 | 70 |
| 5965 | 698 | 700685731H1 | SOYMON008 | g1353352 | BLASTX | 172 | 1e−16 | 82 |
| 5966 | 698 | 700685724H1 | SOYMON008 | g1353352 | BLASTX | 172 | 1e−16 | 82 |
| 5967 | 698 | 700739069H1 | SOYMON012 | g1353352 | BLASTX | 161 | 1e−15 | 83 |
| 5968 | 698 | 700741337H1 | SOYMON012 | g1353352 | BLASTX | 164 | 1e−15 | 81 |
| 5969 | 698 | 700683155H1 | SOYMON008 | g1353352 | BLASTX | 164 | 1e−15 | 81 |
| 5970 | 698 | 700994202H1 | SOYMON011 | g1353352 | BLASTX | 165 | 1e−15 | 73 |
| 5971 | 698 | 700555575H1 | SOYMON001 | g1353352 | BLASTX | 166 | 1e−15 | 79 |
| 5972 | 698 | 701000739H1 | SOYMON018 | g1353352 | BLASTX | 167 | 1e−15 | 63 |
| 5973 | 698 | 700740011H1 | SOYMON012 | g1353352 | BLASTX | 153 | 1e−14 | 83 |
| 5974 | 698 | 700994043H1 | SOYMON011 | g1353352 | BLASTX | 157 | 1e−14 | 81 |
| 5975 | 698 | 700555709H1 | SOYMON001 | g1353352 | BLASTX | 87 | 1e−12 | 76 |
| 5976 | 698 | 701107588H1 | SOYMON036 | g1353352 | BLASTX | 114 | 1e−12 | 68 |
| 5977 | 698 | 700871057H1 | SOYMON018 | g1353352 | BLASTX | 139 | 1e−12 | 77 |
| 5978 | 698 | 700744973H1 | SOYMON013 | g1353352 | BLASTX | 141 | 1e−12 | 79 |
| 5979 | 698 | 700741744H1 | SOYMON012 | g1353352 | BLASTX | 141 | 1e−12 | 79 |
| 5980 | 698 | 700792044H1 | SOYMON011 | g1353352 | BLASTX | 142 | 1e−12 | 63 |
| 5981 | 698 | 700993716H1 | SOYMON011 | g1353352 | BLASTX | 83 | 1e−11 | 83 |
| 5982 | 698 | 700684326H1 | SOYMON008 | g1353352 | BLASTX | 137 | 1e−11 | 81 |
| 5983 | 698 | 700989256H1 | SOYMON011 | g1353352 | BLASTX | 124 | 1e−10 | 77 |
| 5984 | 698 | 700791590H1 | SOYMON011 | g1353352 | BLASTX | 130 | 1e−10 | 78 |
| 5985 | 698 | 700872519H1 | SOYMON018 | g1353352 | BLASTX | 78 | 1e−9 | 78 |
| 5986 | 698 | 700645949H1 | SOYMON011 | g1353352 | BLASTX | 106 | 1e−9 | 63 |
| 5987 | 698 | 700996252H1 | SOYMON018 | g1353352 | BLASTX | 125 | 1e−9 | 77 |
| 5988 | 698 | 700876656H1 | SOYMON018 | g1353352 | BLASTX | 74 | 1e−8 | 79 |
| 5989 | 698 | 700874318H1 | SOYMON018 | g1353352 | BLASTX | 113 | 1e−8 | 73 |
| 5990 | 698 | 700737927H1 | SOYMON012 | g1353352 | BLASTX | 114 | 1e−8 | 73 |
| 5991 | 9687 | 700740448H1 | SOYMON012 | g1353352 | BLASTX | 262 | 1e−29 | 57 |
| 5992 | 9687 | 700954623H1 | SOYMON022 | g1353352 | BLASTX | 265 | 1e−29 | 56 |
| 5993 | 9687 | 701142577H1 | SOYMON038 | g1353352 | BLASTX | 247 | 1e−27 | 56 |
| 5994 | 9687 | 701000510H1 | SOYMON018 | g1353352 | BLASTX | 235 | 1e−25 | 65 |
| 5995 | 9687 | 700874683H1 | SOYMON018 | g1353352 | BLASTX | 212 | 1e−22 | 58 |
| 5996 | 9687 | 700874576H1 | SOYMON018 | g1353352 | BLASTX | 117 | 1e−17 | 54 |
| 5997 | 9687 | 700999910H1 | SOYMON018 | g1353352 | BLASTX | 163 | 1e−15 | 54 |
| 5998 | 9687 | 701001711H1 | SOYMON018 | g1353352 | BLASTX | 116 | 1e−8 | 64 |
| 5999 | 10017 | LIB3030-005-Q1-B1-F1 | LIB3030 | g296204 | BLASTX | 159 | 1e−38 | 72 |
| 6000 | 10017 | LIB3051-078-Q1-K1-B5 | LIB3051 | g296204 | BLASTX | 207 | 1e−37 | 61 |
| 6001 | 10017 | LIB3051-006-Q1-K1-D5 | LIB3051 | g296203 | BLASTN | 543 | 1e−34 | 68 |

TABLE A*-continued

| Seq No. | Cluster ID | CloneID | Library | NCBI gi | Method | Score | P-value | % Ident |
|---|---|---|---|---|---|---|---|---|
| 6002 | 10017 | LIB3051-006-Q1-E1-D5 | LIB3051 | g469147 | BLASTN | 306 | 1e−14 | 69 |
| 6003 | 10017 | LIB3051-113-Q1-K1-B4 | LIB3051 | g469147 | BLASTN | 301 | 1e−13 | 63 |
| 6004 | 698 | LIB3028-005-Q1-B1-A11 | LIB3028 | g1353352 | BLASTX | 110 | 1e−34 | 69 |

MAIZE NADP-DEPENDENT MALIC ENZYME

| Seq No. | Cluster ID | CloneID | Library | NCBI gi | Method | Score | P-value | % Ident |
|---|---|---|---|---|---|---|---|---|
| 6005 | -700041501 | 700041501H1 | SATMON004 | g168527 | BLASTN | 529 | 1e−35 | 93 |
| 6006 | -700051224 | 700051224H1 | SATMON003 | g20468 | BLASTN | 514 | 1e−32 | 81 |
| 6007 | -700073375 | 700073375H1 | SATMON007 | g168527 | BLASTN | 584 | 1e−58 | 77 |
| 6008 | -700101813 | 700101813H1 | SATMON009 | g168527 | BLASTN | 920 | 1e−88 | 100 |
| 6009 | -700104958 | 700104958H1 | SATMON010 | g168527 | BLASTN | 363 | 1e−19 | 92 |
| 6010 | -700219021 | 700219021H1 | SATMON011 | g1785859 | BLASTN | 467 | 1e−28 | 80 |
| 6011 | -700346164 | 700346164H1 | SATMON021 | g510876 | BLASTX | 102 | 1e−18 | 78 |
| 6012 | -700453338 | 700453338H1 | SATMON028 | g20468 | BLASTN | 716 | 1e−50 | 79 |
| 6013 | -700460886 | 700460886H1 | SATMON031 | g168527 | BLASTN | 191 | 1e−14 | 92 |
| 6014 | -700573176 | 700573176H1 | SATMON030 | g168527 | BLASTN | 277 | 1e−25 | 80 |
| 6015 | -701182650 | 701182650H1 | SATMONN06 | g169326 | BLASTN | 572 | 1e−51 | 79 |
| 6016 | 10304 | 700349609H1 | SATMON023 | g20468 | BLASTN | 939 | 1e−69 | 81 |
| 6017 | 10304 | 700050528H1 | SATMON003 | g20468 | BLASTN | 945 | 1e−69 | 80 |
| 6018 | 10304 | 700242979H1 | SATMON010 | g20468 | BLASTN | 926 | 1e−68 | 82 |
| 6019 | 10304 | 700577075H1 | SATMON031 | g20468 | BLASTN | 919 | 1e−67 | 81 |
| 6020 | 10304 | 700381724H1 | SATMON023 | g20468 | BLASTN | 507 | 1e−59 | 76 |
| 6021 | 18769 | 700050667H1 | SATMON003 | g20468 | BLASTN | 452 | 1e−29 | 76 |
| 6022 | 18769 | 700076676H1 | SATMON007 | g20469 | BLASTX | 181 | 1e−18 | 77 |
| 6023 | 18769 | 700155440H1 | SATMON007 | g20469 | BLASTX | 140 | 1e−12 | 73 |
| 6024 | 2190 | 700071978H1 | SATMON007 | g425803 | BLASTN | 1045 | 1e−80 | 83 |
| 6025 | 2190 | 700202802H1 | SATMON003 | g425803 | BLASTN | 440 | 1e−79 | 81 |
| 6026 | 2190 | 700104846H1 | SATMON010 | g425803 | BLASTN | 537 | 1e−73 | 83 |
| 6027 | 2190 | 700444338H1 | SATMON027 | g425803 | BLASTN | 677 | 1e−65 | 84 |
| 6028 | 2190 | 700457069H1 | SATMON029 | g425803 | BLASTN | 428 | 1e−56 | 81 |
| 6029 | 2190 | 700457021H1 | SATMON029 | g425803 | BLASTN | 753 | 1e−56 | 83 |
| 6030 | 2190 | 701181152H1 | SATMONN06 | g1785859 | BLASTN | 577 | 1e−54 | 78 |
| 6031 | 2190 | 700445983H1 | SATMON027 | g1785859 | BLASTN | 607 | 1e−52 | 74 |
| 6032 | 2190 | 700142607H2 | SATMON013 | g1785859 | BLASTN | 684 | 1e−48 | 78 |
| 6033 | 412 | 700097657H1 | SATMON009 | g168527 | BLASTN | 1648 | 1e−128 | 99 |
| 6034 | 412 | 700098574H1 | SATMON009 | g168527 | BLASTN | 1605 | 1e−124 | 99 |
| 6035 | 412 | 700099850H1 | SATMON009 | g168527 | BLASTN | 1537 | 1e−119 | 97 |
| 6036 | 412 | 700097455H1 | SATMON009 | g168527 | BLASTN | 1527 | 1e−118 | 99 |
| 6037 | 412 | 700097222H1 | SATMON009 | g168527 | BLASTN | 1530 | 1e−118 | 98 |
| 6038 | 412 | 700097391H1 | SATMON009 | g168527 | BLASTN | 1520 | 1e−117 | 98 |
| 6039 | 412 | 700097849H1 | SATMON009 | g168527 | BLASTN | 1504 | 1e−116 | 99 |
| 6040 | 412 | 700101666H1 | SATMON009 | g168527 | BLASTN | 1495 | 1e−115 | 100 |
| 6041 | 412 | 700099890H1 | SATMON009 | g168527 | BLASTN | 1468 | 1e−113 | 98 |
| 6042 | 412 | 700097237H1 | SATMON009 | g168527 | BLASTN | 1313 | 1e−112 | 98 |
| 6043 | 412 | 700101278H1 | SATMON009 | g168527 | BLASTN | 1441 | 1e−111 | 99 |
| 6044 | 412 | 700101431H1 | SATMON009 | g168527 | BLASTN | 1450 | 1e−111 | 100 |
| 6045 | 412 | 700100860H1 | SATMON009 | g168527 | BLASTN | 1431 | 1e−110 | 99 |
| 6046 | 412 | 700581218H1 | SATMON031 | g168527 | BLASTN | 1403 | 1e−108 | 98 |
| 6047 | 412 | 700101446H1 | SATMON009 | g168527 | BLASTN | 1407 | 1e−108 | 99 |
| 6048 | 412 | 700044315H1 | SATMON004 | g168527 | BLASTN | 1390 | 1e−106 | 100 |
| 6049 | 412 | 700045610H1 | SATMON004 | g168527 | BLASTN | 1301 | 1e−105 | 98 |
| 6050 | 412 | 700434125H1 | SATMONN01 | g168527 | BLASTN | 1374 | 1e−105 | 97 |
| 6051 | 412 | 700041705H1 | SATMON004 | g168527 | BLASTN | 1311 | 1e−104 | 99 |
| 6052 | 412 | 700104088H1 | SATMON010 | g168527 | BLASTN | 1361 | 1e−104 | 92 |
| 6053 | 412 | 700614919H1 | SATMON033 | g168527 | BLASTN | 1103 | 1e−103 | 86 |
| 6054 | 412 | 700613108H1 | SATMON033 | g168527 | BLASTN | 1345 | 1e−103 | 89 |
| 6055 | 412 | 700042025H1 | SATMON004 | g168527 | BLASTN | 1352 | 1e−103 | 99 |
| 6056 | 412 | 700467944H1 | SATMON025 | g168527 | BLASTN | 1353 | 1e−103 | 95 |
| 6057 | 412 | 700617354H1 | SATMON033 | g168527 | BLASTN | 1354 | 1e−103 | 89 |
| 6058 | 412 | 700095156H1 | SATMON008 | g168527 | BLASTN | 1354 | 1e−103 | 92 |
| 6059 | 412 | 700448457H1 | SATMON027 | g168527 | BLASTN | 722 | 1e−102 | 93 |
| 6060 | 412 | 700581224H1 | SATMON031 | g168527 | BLASTN | 872 | 1e−101 | 98 |
| 6061 | 412 | 700426724H1 | SATMONN01 | g168527 | BLASTN | 1322 | 1e−101 | 98 |
| 6062 | 412 | 700105096H1 | SATMON010 | g168527 | BLASTN | 707 | 1e−100 | 93 |
| 6063 | 412 | 700045272H1 | SATMON004 | g168527 | BLASTN | 1311 | 1e−100 | 99 |
| 6064 | 412 | 700577375H1 | SATMON031 | g168527 | BLASTN | 1300 | 1e−99 | 100 |
| 6065 | 412 | 700044113H1 | SATMON004 | g168527 | BLASTN | 1300 | 1e−99 | 100 |
| 6066 | 412 | 700042068H1 | SATMON004 | g168527 | BLASTN | 1301 | 1e−99 | 99 |
| 6067 | 412 | 700582457H1 | SATMON031 | g168527 | BLASTN | 1305 | 1e−99 | 98 |
| 6068 | 412 | 700580693H1 | SATMON031 | g168527 | BLASTN | 975 | 1e−98 | 97 |
| 6069 | 412 | 700577922H1 | SATMON031 | g168527 | BLASTN | 1111 | 1e−98 | 95 |
| 6070 | 412 | 700043222H1 | SATMON004 | g168527 | BLASTN | 1289 | 1e−98 | 99 |
| 6071 | 412 | 700103882H1 | SATMON010 | g168527 | BLASTN | 1277 | 1e−97 | 92 |
| 6072 | 412 | 700579779H1 | SATMON031 | g168527 | BLASTN | 1282 | 1e−97 | 98 |
| 6073 | 412 | 700615410H1 | SATMON033 | g168527 | BLASTN | 829 | 1e−96 | 91 |

TABLE A*-continued

| Seq No. | Cluster ID | CloneID | Library | NCBI gi | Method | Score | P-value | % Ident |
|---|---|---|---|---|---|---|---|---|
| 6074 | 412 | 700439978H1 | SATMON026 | g168527 | BLASTN | 1264 | 1e−96 | 99 |
| 6075 | 412 | 700045066H1 | SATMON004 | g168527 | BLASTN | 1268 | 1e−96 | 98 |
| 6076 | 412 | 700439024H1 | SATMON026 | g168527 | BLASTN | 1041 | 1e−95 | 96 |
| 6077 | 412 | 700263465H1 | SATMON017 | g168527 | BLASTN | 1088 | 1e−94 | 90 |
| 6078 | 412 | 700046417H1 | SATMON004 | g168527 | BLASTN | 1240 | 1e−94 | 100 |
| 6079 | 412 | 700347845H1 | SATMON023 | g168527 | BLASTN | 1241 | 1e−94 | 92 |
| 6080 | 412 | 700043227H1 | SATMON004 | g168527 | BLASTN | 1241 | 1e−94 | 97 |
| 6081 | 412 | 700469957H1 | SATMON025 | g168527 | BLASTN | 1243 | 1e−94 | 95 |
| 6082 | 412 | 700044725H1 | SATMON004 | g168527 | BLASTN | 1246 | 1e−94 | 99 |
| 6083 | 412 | 700615834H1 | SATMON033 | g168527 | BLASTN | 777 | 1e−93 | 93 |
| 6084 | 412 | 700224349H1 | SATMON011 | g168527 | BLASTN | 1230 | 1e−93 | 92 |
| 6085 | 412 | 700438840H1 | SATMON026 | g168527 | BLASTN | 675 | 1e−92 | 100 |
| 6086 | 412 | 700465188H1 | SATMON025 | g168527 | BLASTN | 1133 | 1e−92 | 91 |
| 6087 | 412 | 700223493H1 | SATMON011 | g168527 | BLASTN | 1222 | 1e−92 | 94 |
| 6088 | 412 | 700442430H1 | SATMON026 | g168527 | BLASTN | 490 | 1e−91 | 95 |
| 6089 | 412 | 700479665H1 | SATMON034 | g168527 | BLASTN | 1199 | 1e−91 | 93 |
| 6090 | 412 | 700242318H1 | SATMON010 | g168527 | BLASTN | 1200 | 1e−91 | 96 |
| 6091 | 412 | 700262339H1 | SATMON017 | g168527 | BLASTN | 924 | 1e−90 | 91 |
| 6092 | 412 | 700551426H1 | SATMON022 | g168527 | BLASTN | 1197 | 1e−90 | 93 |
| 6093 | 412 | 700580501H1 | SATMON031 | g168527 | BLASTN | 674 | 1e−89 | 91 |
| 6094 | 412 | 700430624H1 | SATMONN01 | g168527 | BLASTN | 839 | 1e−89 | 96 |
| 6095 | 412 | 700798989H1 | SATMON036 | g168527 | BLASTN | 1176 | 1e−89 | 90 |
| 6096 | 412 | 700438471H1 | SATMON026 | g168527 | BLASTN | 1183 | 1e−89 | 96 |
| 6097 | 412 | 700572903H1 | SATMON030 | g168527 | BLASTN | 771 | 1e−88 | 89 |
| 6098 | 412 | 700083411H1 | SATMON011 | g168527 | BLASTN | 1096 | 1e−88 | 92 |
| 6099 | 412 | 700442605H1 | SATMON026 | g168527 | BLASTN | 1170 | 1e−88 | 88 |
| 6100 | 412 | 700224532H1 | SATMON011 | g168527 | BLASTN | 1170 | 1e−88 | 92 |
| 6101 | 412 | 700572585H1 | SATMON030 | g168527 | BLASTN | 912 | 1e−87 | 87 |
| 6102 | 412 | 700083289H1 | SATMON011 | g168527 | BLASTN | 1155 | 1e−87 | 90 |
| 6103 | 412 | 700612607H1 | SATMON033 | g168527 | BLASTN | 634 | 1e−86 | 91 |
| 6104 | 412 | 700429569H1 | SATMONN01 | g168527 | BLASTN | 1115 | 1e−84 | 90 |
| 6105 | 412 | 700048813H1 | SATMON003 | g168527 | BLASTN | 844 | 1e−83 | 89 |
| 6106 | 412 | 700422905H1 | SATMONN01 | g168527 | BLASTN | 872 | 1e−83 | 93 |
| 6107 | 412 | 700106553H1 | SATMON010 | g168527 | BLASTN | 888 | 1e−83 | 87 |
| 6108 | 412 | 700101622H1 | SATMON009 | g168527 | BLASTN | 1105 | 1e−83 | 100 |
| 6109 | 412 | 700168331H1 | SATMON013 | g168527 | BLASTN | 1108 | 1e−83 | 90 |
| 6110 | 412 | 701183573H1 | SATMONN06 | g168527 | BLASTN | 1098 | 1e−82 | 89 |
| 6111 | 412 | 700355825H1 | SATMON024 | g168527 | BLASTN | 1102 | 1e−82 | 88 |
| 6112 | 412 | 700171967H1 | SATMON013 | g168527 | BLASTN | 1085 | 1e−81 | 92 |
| 6113 | 412 | 700239492H1 | SATMON010 | g168527 | BLASTN | 1086 | 1e−81 | 91 |
| 6114 | 412 | 701160628H1 | SATMONN04 | g168527 | BLASTN | 624 | 1e−79 | 89 |
| 6115 | 412 | 700020733H1 | SATMON001 | g168527 | BLASTN | 1048 | 1e−78 | 92 |
| 6116 | 412 | 700575032H1 | SATMON030 | g168527 | BLASTN | 493 | 1e−77 | 91 |
| 6117 | 412 | 700241204H1 | SATMON010 | g168527 | BLASTN | 812 | 1e−77 | 88 |
| 6118 | 412 | 700447091H1 | SATMON027 | g168527 | BLASTN | 991 | 1e−77 | 91 |
| 6119 | 412 | 700469827H1 | SATMON025 | g168527 | BLASTN | 643 | 1e−76 | 87 |
| 6120 | 412 | 700043868H1 | SATMON004 | g168527 | BLASTN | 1020 | 1e−76 | 100 |
| 6121 | 412 | 700167416H1 | SATMON013 | g168527 | BLASTN | 1021 | 1e−76 | 92 |
| 6122 | 412 | 700166313H1 | SATMON013 | g168527 | BLASTN | 1010 | 1e−75 | 93 |
| 6123 | 412 | 700477627H1 | SATMON025 | g168527 | BLASTN | 1010 | 1e−75 | 88 |
| 6124 | 412 | 700043873H1 | SATMON004 | g168527 | BLASTN | 1015 | 1e−75 | 100 |
| 6125 | 412 | 700027363H1 | SATMON003 | g168527 | BLASTN | 402 | 1e−73 | 92 |
| 6126 | 412 | 700569811H1 | SATMON030 | g168527 | BLASTN | 593 | 1e−71 | 89 |
| 6127 | 412 | 700551661H1 | SATMON022 | g168527 | BLASTN | 860 | 1e−71 | 86 |
| 6128 | 412 | 700613723H1 | SATMON033 | g168527 | BLASTN | 962 | 1e−71 | 86 |
| 6129 | 412 | 700171193H1 | SATMON013 | g168527 | BLASTN | 935 | 1e−69 | 89 |
| 6130 | 412 | 700164679H1 | SATMON013 | g168527 | BLASTN | 924 | 1e−68 | 88 |
| 6131 | 412 | 700570921H1 | SATMON030 | g168527 | BLASTN | 455 | 1e−67 | 88 |
| 6132 | 412 | 701160615H1 | SATMONN04 | g168527 | BLASTN | 694 | 1e−67 | 84 |
| 6133 | 412 | 700154717H1 | SATMON007 | g168527 | BLASTN | 893 | 1e−65 | 90 |
| 6134 | 412 | 700475530H1 | SATMON025 | g168527 | BLASTN | 328 | 1e−63 | 90 |
| 6135 | 412 | 700203726H1 | SATMON003 | g168527 | BLASTN | 410 | 1e−63 | 91 |
| 6136 | 412 | 700241493H1 | SATMON010 | g168527 | BLASTN | 796 | 1e−63 | 89 |
| 6137 | 412 | 700438637H1 | SATMON026 | g168527 | BLASTN | 493 | 1e−62 | 96 |
| 6138 | 412 | 700100702H1 | SATMON009 | g168527 | BLASTN | 848 | 1e−61 | 98 |
| 6139 | 412 | 700223081H1 | SATMON011 | g168527 | BLASTN | 649 | 1e−56 | 89 |
| 6140 | 412 | 700099413H1 | SATMON009 | g168527 | BLASTN | 767 | 1e−55 | 83 |
| 6141 | 412 | 700613195H1 | SATMON033 | g168527 | BLASTN | 633 | 1e−53 | 83 |
| 6142 | 412 | 700158857H1 | SATMON012 | g168527 | BLASTN | 745 | 1e−53 | 89 |
| 6143 | 412 | 700439831H1 | SATMON026 | g168527 | BLASTN | 498 | 1e−50 | 95 |
| 6144 | 412 | 700017622H1 | SATMON001 | g168527 | BLASTN | 662 | 1e−46 | 89 |
| 6145 | 412 | 700224833H1 | SATMON011 | g168527 | BLASTN | 636 | 1e−44 | 89 |
| 6146 | 412 | 700099061H1 | SATMON009 | g168527 | BLASTN | 637 | 1e−44 | 95 |
| 6147 | 412 | 700577851H1 | SATMON031 | g168527 | BLASTN | 637 | 1e−44 | 95 |
| 6148 | 412 | 700100884H1 | SATMON009 | g168527 | BLASTN | 637 | 1e−44 | 95 |
| 6149 | 412 | 700466638H1 | SATMON025 | g168527 | BLASTN | 640 | 1e−44 | 85 |
| 6150 | 412 | 700614366H1 | SATMON033 | g415314 | BLASTN | 644 | 1e−44 | 88 |

TABLE A*-continued

| Seq No. | Cluster ID | CloneID | Library | NCBI gi | Method | Score | P-value | % Ident |
|---|---|---|---|---|---|---|---|---|
| 6151 | 412 | 700084389H1 | SATMON011 | g168527 | BLASTN | 545 | 1e-43 | 90 |
| 6152 | 412 | 700090184H1 | SATMON011 | g168527 | BLASTN | 615 | 1e-42 | 100 |
| 6153 | 412 | 700099462H1 | SATMON009 | g168527 | BLASTN | 615 | 1e-42 | 100 |
| 6154 | 412 | 700098372H1 | SATMON009 | g168527 | BLASTN | 596 | 1e-40 | 99 |
| 6155 | 412 | 700432379H1 | SATMONN01 | g168527 | BLASTN | 341 | 1e-39 | 94 |
| 6156 | 412 | 700101636H1 | SATMON009 | g168527 | BLASTN | 524 | 1e-38 | 92 |
| 6157 | 412 | 700090392H1 | SATMON011 | g168527 | BLASTN | 532 | 1e-35 | 90 |
| 6158 | 412 | 700282016H1 | SATMON022 | g415314 | BLASTN | 534 | 1e-35 | 86 |
| 6159 | 412 | 700042404H1 | SATMON004 | g168527 | BLASTN | 525 | 1e-34 | 100 |
| 6160 | 412 | 700465190H1 | SATMON025 | g168527 | BLASTN | 509 | 1e-33 | 87 |
| 6161 | 412 | 700260024H1 | SATMON017 | g168527 | BLASTN | 210 | 1e-32 | 94 |
| 6162 | 412 | 700579166H1 | SATMON031 | g168527 | BLASTN | 413 | 1e-32 | 96 |
| 6163 | 412 | 700049441H1 | SATMON003 | g168527 | BLASTN | 303 | 1e-31 | 90 |
| 6164 | 412 | 700618285H1 | SATMON033 | g168527 | BLASTN | 454 | 1e-28 | 85 |
| 6165 | 412 | 700259602H1 | SATMON017 | g168527 | BLASTN | 297 | 1e-26 | 89 |
| 6166 | 412 | 700467465H1 | SATMON025 | g168527 | BLASTN | 420 | 1e-26 | 96 |
| 6167 | 412 | 700215437H1 | SATMON016 | g168527 | BLASTN | 306 | 1e-20 | 86 |
| 6168 | 412 | 700265281H1 | SATMON017 | g168527 | BLASTN | 359 | 1e-19 | 89 |
| 6169 | 6503 | 700083127H1 | SATMON011 | g168528 | BLASTX | 124 | 1e-10 | 92 |
| 6170 | 9238 | 700336628H1 | SATMON019 | g168527 | BLASTN | 435 | 1e-34 | 74 |
| 6171 | 9238 | 700017544H1 | SATMON001 | g168527 | BLASTN | 513 | 1e-33 | 74 |
| 6172 | -L1485987 | LIB148-042-Q1-E1-D11 | LIB148 | g415314 | BLASTN | 566 | 1e-38 | 76 |
| 6173 | -L30602419 | LIB3060-012-Q1-K1-E8 | LIB3060 | g168527 | BLASTN | 723 | 1e-51 | 96 |
| 6174 | -L30611342 | LIB3061-002-Q1-K1-H10 | LIB3061 | g168527 | BLASTN | 633 | 1e-43 | 77 |
| 6175 | -L30662912 | LIB3066-008-Q1-K1-A2 | LIB3066 | g2911148 | BLASTX | 147 | 1e-29 | 84 |
| 6176 | -L30664918 | LIB3066-021-Q1-K1-B5 | LIB3066 | g168527 | BLASTN | 838 | 1e-60 | 71 |
| 6177 | -L30672727 | LIB3067-039-Q1-K1-C10 | LIB3067 | g168527 | BLASTN | 401 | 1e-42 | 82 |
| 6178 | -L30782241 | LIB3078-007-Q1-K1-A1 | LIB3078 | g168527 | BLASTN | 393 | 1e-36 | 79 |
| 6179 | -L30783451 | LIB3078-050-Q1-K1-G11 | LIB3078 | g168527 | BLASTN | 199 | 1e-9 | 83 |
| 6180 | -L30784158 | LIB3078-035-Q1-K1-H5 | LIB3078 | g168527 | BLASTN | 201 | 1e-14 | 91 |
| 6181 | 30424 | LIB3060-024-Q1-K1-D9 | LIB3060 | g415314 | BLASTN | 1355 | 1e-104 | 79 |
| 6182 | 412 | LIB3078-022-Q1-K1-D10 | LIB3078 | g168527 | BLASTN | 2209 | 1e-175 | 95 |
| 6183 | 412 | LIB3060-021-Q1-K1-G10 | LIB3060 | g168527 | BLASTN | 2203 | 1e-174 | 99 |
| 6184 | 412 | LIB189-006-Q1-E1-D2 | LIB189 | g168527 | BLASTN | 2121 | 1e-167 | 99 |
| 6185 | 412 | LIB189-010-Q1-E1-C4 | LIB189 | g168527 | BLASTN | 1749 | 1e-164 | 98 |
| 6186 | 412 | LIB189-029-Q1-E1-A5 | LIB189 | g168527 | BLASTN | 2067 | 1e-163 | 98 |
| 6187 | 412 | LIB36-021-Q1-E1-D12 | LIB36 | g168527 | BLASTN | 2011 | 1e-158 | 97 |
| 6188 | 412 | LIB36-003-Q1-E1-B4 | LIB36 | g168527 | BLASTN | 1988 | 1e-156 | 95 |
| 6189 | 412 | LIB36-017-Q1-E1-D7 | LIB36 | g168527 | BLASTN | 1503 | 1e-155 | 98 |
| 6190 | 412 | LIB189-018-Q1-E1-D11 | LIB189 | g168527 | BLASTN | 1977 | 1e-155 | 97 |
| 6191 | 412 | LIB189-014-Q1-E1-D11 | LIB189 | g168527 | BLASTN | 1941 | 1e-152 | 97 |
| 6192 | 412 | LIB3078-049-Q1-K1-G10 | LIB3078 | g168527 | BLASTN | 1810 | 1e-151 | 94 |
| 6193 | 412 | LIB3078-012-Q1-K1-E8 | LIB3078 | g168527 | BLASTN | 1874 | 1e-151 | 93 |
| 6194 | 412 | LIB36-018-Q1-E1-B9 | LIB36 | g168527 | BLASTN | 1466 | 1e-150 | 97 |
| 6195 | 412 | LIB36-012-Q1-E1-H9 | LIB36 | g168527 | BLASTN | 1901 | 1e-149 | 98 |
| 6196 | 412 | LIB189-027-Q1-E1-C5 | LIB189 | g168527 | BLASTN | 1903 | 1e-149 | 95 |
| 6197 | 412 | LIB84-005-Q1-E1-A11 | LIB84 | g168527 | BLASTN | 1889 | 1e-148 | 96 |
| 6198 | 412 | LIB189-018-Q1-E1-G7 | LIB189 | g168527 | BLASTN | 1814 | 1e-144 | 97 |
| 6199 | 412 | LIB3079-004-Q1-K1-A10 | LIB3079 | g168527 | BLASTN | 1724 | 1e-140 | 91 |

TABLE A*-continued

| Seq No. | Cluster ID | CloneID | Library | NCBI gi | Method | Score | P-value | % Ident |
|---|---|---|---|---|---|---|---|---|
| 6200 | 412 | LIB189-028-Q1-E1-F11 | LIB189 | g168527 | BLASTN | 1740 | 1e-140 | 99 |
| 6201 | 412 | LIB84-029-Q1-E1-A6 | LIB84 | g168527 | BLASTN | 1795 | 1e-140 | 99 |
| 6202 | 412 | LIB3060-002-Q1-K2-A8 | LIB3060 | g168527 | BLASTN | 1779 | 1e-139 | 95 |
| 6203 | 412 | LIB3067-049-Q1-K1-F5 | LIB3067 | g168527 | BLASTN | 1098 | 1e-137 | 88 |
| 6204 | 412 | LIB3062-026-Q1-K1-C8 | LIB3062 | g168527 | BLASTN | 1428 | 1e-135 | 89 |
| 6205 | 412 | LIB3059-011-Q1-K1-C4 | LIB3059 | g168527 | BLASTN | 1651 | 1e-128 | 87 |
| 6206 | 412 | LIB3061-002-Q1-K2-H10 | LIB3061 | g168527 | BLASTN | 1618 | 1e-125 | 89 |
| 6207 | 412 | LIB3060-008-Q1-K1-H3 | LIB3060 | g168527 | BLASTN | 990 | 1e-122 | 97 |
| 6208 | 412 | LIB3060-020-Q1-K1-E10 | LIB3060 | g168527 | BLASTN | 1322 | 1e-121 | 89 |
| 6209 | 412 | LIB189-032-Q1-E1-E7 | LIB189 | g168527 | BLASTN | 680 | 1e-120 | 94 |
| 6210 | 412 | LIB36-019-Q1-E1-F11 | LIB36 | g168527 | BLASTN | 1197 | 1e-115 | 97 |
| 6211 | 412 | LIB3062-038-Q1-K1-D1 | LIB3062 | g168527 | BLASTN | 1498 | 1e-115 | 91 |
| 6212 | 412 | LIB189-029-Q1-E1-A4 | LIB189 | g168527 | BLASTN | 1175 | 1e-113 | 95 |
| 6213 | 412 | LIB36-022-Q1-E1-F12 | LIB36 | g168527 | BLASTN | 1393 | 1e-107 | 98 |
| 6214 | 412 | LIB3079-001-Q1-K1-H3 | LIB3079 | g168527 | BLASTN | 1243 | 1e-103 | 82 |
| 6215 | 412 | LIB189-014-Q1-E1-D12 | LIB189 | g168527 | BLASTN | 855 | 1e-99 | 91 |
| 6216 | 412 | LIB189-026-Q1-E1-C1 | LIB189 | g168527 | BLASTN | 1167 | 1e-93 | 94 |
| 6217 | 412 | LIB3079-001-Q1-K1-H5 | LIB3079 | g168527 | BLASTN | 480 | 1e-78 | 84 |
| 6218 | 412 | LIB36-008-Q1-E1-C5 | LIB36 | g168527 | BLASTN | 576 | 1e-75 | 97 |
| 6219 | 412 | LIB83-015-Q1-E1-G7 | LIB83 | g168527 | BLASTN | 446 | 1e-59 | 92 |
| 6220 | 412 | LIB3062-024-Q1-K1-D2 | LIB3062 | g168527 | BLASTN | 455 | 1e-53 | 77 |
| 6221 | 412 | LIB3062-026-Q1-K1-C4 | LIB3062 | g168527 | BLASTN | 561 | 1e-50 | 78 |
| 6222 | 412 | LIB83-013-Q1-E1-E12 | LIB83 | g168527 | BLASTN | 637 | 1e-44 | 95 |
| 6223 | 412 | LIB83-002-Q1-E1-F4 | LIB83 | g168527 | BLASTN | 564 | 1e-43 | 97 |
| SOYBEAN NADP-DEPENDENT MALIC ENZYME | | | | | | | | |
| 6224 | -700698057 | 700698057H1 | SOYMON015 | g168527 | BLASTN | 513 | 1e-67 | 90 |
| 6225 | -700744209 | 700744209H1 | SOYMON013 | g1679885 | BLASTX | 138 | 1e-12 | 69 |
| 6226 | -700979875 | 700979875H2 | SOYMON009 | g20468 | BLASTN | 236 | 1e-8 | 82 |
| 6227 | -701013601 | 701013601H1 | SOYMON019 | g20469 | BLASTX | 184 | 1e-18 | 60 |
| 6228 | -701054477 | 701054477H1 | SOYMON032 | g169326 | BLASTN | 1122 | 1e-84 | 94 |
| 6229 | -701206630 | 701206630H1 | SOYMON035 | g1679885 | BLASTX | 142 | 1e-14 | 85 |
| 6230 | 11537 | 700653458H1 | SOYMON003 | g20468 | BLASTN | 1173 | 1e-88 | 83 |
| 6231 | 11537 | 700650905H1 | SOYMON003 | g20468 | BLASTN | 886 | 1e-74 | 83 |
| 6232 | 11537 | 701141562H1 | SOYMON038 | g20468 | BLASTN | 532 | 1e-52 | 78 |
| 6233 | 11537 | 701144577H1 | SOYMON031 | g20468 | BLASTN | 624 | 1e-50 | 81 |
| 6234 | 11537 | 700748911H1 | SOYMON013 | g18460 | BLASTX | 91 | 1e-14 | 100 |
| 6235 | 11795 | 700667578H1 | SOYMON006 | g169326 | BLASTN | 1118 | 1e-84 | 95 |
| 6236 | 11795 | 701056334H1 | SOYMON032 | g169326 | BLASTN | 658 | 1e-82 | 94 |
| 6237 | 11795 | 700742616H1 | SOYMON012 | g169326 | BLASTN | 848 | 1e-61 | 95 |
| 6238 | 12499 | 701051365H1 | SOYMON032 | g169326 | BLASTN | 1237 | 1e-94 | 92 |
| 6239 | 12499 | 701102792H1 | SOYMON028 | g169326 | BLASTN | 1169 | 1e-88 | 92 |
| 6240 | 12499 | 701098731H2 | SOYMON028 | g169326 | BLASTN | 1031 | 1e-82 | 91 |
| 6241 | 15256 | 700744584H1 | SOYMON013 | g20469 | BLASTX | 96 | 1e-9 | 85 |
| 6242 | 1729 | 701000647H1 | SOYMON018 | g20468 | BLASTN | 766 | 1e-61 | 81 |
| 6243 | 1729 | 700738988H1 | SOYMON012 | g2150026 | BLASTN | 745 | 1e-53 | 85 |
| 6244 | 1729 | 700956234H1 | SOYMON022 | g20468 | BLASTN | 740 | 1e-52 | 74 |
| 6245 | 1729 | 700888666H1 | SOYMON024 | g2150026 | BLASTN | 626 | 1e-43 | 83 |
| 6246 | 1729 | 700752533H1 | SOYMON014 | g2150026 | BLASTN | 431 | 1e-34 | 80 |
| 6247 | 1729 | 700685485H1 | SOYMON008 | g459441 | BLASTX | 163 | 1e-15 | 82 |
| 6248 | 1729 | 700998862H1 | SOYMON018 | g20469 | BLASTX | 147 | 1e-14 | 73 |
| 6249 | 1729 | 700729313H1 | SOYMON009 | g2150029 | BLASTX | 85 | 1e-10 | 75 |
| 6250 | 17352 | 700846094H1 | SOYMON021 | g20468 | BLASTN | 700 | 1e-49 | 76 |

TABLE A*-continued

| Seq No. | Cluster ID | CloneID | Library | NCBI gi | Method | Score | P-value | % Ident |
|---|---|---|---|---|---|---|---|---|
| 6251 | 17352 | 701062346H1 | SOYMON033 | g20468 | BLASTN | 658 | 1e-45 | 86 |
| 6252 | 17352 | 700866471H1 | SOYMON016 | g169326 | BLASTN | 511 | 1e-39 | 84 |
| 6253 | 21165 | 701129419H1 | SOYMON037 | g169326 | BLASTN | 1098 | 1e-85 | 92 |
| 6254 | 21165 | 701099310H1 | SOYMON028 | g169326 | BLASTN | 534 | 1e-54 | 87 |
| 6255 | 21165 | 701103522H1 | SOYMON028 | g169326 | BLASTN | 764 | 1e-54 | 92 |
| 6256 | 21165 | 701050730H1 | SOYMON032 | g169326 | BLASTN | 460 | 1e-43 | 88 |
| 6257 | 21165 | 701045037H1 | SOYMON032 | g169326 | BLASTN | 536 | 1e-43 | 89 |
| 6258 | 21165 | 701050806H1 | SOYMON032 | g169326 | BLASTN | 515 | 1e-41 | 89 |
| 6259 | 21165 | 700749793H1 | SOYMON013 | g169326 | BLASTN | 258 | 1e-40 | 86 |
| 6260 | 23648 | 701045082H1 | SOYMON032 | g169326 | BLASTN | 825 | 1e-80 | 94 |
| 6261 | 23648 | 701118383H1 | SOYMON037 | g169326 | BLASTN | 475 | 1e-30 | 88 |
| 6262 | 24404 | 700737869H1 | SOYMON012 | g169326 | BLASTN | 460 | 1e-44 | 86 |
| 6263 | 3053 | 701212666H1 | SOYMON035 | g20468 | BLASTN | 868 | 1e-63 | 84 |
| 6264 | 3053 | 701212028H1 | SOYMON035 | g20468 | BLASTN | 631 | 1e-61 | 80 |
| 6265 | 3053 | 700977561H1 | SOYMON009 | g20468 | BLASTN | 841 | 1e-61 | 79 |
| 6266 | 3053 | 700905407H1 | SOYMON022 | g20468 | BLASTN | 843 | 1e-61 | 84 |
| 6267 | 3053 | 700792066H1 | SOYMON011 | g20468 | BLASTN | 776 | 1e-55 | 79 |
| 6268 | 3053 | 701128564H1 | SOYMON037 | g20468 | BLASTN | 708 | 1e-50 | 78 |
| 6269 | 3053 | 700946436H1 | SOYMON024 | g20468 | BLASTN | 683 | 1e-48 | 75 |
| 6270 | 3053 | 701137311H1 | SOYMON038 | g20468 | BLASTN | 379 | 1e-39 | 80 |
| 6271 | 3053 | 700977732H1 | SOYMON009 | g20468 | BLASTN | 279 | 1e-37 | 77 |
| 6272 | 32402 | 700843745H1 | SOYMON021 | g2150027 | BLASTX | 164 | 1e-15 | 88 |
| 6273 | 7467 | 700998015H1 | SOYMON018 | g2150026 | BLASTN | 600 | 1e-46 | 73 |
| 6274 | 7467 | 701051278H1 | SOYMON032 | g2150026 | BLASTN | 594 | 1e-40 | 79 |
| 6275 | 7467 | 700742622H1 | SOYMON012 | g2150026 | BLASTN | 582 | 1e-39 | 79 |
| 6276 | 7467 | 700672459H1 | SOYMON006 | g2911148 | BLASTX | 201 | 1e-20 | 90 |
| 6277 | 7467 | 700668110H1 | SOYMON006 | g2911148 | BLASTX | 201 | 1e-20 | 90 |
| 6278 | 7467 | 701067027H1 | SOYMON034 | g169326 | BLASTN | 356 | 1e-20 | 78 |
| 6279 | 7467 | 700740551H1 | SOYMON012 | g2150027 | BLASTX | 138 | 1e-11 | 60 |
| 6280 | 7507 | 700725450H1 | SOYMON009 | g20468 | BLASTN | 888 | 1e-65 | 81 |
| 6281 | 7507 | 700863501H1 | SOYMON027 | g20468 | BLASTN | 873 | 1e-63 | 79 |
| 6282 | 7507 | 700961324H1 | SOYMON022 | g20468 | BLASTN | 748 | 1e-53 | 77 |
| 6283 | 7507 | 700648881H1 | SOYMON003 | g20468 | BLASTN | 443 | 1e-46 | 76 |
| 6284 | 7507 | 700727322H1 | SOYMON009 | g2150027 | BLASTX | 196 | 1e-19 | 90 |
| 6285 | 32402 | LIB3055-009-Q1-N1-E5 | LIB3055 | g2150028 | BLASTN | 458 | 1e-27 | 80 |
| 6286 | 7467 | LIB3051-044-Q1-K1-A10 | LIB3051 | g169326 | BLASTN | 633 | 1e-42 | 76 |
| 6287 | 7507 | LIB3050-004-Q1-E1-B1 | LIB3050 | g20468 | BLASTN | 635 | 1e-42 | 80 |
| MAIZE NAD-DEPENDENT MALIC ENZYME | | | | | | | | |
| 6022 | 18769 | 700076676H1 | SATMON007 | g20469 | BLASTX | 181 | 1e-18 | 77 |
| 6023 | 18769 | 700155440H1 | SATMON007 | g20469 | BLASTX | 140 | 1e-12 | 73 |
| 6288 | -701172938 | 701172938H2 | SATMONN05 | g438131 | BLASTX | 95 | 1e-18 | 77 |
| 6289 | 18115 | 700217870H1 | SATMON016 | g438131 | BLASTX | 157 | 1e-14 | 84 |
| 6290 | -700455719 | 700455719H1 | SATMON029 | g1129068 | BLASTX | 137 | 1e-14 | 72 |
| SOYBEAN NAD-DEPENDENT MALIC ENZYME | | | | | | | | |
| 6291 | -700565009 | 700565009H1 | SOYMON002 | g438131 | BLASTX | 126 | 1e-10 | 73 |
| 6292 | -701041607 | 701041607H1 | SOYMON029 | g437104 | BLASTX | 124 | 1e-21 | 76 |
| 6293 | -GM32323 | LIB3051-012-Q1-E1-H7 | LIB3051 | g438131 | BLASTX | 152 | 1e-31 | 89 |
| MAIZE PEP CARBOXYKINASE | | | | | | | | |
| 6294 | -700442004 | 700442004H1 | SATMON026 | g607751 | BLASTN | 348 | 1e-21 | 71 |
| 6295 | -700579766 | 700579766H1 | SATMON031 | g607751 | BLASTN | 223 | 1e-16 | 79 |
| 6296 | -700619673 | 700619673H1 | SATMON034 | g607751 | BLASTN | 281 | 1e-15 | 87 |
| 6297 | 15221 | 700620909H1 | SATMON034 | g607751 | BLASTN | 657 | 1e-66 | 88 |
| 6298 | 15221 | 700620957H1 | SATMON034 | g607751 | BLASTN | 657 | 1e-51 | 88 |
| 6299 | 1650 | 700098127H1 | SATMON009 | g607751 | BLASTN | 1241 | 1e-100 | 91 |
| 6300 | 1650 | 700243074H1 | SATMON010 | g607751 | BLASTN | 1190 | 1e-90 | 92 |
| 6301 | 1650 | 700098909H1 | SATMON009 | g607751 | BLASTN | 662 | 1e-89 | 89 |
| 6302 | 1650 | 700578805H1 | SATMON031 | g607751 | BLASTN | 783 | 1e-84 | 92 |
| 6303 | 1650 | 700577590H1 | SATMON031 | g607751 | BLASTN | 1116 | 1e-84 | 91 |
| 6304 | 1650 | 700576768H1 | SATMON031 | g607751 | BLASTN | 885 | 1e-83 | 93 |
| 6305 | 1650 | 700025522H1 | SATMON004 | g607751 | BLASTN | 1097 | 1e-82 | 93 |
| 6306 | 1650 | 700197175H1 | SATMON014 | g607751 | BLASTN | 1067 | 1e-80 | 93 |
| 6307 | 1650 | 700432603H1 | SATMONN01 | g607751 | BLASTN | 659 | 1e-76 | 92 |
| 6308 | 1650 | 700193379H1 | SATMON014 | g607751 | BLASTN | 976 | 1e-72 | 91 |
| 6309 | 1650 | 700196761H1 | SATMON014 | g607751 | BLASTN | 718 | 1e-50 | 92 |
| 6310 | 1650 | 700441535H1 | SATMON026 | g607751 | BLASTN | 391 | 1e-36 | 84 |
| 6311 | 1650 | 700158221H1 | SATMON012 | g607751 | BLASTN | 307 | 1e-28 | 92 |
| 6312 | 20890 | 700101572H1 | SATMON009 | g607751 | BLASTN | 1300 | 1e-99 | 90 |
| 6313 | 20890 | 700099023H1 | SATMON009 | g607751 | BLASTN | 1139 | 1e-86 | 89 |
| 6314 | 20890 | 700577054H1 | SATMON031 | g607751 | BLASTN | 587 | 1e-79 | 90 |
| 6315 | 20890 | 700458441H1 | SATMON029 | g607751 | BLASTN | 1025 | 1e-76 | 85 |

TABLE A*-continued

| Seq No. | Cluster ID | CloneID | Library | NCBI gi | Method | Score | P-value | % Ident |
|---|---|---|---|---|---|---|---|---|
| 6316 | 22085 | 700101950H1 | SATMON009 | g607751 | BLASTN | 273 | 1e-19 | 85 |
| 6317 | 22085 | 700101726H1 | SATMON009 | g607751 | BLASTN | 282 | 1e-12 | 92 |
| 6318 | 22085 | 700045944H1 | SATMON004 | g607751 | BLASTN | 268 | 1e-11 | 91 |
| 6319 | 22085 | 700099310H1 | SATMON009 | g607751 | BLASTN | 269 | 1e-11 | 89 |
| 6320 | 22085 | 700097484H1 | SATMON009 | g607751 | BLASTN | 245 | 1e-9 | 88 |
| 6321 | 22085 | 700101996H1 | SATMON009 | g607751 | BLASTN | 245 | 1e-9 | 85 |
| 6322 | 28836 | 700168982H1 | SATMON013 | g607751 | BLASTN | 195 | 1e-9 | 78 |
| 6323 | 3602 | 700098761H1 | SATMON009 | g607751 | BLASTN | 688 | 1e-94 | 87 |
| 6324 | 3602 | 700240336H1 | SATMON010 | g607751 | BLASTN | 1023 | 1e-76 | 89 |
| 6325 | 3602 | 701158475H1 | SATMONN04 | g607751 | BLASTN | 907 | 1e-66 | 86 |
| 6326 | 8009 | 700028978H1 | SATMON003 | g607751 | BLASTN | 681 | 1e-83 | 89 |
| 6327 | 8009 | 700440427H1 | SATMON026 | g607751 | BLASTN | 726 | 1e-72 | 89 |
| 6328 | 8009 | 700440419H1 | SATMON026 | g607751 | BLASTN | 715 | 1e-67 | 87 |
| 6329 | 8009 | 700578684H1 | SATMON031 | g607751 | BLASTN | 720 | 1e-66 | 84 |
| 6330 | -L1433016 | LIB143-017-Q1-E1-G12 | LIB143 | g607751 | BLASTN | 344 | 1e-17 | 77 |
| 6331 | -L1892500 | LIB189-018-Q1-E1-A7 | LIB189 | g607751 | BLASTN | 483 | 1e-29 | 77 |
| 6332 | -L30604864 | LIB3060-022-Q1-K1-A10 | LIB3060 | g607751 | BLASTN | 266 | 1e-11 | 89 |
| 6333 | 1650 | LIB3069-045-Q1-K1-A5 | LIB3069 | g607751 | BLASTN | 1868 | 1e-146 | 91 |
| 6334 | 1650 | LIB189-002-Q1-E1-F5 | LIB189 | g607751 | BLASTN | 1532 | 1e-118 | 92 |
| 6335 | 1650 | LIB84-013-Q1-E1-D8 | LIB84 | g607751 | BLASTN | 1316 | 1e-100 | 88 |
| 6336 | 1650 | LIB143-049-Q1-E1-D10 | LIB143 | g607751 | BLASTN | 1233 | 1e-93 | 91 |
| 6337 | 20890 | 10-LIB189-016-Q1-E1-C9 | LIB189 | g607751 | BLASTN | 1467 | 1e-113 | 86 |
| 6338 | 22085 | LIB3060-018-Q1-K1-C8 | LIB3060 | g607751 | BLASTN | 288 | 1e-41 | 73 |
| 6339 | 22085 | LIB3060-028-Q1-K1-F4 | LIB3060 | g567102 | BLASTX | 132 | 1e-38 | 66 |
| 6340 | 22085 | LIB143-052-Q1-E1-B12 | LIB143 | g607751 | BLASTN | 288 | 1e-32 | 84 |
| 6341 | 22085 | LIB3060-025-Q1-K1-F9 | LIB3060 | g607751 | BLASTN | 280 | 1e-28 | 85 |
| 6342 | 22085 | LIB3060-005-Q1-K1-G11 | LIB3060 | g607751 | BLASTN | 280 | 1e-27 | 84 |
| 6343 | 22085 | LIB3060-045-Q1-K1-A8 | LIB3060 | g607751 | BLASTN | 280 | 1e-22 | 79 |
| 6344 | 22085 | LIB3060-036-Q1-K1-G2 | LIB3060 | g607751 | BLASTN | 280 | 1e-17 | 85 |
| 6345 | 22085 | LIB3060-045-Q1-K1-E8 | LIB3060 | g607751 | BLASTN | 280 | 1e-17 | 88 |
| 6346 | 22085 | LIB3060-001-Q1-K2-G11 | LIB3060 | g607751 | BLASTN | 280 | 1e-12 | 90 |
| 6347 | 22085 | LIB3060-007-Q1-K1-A4 | LIB3060 | g607751 | BLASTN | 280 | 1e-12 | 92 |
| 6348 | 22085 | LIB3060-007-Q1-K1-D2 | LIB3060 | g607751 | BLASTN | 273 | 1e-11 | 91 |
| 6349 | 22085 | LIB189-007-Q1-E1-H6 | LIB189 | g607751 | BLASTN | 259 | 1e-10 | 88 |
| 6350 | 28836 | LIB143-067-Q1-E1-E12 | LIB143 | g607751 | BLASTN | 281 | 1e-12 | 91 |
| 6351 | 3602 | LIB3060-024-Q1-K1-F3 | LIB3060 | g607751 | BLASTN | 1188 | 1e-112 | 81 |
| 6352 | 8009 | LIB189-023-Q1-E1-H8 | LIB189 | g607751 | BLASTN | 758 | 1e-110 | 85 |
| 6353 | 8009 | LIB3060-013-Q1-K1-F1 | LIB3060 | g607751 | BLASTN | 1184 | 1e-99 | 87 |
| SOYBEAN PEP CARBOXYKINASE | | | | | | | | |
| 6354 | -700654736 | 700654736H1 | SOYMON004 | g567102 | BLASTX | 204 | 1e-21 | 86 |
| 6355 | -700848574 | 700848574H1 | SOYMON021 | g567101 | BLASTN | 741 | 1e-52 | 80 |
| 6356 | -700866163 | 700866163H1 | SOYMON016 | g567102 | BLASTX | 60 | 1e-10 | 71 |
| 6357 | -700868677 | 700868677H1 | SOYMON016 | g914915 | BLASTX | 163 | 1e-15 | 65 |
| 6358 | -700943040 | 700943040H1 | SOYMON024 | g567101 | BLASTN | 405 | 1e-23 | 82 |
| 6359 | -700972225 | 700972225H1 | SOYMON005 | g567101 | BLASTN | 588 | 1e-47 | 82 |
| 6360 | -700996224 | 700996224H1 | SOYMON018 | g567101 | BLASTN | 563 | 1e-38 | 83 |
| 6361 | -701045039 | 701045039H1 | SOYMON032 | g914914 | BLASTN | 581 | 1e-54 | 82 |
| 6362 | 12737 | 700605402H2 | SOYMON004 | g567101 | BLASTN | 809 | 1e-58 | 76 |
| 6363 | 12737 | 700888213H1 | SOYMON024 | g607751 | BLASTN | 361 | 1e-19 | 75 |
| 6364 | 13320 | 701040204H1 | SOYMON029 | g914914 | BLASTN | 1002 | 1e-74 | 81 |
| 6365 | 13320 | 701042078H1 | SOYMON029 | g914914 | BLASTN | 865 | 1e-63 | 81 |
| 6366 | 13320 | 700849715H1 | SOYMON021 | g914914 | BLASTN | 745 | 1e-53 | 83 |

TABLE A*-continued

| Seq No. | Cluster ID | CloneID | Library | NCBI gi | Method | Score | P-value | % Ident |
|---|---|---|---|---|---|---|---|---|
| 6367 | 17750 | 700959272H1 | SOYMON022 | g567102 | BLASTX | 154 | 1e−13 | 53 |
| 6368 | 17750 | 700961793H1 | SOYMON022 | g567102 | BLASTX | 119 | 1e−9 | 50 |
| 6369 | 20486 | 700726640H1 | SOYMON009 | g567102 | BLASTX | 131 | 1e−16 | 75 |
| 6370 | 24418 | 700605382H2 | SOYMON004 | g914914 | BLASTN | 814 | 1e−59 | 76 |
| 6371 | 24418 | 701052653H1 | SOYMON032 | g567101 | BLASTN | 760 | 1e−54 | 79 |
| 6372 | 24418 | 700847843H1 | SOYMON021 | g567101 | BLASTN | 447 | 1e−50 | 82 |
| 6373 | 24418 | 701051337H1 | SOYMON032 | g914914 | BLASTN | 715 | 1e−50 | 78 |
| 6374 | 24418 | 700656509H1 | SOYMON004 | g914914 | BLASTN | 655 | 1e−45 | 72 |
| 6375 | 24418 | 701101473H1 | SOYMON028 | g567101 | BLASTN | 417 | 1e−43 | 80 |
| 6376 | 24418 | 701053551H1 | SOYMON032 | g607752 | BLASTX | 126 | 1e−14 | 72 |
| 6377 | 26845 | 701046671H1 | SOYMON032 | g567101 | BLASTN | 528 | 1e−35 | 67 |
| 6378 | 26845 | 701103555H1 | SOYMON028 | g607751 | BLASTN | 352 | 1e−18 | 63 |
| 6379 | -GM20322 | LIB3056-013-Q1-N1-F3 | LIB3056 | g567101 | BLASTN | 766 | 1e−53 | 81 |
| 6380 | -GM36301 | LIB3051-054-Q1-K1-G11 | LIB3051 | g607751 | BLASTN | 273 | 1e−11 | 91 |
| 6381 | -GM37519 | LIB3051-063-Q1-K1-D7 | LIB3051 | g567101 | BLASTN | 911 | 1e−67 | 81 |
| 6382 | 11698 | LIB3051-065-Q1-K1-G9 | LIB3051 | g567102 | BLASTX | 167 | 1e−32 | 58 |
| 6383 | 12737 | LIB3051-003-Q1-E1-C4 | LIB3051 | g567101 | BLASTN | 820 | 1e−58 | 75 |
| 6384 | 24418 | LIB3051-104-Q1-K1-G11 | LIB3051 | g914914 | BLASTN | 1096 | 1e−89 | 77 |
| 6385 | 24418 | LIB3051-042-Q1-K1-C1 | LIB3051 | g567101 | BLASTN | 1019 | 1e−84 | 78 |
| 6386 | 24418 | LIB3051-116-Q1-K1-B4 | LIB3051 | g914914 | BLASTN | 918 | 1e−67 | 73 |
| 6387 | 24418 | LIB3051-046-Q1-K1-E11 | LIB3051 | g914914 | BLASTN | 863 | 1e−65 | 76 |
| SOYBEAN PUTATIVE PEP CARBOXYKINASE | | | | | | | | |
| 6388 | -700868431 | 700868431H1 | SOYMON016 | g2827717 | BLASTX | 94 | 1e−9 | 81 |
| MAIZE PYRUVATE, PHOSPHATE DIKINASE | | | | | | | | |
| 6389 | -700044189 | 700044189H1 | SATMON004 | g168579 | BLASTN | 155 | 1e−10 | 89 |
| 6390 | -700098830 | 700098830H1 | SATMON009 | g257804 | BLASTN | 317 | 1e−76 | 93 |
| 6391 | -700267212 | 700267212H1 | SATMON017 | g168579 | BLASTN | 1115 | 1e−84 | 86 |
| 6392 | -700268101 | 700268101H1 | SATMON017 | g257809 | BLASTN | 698 | 1e−66 | 96 |
| 6393 | -700404827 | 700404827H1 | SATMON026 | g168583 | BLASTN | 445 | 1e−57 | 89 |
| 6394 | -700426407 | 700426407H1 | SATMONN01 | g168579 | BLASTN | 365 | 1e−21 | 81 |
| 6395 | -700430716 | 700430716H1 | SATMONN01 | g22451 | BLASTN | 210 | 1e−8 | 83 |
| 6396 | -700438208 | 700438208H1 | SATMON026 | g168584 | BLASTN | 325 | 1e−50 | 94 |
| 6397 | -700438250 | 700438250H1 | SATMON026 | g168579 | BLASTN | 263 | 1e−28 | 94 |
| 6398 | -700442440 | 700442440H1 | SATMON026 | g168579 | BLASTN | 492 | 1e−63 | 84 |
| 6399 | -700442486 | 700442486H1 | SATMON026 | g168579 | BLASTN | 399 | 1e−34 | 76 |
| 6400 | -700442534 | 700442534H1 | SATMON026 | g168579 | BLASTN | 280 | 1e−26 | 86 |
| 6401 | -700445755 | 700445755H1 | SATMON027 | g168579 | BLASTN | 537 | 1e−45 | 91 |
| 6402 | -700448312 | 700448312H1 | SATMON027 | g168579 | BLASTN | 201 | 1e−16 | 93 |
| 6403 | -700458259 | 700458259H1 | SATMON029 | g168579 | BLASTN | 635 | 1e−57 | 87 |
| 6404 | -700460850 | 700460850H1 | SATMON031 | g168579 | BLASTN | 227 | 1e−14 | 92 |
| 6405 | -700576979 | 700576979H1 | SATMON031 | g168579 | BLASTN | 239 | 1e−9 | 89 |
| 6406 | -700582461 | 700582461H1 | SATMON031 | g168584 | BLASTN | 310 | 1e−34 | 86 |
| 6407 | -700613790 | 700613790H1 | SATMON033 | g168579 | BLASTN | 473 | 1e−69 | 90 |
| 6408 | -700615033 | 700615033H1 | SATMON033 | g168579 | BLASTN | 1209 | 1e−94 | 89 |
| 6409 | -700807115 | 700807115H1 | SATMON036 | g168579 | BLASTN | 961 | 1e−71 | 85 |
| 6410 | -700807148 | 700807148H1 | SATMON036 | g168579 | BLASTN | 1046 | 1e−78 | 85 |
| 6411 | -700807285 | 700807285H1 | SATMON036 | g168579 | BLASTN | 850 | 1e−61 | 81 |
| 6412 | 241 | 700616008H1 | SATMON033 | g168579 | BLASTN | 1750 | 1e−136 | 99 |
| 6413 | 241 | 700084360H1 | SATMON011 | g168579 | BLASTN | 1706 | 1e−133 | 99 |
| 6414 | 241 | 700097569H1 | SATMON009 | g168579 | BLASTN | 1635 | 1e−127 | 100 |
| 6415 | 241 | 700099686H1 | SATMON009 | g168579 | BLASTN | 1540 | 1e−124 | 100 |
| 6416 | 241 | 700097065H1 | SATMON009 | g168579 | BLASTN | 1565 | 1e−124 | 100 |
| 6417 | 241 | 700097577H1 | SATMON009 | g168579 | BLASTN | 1601 | 1e−124 | 99 |
| 6418 | 241 | 700098157H1 | SATMON009 | g168579 | BLASTN | 1588 | 1e−123 | 99 |
| 6419 | 241 | 700095354H1 | SATMON008 | g168579 | BLASTN | 1578 | 1e−122 | 99 |
| 6420 | 241 | 700097024H1 | SATMON009 | g168579 | BLASTN | 1561 | 1e−121 | 98 |
| 6421 | 241 | 700101705H1 | SATMON009 | g168579 | BLASTN | 1563 | 1e−121 | 99 |
| 6422 | 241 | 700100753H1 | SATMON009 | g168579 | BLASTN | 1569 | 1e−121 | 98 |
| 6423 | 241 | 700209526H1 | SATMON016 | g168579 | BLASTN | 1548 | 1e−120 | 98 |
| 6424 | 241 | 700101967H1 | SATMON009 | g168579 | BLASTN | 1550 | 1e−120 | 100 |
| 6425 | 241 | 700100971H1 | SATMON009 | g168579 | BLASTN | 1552 | 1e−120 | 97 |
| 6426 | 241 | 700097028H1 | SATMON009 | g168579 | BLASTN | 876 | 1e−119 | 99 |
| 6427 | 241 | 700100216H1 | SATMON009 | g168579 | BLASTN | 1068 | 1e−115 | 98 |
| 6428 | 241 | 700100408H1 | SATMON009 | g168579 | BLASTN | 1413 | 1e−118 | 99 |
| 6429 | 241 | 700098443H1 | SATMON009 | g168579 | BLASTN | 1518 | 1e−117 | 99 |
| 6430 | 241 | 700099779H1 | SATMON009 | g168579 | BLASTN | 1502 | 1e−116 | 97 |

TABLE A*-continued

| Seq No. | Cluster ID | CloneID | Library | NCBI gi | Method | Score | P-value | % Ident |
|---|---|---|---|---|---|---|---|---|
| 6431 | 241 | 700099086H1 | SATMON009 | g168579 | BLASTN | 1503 | 1e-116 | 99 |
| 6432 | 241 | 700101887H1 | SATMON009 | g168579 | BLASTN | 1506 | 1e-116 | 99 |
| 6433 | 241 | 700097164H1 | SATMON009 | g168579 | BLASTN | 1489 | 1e-115 | 98 |
| 6434 | 241 | 700100751H1 | SATMON009 | g168579 | BLASTN | 1492 | 1e-112 | 97 |
| 6435 | 241 | 700101890H1 | SATMON009 | g168579 | BLASTN | 1498 | 1e-115 | 99 |
| 6436 | 241 | 700100212H1 | SATMON009 | g168579 | BLASTN | 1042 | 1e-114 | 99 |
| 6437 | 241 | 700100040H1 | SATMON009 | g168579 | BLASTN | 1484 | 1e-114 | 99 |
| 6438 | 241 | 700101179H1 | SATMON009 | g168579 | BLASTN | 1486 | 1e-114 | 99 |
| 6439 | 241 | 700097777H1 | SATMON009 | g168579 | BLASTN | 1097 | 1e-113 | 97 |
| 6440 | 241 | 700621494H1 | SATMON034 | g168579 | BLASTN | 1184 | 1e-113 | 97 |
| 6441 | 241 | 700621492H1 | SATMON034 | g168579 | BLASTN | 1184 | 1e-113 | 97 |
| 6442 | 241 | 700620055H1 | SATMON034 | g168579 | BLASTN | 1205 | 1e-113 | 98 |
| 6443 | 241 | 700099278H1 | SATMON009 | g168579 | BLASTN | 1468 | 1e-113 | 99 |
| 6444 | 241 | 700100235H1 | SATMON009 | g168579 | BLASTN | 1036 | 1e-112 | 97 |
| 6445 | 241 | 700097726H1 | SATMON009 | g168579 | BLASTN | 1452 | 1e-112 | 99 |
| 6446 | 241 | 700099458H1 | SATMON009 | g168579 | BLASTN | 1452 | 1e-112 | 97 |
| 6447 | 241 | 700101405H1 | SATMON009 | g168579 | BLASTN | 1457 | 1e-112 | 99 |
| 6448 | 241 | 700098006H1 | SATMON009 | g168579 | BLASTN | 1458 | 1e-112 | 98 |
| 6449 | 241 | 700098988H1 | SATMON009 | g168579 | BLASTN | 1460 | 1e-112 | 98 |
| 6450 | 241 | 700101193H1 | SATMON009 | g168579 | BLASTN | 1460 | 1e-112 | 100 |
| 6451 | 241 | 700099029H1 | SATMON009 | g168579 | BLASTN | 1450 | 1e-111 | 100 |
| 6452 | 241 | 700099494H1 | SATMON009 | g168579 | BLASTN | 1451 | 1e-111 | 99 |
| 6453 | 241 | 700624034H1 | SATMON034 | g168579 | BLASTN | 887 | 1e-110 | 92 |
| 6454 | 241 | 700099587H1 | SATMON009 | g168579 | BLASTN | 1432 | 1e-110 | 97 |
| 6455 | 241 | 700097537H1 | SATMON009 | g168579 | BLASTN | 1434 | 1e-110 | 98 |
| 6456 | 241 | 700099280H1 | SATMON009 | g168579 | BLASTN | 1437 | 1e-110 | 98 |
| 6457 | 241 | 700099242H1 | SATMON009 | g168579 | BLASTN | 924 | 1e-109 | 98 |
| 6458 | 241 | 700097259H1 | SATMON009 | g168579 | BLASTN | 1275 | 1e-109 | 98 |
| 6459 | 241 | 700099789H1 | SATMON009 | g168579 | BLASTN | 1422 | 1e-109 | 96 |
| 6460 | 241 | 700097672H1 | SATMON009 | g168579 | BLASTN | 1425 | 1e-109 | 95 |
| 6461 | 241 | 700099985H1 | SATMON009 | g168579 | BLASTN | 870 | 1e-108 | 99 |
| 6462 | 241 | 700045762H1 | SATMON004 | g168579 | BLASTN | 1410 | 1e-108 | 100 |
| 6463 | 241 | 700101542H1 | SATMON009 | g168579 | BLASTN | 1008 | 1e-107 | 98 |
| 6464 | 241 | 700099788H1 | SATMON009 | g168579 | BLASTN | 1255 | 1e-107 | 99 |
| 6465 | 241 | 700265183H1 | SATMON017 | g168579 | BLASTN | 1394 | 1e-107 | 97 |
| 6466 | 241 | 700072495H1 | SATMON007 | g168579 | BLASTN | 1395 | 1e-107 | 96 |
| 6467 | 241 | 700578123H1 | SATMON031 | g168579 | BLASTN | 1398 | 1e-107 | 98 |
| 6468 | 241 | 700445628H1 | SATMON027 | g168579 | BLASTN | 1401 | 1e-107 | 96 |
| 6469 | 241 | 700098025H1 | SATMON009 | g168579 | BLASTN | 1403 | 1e-107 | 98 |
| 6470 | 241 | 700457276H1 | SATMON029 | g168579 | BLASTN | 1380 | 1e-106 | 100 |
| 6471 | 241 | 700045419H1 | SATMON004 | g168579 | BLASTN | 1385 | 1e-106 | 100 |
| 6472 | 241 | 700457282H1 | SATMON029 | g168579 | BLASTN | 1385 | 1e-106 | 100 |
| 6473 | 241 | 700042861H1 | SATMON004 | g168579 | BLASTN | 1387 | 1e-106 | 99 |
| 6474 | 241 | 700099765H1 | SATMON009 | g168579 | BLASTN | 1177 | 1e-105 | 96 |
| 6475 | 241 | 700213650H1 | SATMON016 | g168579 | BLASTN | 1367 | 1e-105 | 99 |
| 6476 | 241 | 700157249H1 | SATMON012 | g168579 | BLASTN | 1370 | 1e-105 | 100 |
| 6477 | 241 | 700441931H1 | SATMON026 | g168579 | BLASTN | 1370 | 1e-105 | 98 |
| 6478 | 241 | 700097944H1 | SATMON009 | g168579 | BLASTN | 1372 | 1e-105 | 97 |
| 6479 | 241 | 700423208H1 | SATMONN01 | g168579 | BLASTN | 630 | 1e-104 | 97 |
| 6480 | 241 | 700442667H1 | SATMON026 | g168579 | BLASTN | 1259 | 1e-104 | 98 |
| 6481 | 241 | 700044521H1 | SATMON004 | g168579 | BLASTN | 1355 | 1e-104 | 100 |
| 6482 | 241 | 700208177H1 | SATMON016 | g168579 | BLASTN | 1365 | 1e-104 | 97 |
| 6483 | 241 | 700444555H1 | SATMON027 | g168579 | BLASTN | 1227 | 1e-103 | 99 |
| 6484 | 241 | 700580211H1 | SATMON031 | g168579 | BLASTN | 1238 | 1e-103 | 99 |
| 6485 | 241 | 700577814H1 | SATMON031 | g168579 | BLASTN | 1345 | 1e-103 | 98 |
| 6486 | 241 | 700100895H1 | SATMON009 | g168579 | BLASTN | 1347 | 1e-103 | 97 |
| 6487 | 241 | 700100893H1 | SATMON009 | g168579 | BLASTN | 1347 | 1e-103 | 98 |
| 6488 | 241 | 700442655H1 | SATMON026 | g168579 | BLASTN | 1351 | 1e-103 | 99 |
| 6489 | 241 | 700101289H1 | SATMON009 | g168579 | BLASTN | 1353 | 1e-103 | 99 |
| 6490 | 241 | 700446244H1 | SATMON027 | g168579 | BLASTN | 778 | 1e-102 | 99 |
| 6491 | 241 | 700210293H1 | SATMON016 | g168579 | BLASTN | 943 | 1e-102 | 98 |
| 6492 | 241 | 700404894H1 | SATMON026 | g168579 | BLASTN | 1202 | 1e-102 | 97 |
| 6493 | 241 | 700577581H1 | SATMON031 | g168579 | BLASTN | 1331 | 1e-102 | 98 |
| 6494 | 241 | 700041646H1 | SATMON004 | g168579 | BLASTN | 1335 | 1e-102 | 98 |
| 6495 | 241 | 700442593H1 | SATMON026 | g168579 | BLASTN | 1338 | 1e-102 | 99 |
| 6496 | 241 | 700581301H1 | SATMON031 | g168579 | BLASTN | 1338 | 1e-102 | 98 |
| 6497 | 241 | 700043360H1 | SATMON004 | g168579 | BLASTN | 1340 | 1e-102 | 100 |
| 6498 | 241 | 700044853H1 | SATMON004 | g168579 | BLASTN | 1340 | 1e-102 | 100 |
| 6499 | 241 | 700581894H1 | SATMON031 | g168579 | BLASTN | 1342 | 1e-102 | 98 |
| 6500 | 241 | 700582749H1 | SATMON031 | g168579 | BLASTN | 853 | 1e-101 | 99 |
| 6501 | 241 | 700046068H1 | SATMON004 | g168579 | BLASTN | 864 | 1e-101 | 98 |
| 6502 | 241 | 700045115H1 | SATMON004 | g168579 | BLASTN | 1320 | 1e-101 | 100 |
| 6503 | 241 | 700053428H1 | SATMON004 | g168579 | BLASTN | 1321 | 1e-101 | 99 |
| 6504 | 241 | 700100830H1 | SATMON009 | g168579 | BLASTN | 1321 | 1e-101 | 99 |
| 6505 | 241 | 700441945H1 | SATMON026 | g168579 | BLASTN | 1326 | 1e-101 | 98 |
| 6506 | 241 | 700576780H1 | SATMON031 | g168579 | BLASTN | 1326 | 1e-101 | 97 |
| 6507 | 241 | 700442663H1 | SATMON026 | g168579 | BLASTN | 1326 | 1e-101 | 99 |

TABLE A*-continued

| Seq No. | Cluster ID | CloneID | Library | NCBI gi | Method | Score | P-value | % Ident |
|---|---|---|---|---|---|---|---|---|
| 6508 | 241 | 700439640H1 | SATMON026 | g168579 | BLASTN | 1005 | 1e-100 | 97 |
| 6509 | 241 | 700098515H1 | SATMON009 | g168579 | BLASTN | 1211 | 1e-100 | 97 |
| 6510 | 241 | 700430478H1 | SATMONN01 | g168579 | BLASTN | 1307 | 1e-100 | 98 |
| 6511 | 241 | 700802781H1 | SATMON036 | g168579 | BLASTN | 1307 | 1e-100 | 99 |
| 6512 | 241 | 700045313H1 | SATMON004 | g168579 | BLASTN | 1316 | 1e-100 | 99 |
| 6513 | 241 | 700045790H1 | SATMON004 | g168579 | BLASTN | 1316 | 1e-100 | 99 |
| 6514 | 241 | 700440018H1 | SATMON026 | g168579 | BLASTN | 1317 | 1e-100 | 99 |
| 6515 | 241 | 700100827H1 | SATMON009 | g168579 | BLASTN | 1317 | 1e-100 | 99 |
| 6516 | 241 | 700617476H1 | SATMON033 | g168579 | BLASTN | 558 | 1e-99 | 96 |
| 6517 | 241 | 700577914H1 | SATMON031 | g168579 | BLASTN | 1002 | 1e-99 | 96 |
| 6518 | 241 | 700440805H1 | SATMON026 | g168579 | BLASTN | 1295 | 1e-99 | 100 |
| 6519 | 241 | 700097121H1 | SATMON009 | g168579 | BLASTN | 1295 | 1e-99 | 90 |
| 6520 | 241 | 700043644H1 | SATMON004 | g168579 | BLASTN | 1296 | 1e-99 | 97 |
| 6521 | 241 | 700045549H1 | SATMON004 | g168579 | BLASTN | 1301 | 1e-99 | 99 |
| 6522 | 241 | 700578928H1 | SATMON031 | g168579 | BLASTN | 1303 | 1e-99 | 99 |
| 6523 | 241 | 700467315H1 | SATMON025 | g168579 | BLASTN | 490 | 1e-98 | 98 |
| 6524 | 241 | 700583117H1 | SATMON031 | g168579 | BLASTN | 955 | 1e-98 | 95 |
| 6525 | 241 | 700801426H1 | SATMON036 | g168579 | BLASTN | 1256 | 1e-98 | 99 |
| 6526 | 241 | 700041748H1 | SATMON004 | g168579 | BLASTN | 1286 | 1e-98 | 97 |
| 6527 | 241 | 700043365H1 | SATMON004 | g168579 | BLASTN | 1294 | 1e-98 | 98 |
| 6528 | 241 | 700042742H1 | SATMON004 | g168579 | BLASTN | 1294 | 1e-98 | 97 |
| 6529 | 241 | 700041509H1 | SATMON004 | g168579 | BLASTN | 870 | 1e-97 | 99 |
| 6530 | 241 | 700098536H1 | SATMON009 | g168584 | BLASTN | 910 | 1e-97 | 97 |
| 6531 | 241 | 700100481H1 | SATMON009 | g168579 | BLASTN | 1109 | 1e-97 | 93 |
| 6532 | 241 | 700578290H1 | SATMON031 | g168579 | BLASTN | 1232 | 1e-97 | 99 |
| 6533 | 241 | 700045316H1 | SATMON004 | g168579 | BLASTN | 1272 | 1e-97 | 97 |
| 6534 | 241 | 700043494H1 | SATMON004 | g168579 | BLASTN | 1275 | 1e-97 | 97 |
| 6535 | 241 | 700044584H1 | SATMON004 | g168579 | BLASTN | 1276 | 1e-97 | 99 |
| 6536 | 241 | 700619616H1 | SATMON034 | g168579 | BLASTN | 1278 | 1e-97 | 87 |
| 6537 | 241 | 700041517H1 | SATMON004 | g168579 | BLASTN | 1281 | 1e-97 | 96 |
| 6538 | 241 | 700100133H1 | SATMON009 | g168579 | BLASTN | 496 | 1e-96 | 94 |
| 6539 | 241 | 700456453H1 | SATMON029 | g168579 | BLASTN | 669 | 1e-96 | 97 |
| 6540 | 241 | 700440516H1 | SATMON026 | g168579 | BLASTN | 1015 | 1e-96 | 100 |
| 6541 | 241 | 700042888H1 | SATMON004 | g168579 | BLASTN | 1172 | 1e-96 | 99 |
| 6542 | 241 | 700157245H1 | SATMON012 | g168579 | BLASTN | 1259 | 1e-96 | 98 |
| 6543 | 241 | 700261321H1 | SATMON017 | g168579 | BLASTN | 1261 | 1e-96 | 99 |
| 6544 | 241 | 700045657H1 | SATMON004 | g168579 | BLASTN | 1265 | 1e-96 | 95 |
| 6545 | 241 | 700042469H1 | SATMON004 | g168579 | BLASTN | 1265 | 1e-96 | 98 |
| 6546 | 241 | 700434549H1 | SATMONN01 | g168579 | BLASTN | 1269 | 1e-96 | 91 |
| 6547 | 241 | 700433527H1 | SATMONN01 | g168579 | BLASTN | 795 | 1e-95 | 99 |
| 6548 | 241 | 701177258H1 | SATMONN05 | g168579 | BLASTN | 900 | 1e-95 | 96 |
| 6549 | 241 | 700440442H1 | SATMON026 | g168579 | BLASTN | 997 | 1e-95 | 97 |
| 6550 | 241 | 700432310H1 | SATMONN01 | g168579 | BLASTN | 1074 | 1e-95 | 97 |
| 6551 | 241 | 700026635H1 | SATMON003 | g168579 | BLASTN | 1077 | 1e-95 | 96 |
| 6552 | 241 | 700043320H1 | SATMON004 | g168579 | BLASTN | 1129 | 1e-95 | 98 |
| 6553 | 241 | 700025682H1 | SATMON004 | g168579 | BLASTN | 1256 | 1e-95 | 98 |
| 6554 | 241 | 700441415H1 | SATMON026 | g168579 | BLASTN | 580 | 1e-94 | 96 |
| 6555 | 241 | 700460762H1 | SATMON031 | g168579 | BLASTN | 624 | 1e-94 | 97 |
| 6556 | 241 | 700053387H1 | SATMON009 | g168584 | BLASTN | 649 | 1e-94 | 96 |
| 6557 | 241 | 700044829H1 | SATMON004 | g168579 | BLASTN | 960 | 1e-94 | 100 |
| 6558 | 241 | 700576848H1 | SATMON031 | g168579 | BLASTN | 1207 | 1e-94 | 98 |
| 6559 | 241 | 700195073H1 | SATMON014 | g168579 | BLASTN | 1245 | 1e-94 | 98 |
| 6560 | 241 | 700044956H1 | SATMON004 | g168579 | BLASTN | 1246 | 1e-94 | 97 |
| 6561 | 241 | 700441974H1 | SATMON026 | g168579 | BLASTN | 588 | 1e-93 | 97 |
| 6562 | 241 | 700045323H1 | SATMON004 | g168579 | BLASTN | 673 | 1e-93 | 98 |
| 6563 | 241 | 700584010H1 | SATMON031 | g168579 | BLASTN | 753 | 1e-93 | 92 |
| 6564 | 241 | 700098611H1 | SATMON009 | g168579 | BLASTN | 1137 | 1e-93 | 97 |
| 6565 | 241 | 700043635H1 | SATMON004 | g168584 | BLASTN | 1231 | 1e-93 | 99 |
| 6566 | 241 | 700441843H1 | SATMON026 | g168579 | BLASTN | 1232 | 1e-93 | 98 |
| 6567 | 241 | 700621537H1 | SATMON034 | g168579 | BLASTN | 638 | 1e-92 | 93 |
| 6568 | 241 | 700438416H1 | SATMON026 | g168579 | BLASTN | 1013 | 1e-92 | 97 |
| 6569 | 241 | 700043045H1 | SATMON004 | g168579 | BLASTN | 1117 | 1e-92 | 99 |
| 6570 | 241 | 700433859H1 | SATMONN01 | g168579 | BLASTN | 1148 | 1e-92 | 96 |
| 6571 | 241 | 700580039H1 | SATMON031 | g168579 | BLASTN | 1159 | 1e-92 | 96 |
| 6572 | 241 | 700208040H1 | SATMON016 | g168579 | BLASTN | 1171 | 1e-92 | 98 |
| 6573 | 241 | 700043891H1 | SATMON004 | g168579 | BLASTN | 1211 | 1e-92 | 97 |
| 6574 | 241 | 701175175H1 | SATMONN05 | g168579 | BLASTN | 1212 | 1e-92 | 98 |
| 6575 | 241 | 700210840H1 | SATMON016 | g168579 | BLASTN | 1214 | 1e-92 | 96 |
| 6576 | 241 | 700086935H1 | SATMON011 | g168579 | BLASTN | 1221 | 1e-92 | 87 |
| 6577 | 241 | 700044111H1 | SATMON004 | g168579 | BLASTN | 700 | 1e-91 | 98 |
| 6578 | 241 | 700576815H1 | SATMON031 | g168579 | BLASTN | 912 | 1e-91 | 96 |
| 6579 | 241 | 700438522H1 | SATMON026 | g168579 | BLASTN | 1105 | 1e-91 | 97 |
| 6580 | 241 | 700578239H1 | SATMON031 | g168579 | BLASTN | 1119 | 1e-91 | 98 |
| 6581 | 241 | 700044219H1 | SATMON004 | g168579 | BLASTN | 1200 | 1e-91 | 100 |
| 6582 | 241 | 700220031H1 | SATMON011 | g168579 | BLASTN | 1203 | 1e-91 | 96 |
| 6583 | 241 | 700454149H1 | SATMON029 | g168579 | BLASTN | 1203 | 1e-91 | 95 |
| 6584 | 241 | 700578265H1 | SATMON031 | g168579 | BLASTN | 1074 | 1e-90 | 98 |

TABLE A*-continued

| Seq No. | Cluster ID | CloneID | Library | NCBI gi | Method | Score | P-value | % Ident |
|---|---|---|---|---|---|---|---|---|
| 6585 | 241 | 700442849H1 | SATMON026 | g168579 | BLASTN | 891 | 1e−89 | 94 |
| 6586 | 241 | 700044381H1 | SATMON004 | g168579 | BLASTN | 1033 | 1e−89 | 95 |
| 6587 | 241 | 700578031H1 | SATMON031 | g168579 | BLASTN | 1175 | 1e−89 | 96 |
| 6588 | 241 | 700802158H1 | SATMON036 | g168579 | BLASTN | 1183 | 1e−89 | 91 |
| 6589 | 241 | 700581537H1 | SATMON031 | g168579 | BLASTN | 434 | 1e−88 | 97 |
| 6590 | 241 | 700447772H1 | SATMON027 | g168579 | BLASTN | 628 | 1e−88 | 96 |
| 6591 | 241 | 700044908H1 | SATMON004 | g168579 | BLASTN | 1166 | 1e−88 | 97 |
| 6592 | 241 | 700806626H1 | SATMON036 | g168579 | BLASTN | 1167 | 1e−88 | 95 |
| 6593 | 241 | 700580766H1 | SATMON031 | g168579 | BLASTN | 1168 | 1e−88 | 98 |
| 6594 | 241 | 700100482H1 | SATMON009 | g168579 | BLASTN | 1169 | 1e−88 | 87 |
| 6595 | 241 | 700428285H1 | SATMONN01 | g168579 | BLASTN | 707 | 1e−87 | 97 |
| 6596 | 241 | 700158124H1 | SATMON012 | g168579 | BLASTN | 918 | 1e−87 | 98 |
| 6597 | 241 | 700439158H1 | SATMON026 | g168579 | BLASTN | 922 | 1e−87 | 93 |
| 6598 | 241 | 700577046H1 | SATMON031 | g168579 | BLASTN | 989 | 1e−87 | 97 |
| 6599 | 241 | 700098026H1 | SATMON009 | g168579 | BLASTN | 1151 | 1e−87 | 87 |
| 6600 | 241 | 700099229H1 | SATMON009 | g168579 | BLASTN | 1154 | 1e−87 | 98 |
| 6601 | 241 | 700045027H1 | SATMON004 | g168579 | BLASTN | 1162 | 1e−87 | 97 |
| 6602 | 241 | 701177010H1 | SATMONN05 | g22452 | BLASTN | 413 | 1e−86 | 94 |
| 6603 | 241 | 700044687H1 | SATMON004 | g168579 | BLASTN | 660 | 1e−86 | 99 |
| 6604 | 241 | 700438501H1 | SATMON026 | g168579 | BLASTN | 714 | 1e−86 | 95 |
| 6605 | 241 | 700044229H1 | SATMON004 | g168579 | BLASTN | 965 | 1e−86 | 100 |
| 6606 | 241 | 700447355H1 | SATMON027 | g168579 | BLASTN | 1074 | 1e−86 | 96 |
| 6607 | 241 | 700806248H1 | SATMON036 | g168579 | BLASTN | 1082 | 1e−86 | 96 |
| 6608 | 241 | 700044220H1 | SATMON004 | g168579 | BLASTN | 1132 | 1e−85 | 97 |
| 6609 | 241 | 700193031H1 | SATMON014 | g168579 | BLASTN | 1121 | 1e−84 | 92 |
| 6610 | 241 | 700581571H1 | SATMON031 | g168584 | BLASTN | 461 | 1e−83 | 95 |
| 6611 | 241 | 700100987H1 | SATMON009 | g168579 | BLASTN | 1006 | 1e−83 | 93 |
| 6612 | 241 | 700439748H1 | SATMON026 | g168579 | BLASTN | 1107 | 1e−83 | 97 |
| 6613 | 241 | 700441474H1 | SATMON026 | g168579 | BLASTN | 570 | 1e−82 | 96 |
| 6614 | 241 | 700042302H1 | SATMON004 | g168579 | BLASTN | 586 | 1e−82 | 98 |
| 6615 | 241 | 700616327H1 | SATMON033 | g168579 | BLASTN | 604 | 1e−82 | 88 |
| 6616 | 241 | 700194736H1 | SATMON014 | g168584 | BLASTN | 625 | 1e−82 | 96 |
| 6617 | 241 | 700578367H1 | SATMON031 | g168579 | BLASTN | 674 | 1e−82 | 96 |
| 6618 | 241 | 700042652H1 | SATMON004 | g168579 | BLASTN | 693 | 1e−82 | 98 |
| 6619 | 241 | 700397564H1 | SATMONN01 | g168579 | BLASTN | 965 | 1e−82 | 89 |
| 6620 | 241 | 700434288H1 | SATMONN01 | g168584 | BLASTN | 1096 | 1e−82 | 92 |
| 6621 | 241 | 700429519H1 | SATMONN01 | g168579 | BLASTN | 1098 | 1e−82 | 89 |
| 6622 | 241 | 700438174H1 | SATMON026 | g168579 | BLASTN | 1102 | 1e−82 | 90 |
| 6623 | 241 | 700583672H1 | SATMON031 | g168579 | BLASTN | 894 | 1e−81 | 88 |
| 6624 | 241 | 700441307H1 | SATMON026 | g168579 | BLASTN | 1088 | 1e−81 | 99 |
| 6625 | 241 | 701176710H1 | SATMONN05 | g22452 | BLASTN | 477 | 1e−79 | 94 |
| 6626 | 241 | 700581577H1 | SATMON031 | g168579 | BLASTN | 551 | 1e−79 | 94 |
| 6627 | 241 | 700428336H1 | SATMONN01 | g168579 | BLASTN | 948 | 1e−79 | 92 |
| 6628 | 241 | 700018165H1 | SATMON001 | g168579 | BLASTN | 1020 | 1e−79 | 98 |
| 6629 | 241 | 700405414H1 | SATMON029 | g168579 | BLASTN | 1058 | 1e−79 | 98 |
| 6630 | 241 | 700239413H1 | SATMON010 | g168579 | BLASTN | 965 | 1e−78 | 95 |
| 6631 | 241 | 700581594H1 | SATMON031 | g168579 | BLASTN | 607 | 1e−76 | 89 |
| 6632 | 241 | 700433062H1 | SATMONN01 | g168579 | BLASTN | 642 | 1e−76 | 85 |
| 6633 | 241 | 700581979H1 | SATMON031 | g168579 | BLASTN | 1019 | 1e−76 | 85 |
| 6634 | 241 | 700441332H1 | SATMON026 | g168579 | BLASTN | 1023 | 1e−76 | 94 |
| 6635 | 241 | 700441363H1 | SATMON026 | g168579 | BLASTN | 1016 | 1e−75 | 94 |
| 6636 | 241 | 700807116H1 | SATMON036 | g168581 | BLASTN | 686 | 1e−74 | 99 |
| 6637 | 241 | 700800557H1 | SATMON036 | g168579 | BLASTN | 985 | 1e−73 | 86 |
| 6638 | 241 | 700803903H1 | SATMON036 | g168579 | BLASTN | 391 | 1e−72 | 87 |
| 6639 | 241 | 700257764H1 | SATMON017 | g168579 | BLASTN | 974 | 1e−72 | 94 |
| 6640 | 241 | 700207392H1 | SATMON016 | g168579 | BLASTN | 960 | 1e−71 | 100 |
| 6641 | 241 | 700193933H1 | SATMON014 | g168579 | BLASTN | 969 | 1e−71 | 88 |
| 6642 | 241 | 700806409H1 | SATMON036 | g168581 | BLASTN | 543 | 1e−69 | 96 |
| 6643 | 241 | 700195405H1 | SATMON014 | g168579 | BLASTN | 740 | 1e−69 | 87 |
| 6644 | 241 | 700579292H1 | SATMON031 | g168579 | BLASTN | 746 | 1e−69 | 94 |
| 6645 | 241 | 700427458H1 | SATMONN01 | g168584 | BLASTN | 337 | 1e−68 | 88 |
| 6646 | 241 | 700624196H1 | SATMON034 | g168579 | BLASTN | 648 | 1e−66 | 90 |
| 6647 | 241 | 700805096H1 | SATMON036 | g168579 | BLASTN | 900 | 1e−66 | 86 |
| 6648 | 241 | 700042161H1 | SATMON004 | g168579 | BLASTN | 903 | 1e−66 | 91 |
| 6649 | 241 | 700578768H1 | SATMON031 | g168584 | BLASTN | 908 | 1e−66 | 93 |
| 6650 | 241 | 700802865H1 | SATMON036 | g168584 | BLASTN | 705 | 1e−65 | 94 |
| 6651 | 241 | 700580152H1 | SATMON031 | g168579 | BLASTN | 863 | 1e−63 | 96 |
| 6652 | 241 | 700041938H1 | SATMON004 | g168584 | BLASTN | 845 | 1e−61 | 100 |
| 6653 | 241 | 700196549H1 | SATMON014 | g168579 | BLASTN | 848 | 1e−61 | 91 |
| 6654 | 241 | 700425162H1 | SATMONN01 | g22451 | BLASTN | 805 | 1e−60 | 100 |
| 6655 | 241 | 701160579H1 | SATMONN04 | g168579 | BLASTN | 380 | 1e−59 | 96 |
| 6656 | 241 | 700456514H1 | SATMON029 | g168579 | BLASTN | 822 | 1e−59 | 92 |
| 6657 | 241 | 700441507H1 | SATMON026 | g168579 | BLASTN | 697 | 1e−58 | 96 |
| 6658 | 241 | 700099603H1 | SATMON009 | g168579 | BLASTN | 804 | 1e−58 | 98 |
| 6659 | 241 | 700442758H1 | SATMON026 | g168579 | BLASTN | 326 | 1e−56 | 90 |
| 6660 | 241 | 700804296H1 | SATMON036 | g168579 | BLASTN | 687 | 1e−54 | 84 |
| 6661 | 241 | 700438664H1 | SATMON026 | g168579 | BLASTN | 277 | 1e−53 | 96 |

TABLE A*-continued

| Seq No. | Cluster ID | CloneID | Library | NCBI gi | Method | Score | P-value | % Ident |
|---|---|---|---|---|---|---|---|---|
| 6662 | 241 | 700441510H1 | SATMON026 | g168579 | BLASTN | 388 | 1e−52 | 96 |
| 6663 | 241 | 700428514H1 | SATMONN01 | g168579 | BLASTN | 491 | 1e−52 | 96 |
| 6664 | 241 | 700101932H1 | SATMON009 | g168579 | BLASTN | 384 | 1e−50 | 92 |
| 6665 | 241 | 700262656H1 | SATMON017 | g168579 | BLASTN | 542 | 1e−49 | 93 |
| 6666 | 241 | 700583279H1 | SATMON031 | g168579 | BLASTN | 449 | 1e−47 | 95 |
| 6667 | 241 | 700624652H1 | SATMON034 | g168579 | BLASTN | 623 | 1e−47 | 96 |
| 6668 | 241 | 700612451H1 | SATMON033 | g168579 | BLASTN | 672 | 1e−47 | 89 |
| 6669 | 241 | 700335324H1 | SATMON019 | g168581 | BLASTN | 637 | 1e−46 | 71 |
| 6670 | 241 | 700440390H1 | SATMON026 | g168579 | BLASTN | 361 | 1e−45 | 95 |
| 6671 | 241 | 700097825H1 | SATMON009 | g168579 | BLASTN | 650 | 1e−45 | 100 |
| 6672 | 241 | 701163821H1 | SATMONN04 | g168581 | BLASTN | 606 | 1e−44 | 98 |
| 6673 | 241 | 700438560H1 | SATMON026 | g168584 | BLASTN | 623 | 1e−43 | 96 |
| 6674 | 241 | 700805587H1 | SATMON036 | g168579 | BLASTN | 632 | 1e−43 | 84 |
| 6675 | 241 | 700100859H1 | SATMON009 | g168579 | BLASTN | 612 | 1e−42 | 97 |
| 6676 | 241 | 700580595H1 | SATMON031 | g168579 | BLASTN | 295 | 1e−39 | 81 |
| 6677 | 241 | 700441529H1 | SATMON026 | g168584 | BLASTN | 302 | 1e−37 | 97 |
| 6678 | 241 | 700045548H1 | SATMON004 | g22451 | BLASTN | 511 | 1e−36 | 99 |
| 6679 | 241 | 700097365H1 | SATMON009 | g168579 | BLASTN | 544 | 1e−36 | 97 |
| 6680 | 241 | 700424468H1 | SATMONN01 | g168579 | BLASTN | 547 | 1e−36 | 94 |
| 6681 | 241 | 700457633H1 | SATMON029 | g168584 | BLASTN | 275 | 1e−35 | 96 |
| 6682 | 241 | 700425102H1 | SATMONN01 | g168579 | BLASTN | 472 | 1e−33 | 92 |
| 6683 | 241 | 700097811H1 | SATMON009 | g168579 | BLASTN | 501 | 1e−32 | 87 |
| 6684 | 241 | 700404795H1 | SATMON026 | g168584 | BLASTN | 483 | 1e−31 | 98 |
| 6685 | 241 | 700431218H1 | SATMONN01 | g168579 | BLASTN | 302 | 1e−29 | 96 |
| 6686 | 241 | 700097835H1 | SATMON009 | g168579 | BLASTN | 337 | 1e−29 | 89 |
| 6687 | 241 | 700100627H1 | SATMON009 | g168579 | BLASTN | 444 | 1e−28 | 94 |
| 6688 | 241 | 700618263H1 | SATMON033 | g168579 | BLASTN | 286 | 1e−27 | 88 |
| 6689 | 241 | 700583801H1 | SATMON031 | g168579 | BLASTN | 350 | 1e−26 | 95 |
| 6690 | 241 | 700099807H1 | SATMON009 | g168579 | BLASTN | 233 | 1e−24 | 94 |
| 6691 | 241 | 700097573H1 | SATMON009 | g168579 | BLASTN | 305 | 1e−23 | 92 |
| 6692 | 241 | 700427553H1 | SATMONN01 | g168584 | BLASTN | 344 | 1e−23 | 93 |
| 6693 | 241 | 700098562H1 | SATMON009 | g168579 | BLASTN | 309 | 1e−16 | 95 |
| 6694 | 241 | 700799964H1 | SATMON036 | g168584 | BLASTN | 234 | 1e−13 | 94 |
| 6695 | 3862 | 700266534H1 | SATMON017 | g257804 | BLASTN | 923 | 1e−77 | 97 |
| 6696 | 3862 | 700455813H1 | SATMON029 | g257804 | BLASTN | 879 | 1e−66 | 98 |
| 6697 | 3862 | 700099255H1 | SATMON009 | g168579 | BLASTN | 460 | 1e−29 | 91 |
| 6698 | 5767 | 700098424H1 | SATMON009 | g22449 | BLASTN | 1555 | 1e−120 | 98 |
| 6699 | 5767 | 700099971H1 | SATMON009 | g168583 | BLASTN | 1468 | 1e−113 | 96 |
| 6700 | 5767 | 700044869H1 | SATMON004 | g168583 | BLASTN | 1242 | 1e−99 | 98 |
| 6701 | 5767 | 700097037H1 | SATMON009 | g168579 | BLASTN | 1264 | 1e−96 | 89 |
| 6702 | 5767 | 700095363H1 | SATMON008 | g168583 | BLASTN | 310 | 1e−78 | 97 |
| 6703 | 5767 | 700101364H1 | SATMON009 | g22449 | BLASTN | 1006 | 1e−75 | 94 |
| 6704 | 5767 | 700101568H1 | SATMON009 | g22449 | BLASTN | 1013 | 1e−75 | 95 |
| 6705 | 5767 | 700045180H1 | SATMON004 | g22449 | BLASTN | 901 | 1e−74 | 90 |
| 6706 | 5767 | 700042559H1 | SATMON004 | g22449 | BLASTN | 998 | 1e−74 | 94 |
| 6707 | 5767 | 700045393H1 | SATMON004 | g22449 | BLASTN | 865 | 1e−63 | 100 |
| 6708 | 5767 | 700099658H1 | SATMON009 | g22449 | BLASTN | 531 | 1e−35 | 92 |
| 6709 | −L1433809 | LIB143-024-Q1-E1-F11 | LIB143 | g168579 | BLASTN | 256 | 1e−23 | 81 |
| 6710 | −L30592709 | LIB3059-017-Q1-K1-F2 | LIB3059 | g2443401 | BLASTN | 431 | 1e−27 | 68 |
| 6711 | −L30593789 | LIB3059-022-Q1-K1-D6 | LIB3059 | g168584 | BLASTN | 361 | 1e−21 | 89 |
| 6712 | −L30594314 | LIB3059-032-Q1-K1-G4 | LIB3059 | g168579 | BLASTN | 488 | 1e−29 | 63 |
| 6713 | −L30594987 | LIB3059-056-Q1-K1-G11 | LIB3059 | g168579 | BLASTN | 406 | 1e−41 | 73 |
| 6714 | −L30596613 | LIB3059-054-Q1-K1-F4 | LIB3059 | g168579 | BLASTN | 568 | 1e−52 | 78 |
| 6715 | −L30602598 | LIB3060-018-Q1-K1-B4 | LIB3060 | g168579 | BLASTN | 580 | 1e−79 | 73 |
| 6716 | −L30602793 | LIB3060-014-Q1-K1-C6 | LIB3060 | g168583 | BLASTN | 513 | 1e−62 | 77 |
| 6717 | −L30602820 | LIB3060-017-Q1-K1-B1 | LIB3060 | g168579 | BLASTN | 151 | 1e−12 | 89 |
| 6718 | −L30603538 | LIB3060-045-Q1-K1-E12 | LIB3060 | g168583 | BLASTN | 382 | 1e−34 | 88 |
| 6719 | −L30603998 | LIB3060-036-Q1-K1-H4 | LIB3060 | g168579 | BLASTN | 678 | 1e−90 | 82 |
| 6720 | −L30605229 | LIB3060-050-Q1-K1-D5 | LIB3060 | g168579 | BLASTN | 305 | 1e−16 | 80 |
| 6721 | −L30611520 | LIB3061-002-Q1-K2-D12 | LIB3061 | g168581 | BLASTN | 492 | 1e−41 | 82 |
| 6722 | −L30615750 | LIB3061-042-Q1-K1-H11 | LIB3061 | g168579 | BLASTN | 223 | 1e−11 | 96 |
| 6723 | −L30783291 | LIB3078-051-Q1-K1-G3 | LIB3078 | g168579 | BLASTN | 538 | 1e−70 | 73 |

TABLE A*-continued

| Seq No. | Cluster ID | CloneID | Library | NCBI gi | Method | Score | P-value | % Ident |
|---|---|---|---|---|---|---|---|---|
| 6724 | -L30784553 | LIB3078-011-Q1-K1-B7 | LIB3078 | g168579 | BLASTN | 671 | 1e-90 | 83 |
| 6725 | -L361816 | LIB36-020-Q1-E1-A10 | LIB36 | g168579 | BLASTN | 738 | 1e-69 | 82 |
| 6726 | -L362168 | LIB36-005-Q1-E1-D11 | LIB36 | g168579 | BLASTN | 304 | 1e-15 | 72 |
| 6727 | -L362639 | LIB36-007-Q1-E1-F2 | LIB36 | g168584 | BLASTN | 332 | 1e-36 | 86 |
| 6728 | -L831870 | LIB83-009-Q1-E1-E9 | LIB83 | g168579 | BLASTN | 250 | 1e-11 | 100 |
| 6729 | -L831984 | LIB83-010-Q1-E1-B1 | LIB83 | g168584 | BLASTN | 382 | 1e-41 | 89 |
| 6730 | 241 | LIB36-016-Q2-E2-E10 | LIB36 | g168579 | BLASTN | 2261 | 1e-179 | 99 |
| 6731 | 241 | LIB3060-003-Q1-K1-C3 | LIB3060 | g168579 | BLASTN | 2186 | 1e-173 | 99 |
| 6732 | 241 | LIB3078-052-Q1-K1-H5 | LIB3078 | g168579 | BLASTN | 2188 | 1e-173 | 99 |
| 6733 | 241 | LIB3078-033-Q1-K1-A12 | LIB3078 | g168579 | BLASTN | 2176 | 1e-172 | 98 |
| 6734 | 241 | LIB36-016-Q2-E2-C3 | LIB36 | g168579 | BLASTN | 2164 | 1e-171 | 98 |
| 6735 | 241 | LIB3060-054-Q1-K1-E4 | LIB3060 | g168579 | BLASTN | 1973 | 1e-168 | 97 |
| 6736 | 241 | LIB36-016-Q2-E2-C5 | LIB36 | g168579 | BLASTN | 2130 | 1e-168 | 98 |
| 6737 | 241 | LIB36-014-Q1-E1-D2 | LIB36 | g168579 | BLASTN | 1968 | 1e-167 | 96 |
| 6738 | 241 | LIB3059-058-Q1-K1-A12 | LIB3059 | g168579 | BLASTN | 2112 | 1e-167 | 98 |
| 6739 | 241 | LIB3060-006-Q1-K1-C1 | LIB3060 | g168579 | BLASTN | 1699 | 1e-165 | 97 |
| 6740 | 241 | LIB3060-016-Q1-K1-F8 | LIB3060 | g168579 | BLASTN | 2051 | 1e-165 | 99 |
| 6741 | 241 | LIB3060-045-Q1-K1-E3 | LIB3060 | g168579 | BLASTN | 2098 | 1e-165 | 97 |
| 6742 | 241 | LIB3060-026-Q1-K1-D6 | LIB3060 | g168579 | BLASTN | 1162 | 1e-164 | 94 |
| 6743 | 241 | LIB3060-012-Q1-K1-A7 | LIB3060 | g168579 | BLASTN | 1897 | 1e-164 | 98 |
| 6744 | 241 | LIB83-003-Q1-E1-G2 | LIB83 | g168579 | BLASTN | 2077 | 1e-164 | 96 |
| 6745 | 241 | LIB143-022-Q1-E1-G5 | LIB143 | g168579 | BLASTN | 2087 | 1e-164 | 98 |
| 6746 | 241 | LIB3060-044-Q1-K1-F6 | LIB3060 | g168579 | BLASTN | 1768 | 1e-163 | 95 |
| 6747 | 241 | LIB3060-025-Q1-K1-B10 | LIB3060 | g168579 | BLASTN | 2058 | 1e-162 | 96 |
| 6748 | 241 | LIB36-005-Q1-E1-C7 | LIB36 | g168579 | BLASTN | 2059 | 1e-162 | 97 |
| 6749 | 241 | LIB3060-052-Q1-K1-D5 | LIB3060 | g168579 | BLASTN | 1831 | 1e-161 | 97 |
| 6750 | 241 | LIB3059-024-Q1-K1-F6 | LIB3059 | g168579 | BLASTN | 1932 | 1e-161 | 99 |
| 6751 | 241 | LIB36-002-Q1-E1-B10 | LIB36 | g168579 | BLASTN | 2051 | 1e-161 | 98 |
| 6752 | 241 | LIB3060-052-Q1-K1-E8 | LIB3060 | g168579 | BLASTN | 1740 | 1e-160 | 97 |
| 6753 | 241 | LIB3060-016-Q1-K1-G8 | LIB3060 | g168579 | BLASTN | 2030 | 1e-160 | 97 |
| 6754 | 241 | LIB84-004-Q1-E1-C3 | LIB84 | g168579 | BLASTN | 2034 | 1e-160 | 97 |
| 6755 | 241 | LIB3060-051-Q1-K1-E9 | LIB3060 | g168579 | BLASTN | 2037 | 1e-160 | 98 |
| 6756 | 241 | LIB84-013-Q1-E1-A5 | LIB84 | g168579 | BLASTN | 2018 | 1e-159 | 98 |
| 6757 | 241 | LIB3078-002-Q1-K1-E2 | LIB3078 | g168579 | BLASTN | 2027 | 1e-159 | 97 |
| 6758 | 241 | LIB189-006-Q1-E1-G6 | LIB189 | g168579 | BLASTN | 1791 | 1e-158 | 99 |
| 6759 | 241 | LIB3060-044-Q1-K1-F8 | LIB3060 | g168579 | BLASTN | 1692 | 1e-157 | 98 |
| 6760 | 241 | LIB36-004-Q1-E1-B11 | LIB36 | g168579 | BLASTN | 1892 | 1e-157 | 98 |
| 6761 | 241 | LIB3078-013-Q1-K1-H10 | LIB3078 | g168579 | BLASTN | 1853 | 1e-156 | 97 |

TABLE A*-continued

| Seq No. | Cluster ID | CloneID | Library | NCBI gi | Method | Score | P-value | % Ident |
|---|---|---|---|---|---|---|---|---|
| 6762 | 241 | LIB36-015-Q1-E1-F9 | LIB36 | g168579 | BLASTN | 1988 | 1e-156 | 98 |
| 6763 | 241 | LIB189-020-Q1-E1-G9 | LIB189 | g168579 | BLASTN | 1972 | 1e-155 | 98 |
| 6764 | 241 | LIB36-004-Q1-E1-F10 | LIB36 | g168579 | BLASTN | 1972 | 1e-155 | 99 |
| 6765 | 241 | LIB3060-005-Q1-K1-B6 | LIB3060 | g168579 | BLASTN | 1974 | 1e-155 | 99 |
| 6766 | 241 | LIB3060-052-Q1-K1-H7 | LIB3060 | g168579 | BLASTN | 1979 | 1e-155 | 94 |
| 6767 | 241 | LIB189-007-Q1-E1-G11 | LIB189 | g168579 | BLASTN | 1130 | 1e-154 | 99 |
| 6768 | 241 | LIB83-006-Q1-E1-C7 | LIB83 | g168579 | BLASTN | 1964 | 1e-154 | 98 |
| 6769 | 241 | LIB189-009-Q1-E1-G9 | LIB189 | g168579 | BLASTN | 1405 | 1e-150 | 97 |
| 6770 | 241 | LIB3060-036-Q1-K1-H3 | LIB3060 | g168579 | BLASTN | 1910 | 1e-150 | 94 |
| 6771 | 241 | LIB189-013-Q1-E1-D10 | LIB189 | g168579 | BLASTN | 1732 | 1e-149 | 93 |
| 6772 | 241 | LIB36-014-Q1-E1-D12 | LIB36 | g168579 | BLASTN | 1519 | 1e-147 | 95 |
| 6773 | 241 | LIB3078-055-Q1-K1-E2 | LIB3078 | g168579 | BLASTN | 1860 | 1e-146 | 90 |
| 6774 | 241 | LIB3060-004-Q1-K1-D9 | LIB3060 | g168579 | BLASTN | 1830 | 1e-143 | 97 |
| 6775 | 241 | LIB189-020-Q1-E1-G4 | LIB189 | g168579 | BLASTN | 1823 | 1e-142 | 92 |
| 6776 | 241 | LIB3060-008-Q1-K1-D10 | LIB3060 | g168579 | BLASTN | 1511 | 1e-140 | 90 |
| 6777 | 241 | LIB189-008-Q1-E1-B5 | LIB189 | g168579 | BLASTN | 1379 | 1e-139 | 95 |
| 6778 | 241 | LIB3059-040-Q1-K1-E1 | LIB3059 | g168579 | BLASTN | 1437 | 1e-139 | 91 |
| 6779 | 241 | LIB3078-051-Q1-K1-G2 | LIB3078 | g168579 | BLASTN | 1474 | 1e-139 | 96 |
| 6780 | 241 | LIB84-029-Q1-E1-E6 | LIB84 | g168579 | BLASTN | 1508 | 1e-136 | 98 |
| 6781 | 241 | LIB36-004-Q1-E1-D1 | LIB36 | g168579 | BLASTN | 1310 | 1e-134 | 94 |
| 6782 | 241 | LIB3059-012-Q1-K1-D10 | LIB3059 | g168579 | BLASTN | 1720 | 1e-134 | 89 |
| 6783 | 241 | LIB3059-044-Q1-K1-E2 | LIB3059 | g168579 | BLASTN | 1725 | 1e-134 | 87 |
| 6784 | 241 | LIB3059-043-Q1-K1-F7 | LIB3059 | g168579 | BLASTN | 1588 | 1e-133 | 87 |
| 6785 | 241 | LIB189-008-Q1-E1-H1 | LIB189 | g168579 | BLASTN | 1705 | 1e-133 | 91 |
| 6786 | 241 | LIB83-003-Q1-E1-D3 | LIB83 | g168579 | BLASTN | 1422 | 1e-131 | 97 |
| 6787 | 241 | LIB189-002-Q1-E1-C11 | LIB189 | g168579 | BLASTN | 1656 | 1e-131 | 97 |
| 6788 | 241 | LIB36-002-Q1-E1-F3 | LIB36 | g168579 | BLASTN | 1546 | 1e-129 | 96 |
| 6789 | 241 | LIB189-015-Q1-E1-F3 | LIB189 | g168579 | BLASTN | 1062 | 1e-127 | 94 |
| 6790 | 241 | LIB189-013-Q1-E1-F6 | LIB189 | g168579 | BLASTN | 1639 | 1e-127 | 97 |
| 6791 | 241 | LIB3061-007-Q1-K-A1 | LIB3061 | g168579 | BLASTN | 1625 | 1e-126 | 85 |
| 6792 | 241 | LIB3060-054-Q1-K1-D4 | LIB3060 | g168579 | BLASTN | 879 | 1e-123 | 89 |
| 6793 | 241 | LIB3078-028-Q1-K1-A6 | LIB3078 | g168579 | BLASTN | 1066 | 1e-123 | 93 |
| 6794 | 241 | LIB3059-047-Q1-K1-H7 | LIB3059 | g168579 | BLASTN | 1576 | 1e-122 | 85 |
| 6795 | 241 | LIB36-021-Q1-E1-F1 | LIB36 | g168579 | BLASTN | 1465 | 1e-121 | 100 |
| 6796 | 241 | LIB3059-002-Q1-K2-A4 | LIB3059 | g168579 | BLASTN | 1273 | 1e-119 | 81 |
| 6797 | 241 | LIB189-015-Q1-E1-G8 | LIB189 | g168579 | BLASTN | 1530 | 1e-118 | 94 |
| 6798 | 241 | LIB189-007-Q1-E1-F9 | LIB189 | g168579 | BLASTN | 1517 | 1e-117 | 96 |
| 6799 | 241 | LIB3079-013-Q1-K1-G8 | LIB3079 | g168579 | BLASTN | 1367 | 1e-115 | 90 |

TABLE A*-continued

| Seq No. | Cluster ID | CloneID | Library | NCBI gi | Method | Score | P-value | % Ident |
|---|---|---|---|---|---|---|---|---|
| 6800 | 241 | LIB36-015-Q1-E1-D2 | LIB36 | g168579 | BLASTN | 1333 | 1e−113 | 95 |
| 6801 | 241 | LIB3059-018-Q1-K1-H2 | LIB3059 | g168579 | BLASTN | 1210 | 1e−112 | 86 |
| 6802 | 241 | LIB3078-007-Q1-K1-E1 | LIB3078 | g168579 | BLASTN | 508 | 1e−111 | 90 |
| 6803 | 241 | LIB3060-038-Q1-K1-H3 | LIB3060 | g168579 | BLASTN | 1443 | 1e−111 | 98 |
| 6804 | 241 | LIB36-020-Q1-E1-A9 | LIB36 | g168579 | BLASTN | 1446 | 1e−111 | 95 |
| 6805 | 241 | LIB3061-026-Q1-K1-D7 | LIB3061 | g168579 | BLASTN | 1435 | 1e−110 | 86 |
| 6806 | 241 | LIB36-021-Q1-E1-G7 | LIB36 | g168579 | BLASTN | 1381 | 1e−109 | 96 |
| 6807 | 241 | LIB3059-028-Q1-K1-G7 | LIB3059 | g168579 | BLASTN | 884 | 1e−108 | 88 |
| 6808 | 241 | LIB189-029-Q1-E1-D4 | LIB189 | g168579 | BLASTN | 982 | 1e−108 | 87 |
| 6809 | 241 | LIB3060-020-Q1-K1-F2 | LIB3060 | g168579 | BLASTN | 1053 | 1e−108 | 77 |
| 6810 | 241 | LIB36-007-Q1-E1-E9 | LIB36 | g168579 | BLASTN | 1348 | 1e−108 | 94 |
| 6811 | 241 | LIB3059-017-Q1-K1-C3 | LIB3059 | g168579 | BLASTN | 1096 | 1e−106 | 87 |
| 6812 | 241 | LIB3061-051-Q1-K1-H5 | LIB3061 | g168581 | BLASTN | 931 | 1e−104 | 90 |
| 6813 | 241 | LIB3061-009-Q1-K1-F12 | LIB3061 | g168579 | BLASTN | 1032 | 1e−102 | 76 |
| 6814 | 241 | LIB3061-041-Q1-K1-C5 | LIB3061 | g168579 | BLASTN | 1326 | 1e−101 | 88 |
| 6815 | 241 | LIB36-013-Q1-E1-B6 | LIB36 | g168579 | BLASTN | 1328 | 1e−101 | 91 |
| 6816 | 241 | LIB84-016-Q1-E1-A7 | LIB84 | g168579 | BLASTN | 1308 | 1e−100 | 97 |
| 6817 | 241 | LIB84-002-Q1-E1-D6 | LIB84 | g168579 | BLASTN | 716 | 1e−99 | 90 |
| 6818 | 241 | LIB3060-039-Q1-K1-E5 | LIB3060 | g168579 | BLASTN | 1166 | 1e−99 | 92 |
| 6819 | 241 | LIB3078-011-Q1-K1-E7 | LIB3078 | g168579 | BLASTN | 558 | 1e−95 | 84 |
| 6820 | 241 | LIB3060-052-Q1-K1-H8 | LIB3060 | g168579 | BLASTN | 596 | 1e−95 | 89 |
| 6821 | 241 | LIB3060-026-Q1-K1-D7 | LIB3060 | g168579 | BLASTN | 817 | 1e−94 | 82 |
| 6822 | 241 | LIB3059-003-Q1-K1-F1 | LIB3059 | g168579 | BLASTN | 954 | 1e−93 | 86 |
| 6823 | 241 | LIB189-006-Q1-E1-C4 | LIB189 | g22451 | BLASTN | 1136 | 1e−88 | 97 |
| 6824 | 241 | LIB189-029-Q1-E1-C2 | LIB189 | g168579 | BLASTN | 746 | 1e−87 | 92 |
| 6825 | 241 | LIB84-003-Q1-E1-C2 | LIB84 | g168584 | BLASTN | 1143 | 1e−86 | 99 |
| 6826 | 241 | LIB36-014-Q1-E1-A2 | LIB36 | g168579 | BLASTN | 760 | 1e−83 | 97 |
| 6827 | 241 | LIB3078-011-Q1-K1-D6 | LIB3078 | g22451 | BLASTN | 1085 | 1e−83 | 100 |
| 6828 | 241 | LIB3059-031-Q1-K1-E3 | LIB3059 | g168581 | BLASTN | 914 | 1e−81 | 93 |
| 6829 | 241 | LIB189-023-Q1-E1-E7 | LIB189 | g168581 | BLASTN | 755 | 1e−80 | 100 |
| 6830 | 241 | LIB83-009-Q1-E1-D12 | LIB83 | g168579 | BLASTN | 1003 | 1e−74 | 92 |
| 6831 | 241 | LIB83-010-Q1-E1-G9 | LIB83 | g168584 | BLASTN | 546 | 1e−65 | 98 |
| 6832 | 241 | LIB189-017-Q1-E1-A5 | LIB189 | g22451 | BLASTN | 822 | 1e−61 | 93 |
| 6833 | 241 | LIB3061-002-Q1-K1-D12 | LIB3061 | g168579 | BLASTN | 421 | 1e−57 | 87 |
| 6834 | 241 | LIB3059-058-Q1-K1-A4 | LIB3059 | g168579 | BLASTN | 624 | 1e−55 | 86 |
| 6835 | 241 | LIB3059-023-Q1-K1-C3 | LIB3059 | g168579 | BLASTN | 728 | 1e−51 | 85 |
| 6836 | 241 | LIB189-027-Q1-E1-F4 | LIB189 | g168579 | BLASTN | 649 | 1e−49 | 87 |
| 6837 | 241 | LIB3059-020-Q1-K1-E10 | LIB3059 | g22389 | BLASTN | 475 | 1e−48 | 91 |

TABLE A*-continued

| Seq No. | Cluster ID | CloneID | Library | NCBI gi | Method | Score | P-value | % Ident |
|---|---|---|---|---|---|---|---|---|
| 6838 | 241 | LIB3060-045-Q1-K1-H10 | LIB3060 | g168579 | BLASTN | 569 | 1e−47 | 89 |
| 6839 | 241 | LIB84-003-Q1-E1-A10 | LIB84 | g22451 | BLASTN | 668 | 1e−47 | 90 |
| 6840 | 241 | LIB3059-037-Q1-K1-H8 | LIB3059 | g22389 | BLASTN | 475 | 1e−35 | 91 |
| 6841 | 5767 | LIB3060-051-Q1-K1-C1 | LIB3060 | g22449 | BLASTN | 1640 | 1e−164 | 99 |
| 6842 | 5767 | LIB3060-015-Q1-K1-G11 | LIB3060 | g168583 | BLASTN | 1920 | 1e−162 | 99 |
| 6843 | 5767 | LIB3060-017-Q1-K1-A8 | LIB3060 | g168583 | BLASTN | 2060 | 1e−162 | 100 |
| 6844 | 5767 | LIB3060-014-Q1-K1-C3 | LIB3060 | g22449 | BLASTN | 1933 | 1e−159 | 97 |
| 6845 | 5767 | LIB3060-010-Q1-K1-H5 | LIB3060 | g22449 | BLASTN | 1285 | 1e−156 | 99 |
| 6846 | 5767 | LIB3060-045-Q1-K1-C7 | LIB3060 | g22449 | BLASTN | 1020 | 1e−76 | 95 |
| 6847 | 5767 | LIB3060-027-Q1-K1-E7 | LIB3060 | g22449 | BLASTN | 1025 | 1e−76 | 95 |
| | | | SOYBEAN PYRUVATE, PHOSPHATE DIKINASE | | | | | |
| 6848 | -700646607 | 700646607H1 | SOYMON014 | g18461 | BLASTN | 947 | 1e−70 | 81 |
| 6849 | 30854 | 700787466H2 | SOYMON011 | g577775 | BLASTN | 825 | 1e−59 | 80 |
| 6850 | 30854 | LIB3054-008-Q1-N1-C5 | LIB3054 | g577775 | BLASTN | 1279 | 1e−97 | 80 |
| | | | MAIZE PYROPHOSPHATASE | | | | | |
| 6851 | -700043816 | 700043816H1 | SATMON004 | g1049254 | BLASTN | 476 | 1e−30 | 76 |
| 6852 | -700049210 | 700049210H1 | SATMON003 | g1747293 | BLASTN | 216 | 1e−10 | 85 |
| 6853 | -700098741 | 700098741H1 | SATMON009 | g1747293 | BLASTN | 1093 | 1e−82 | 85 |
| 6854 | -700100718 | 700100718H1 | SATMON009 | g1747293 | BLASTN | 595 | 1e−40 | 86 |
| 6855 | -700105040 | 700105040H1 | SATMON010 | g1747293 | BLASTN | 463 | 1e−28 | 76 |
| 6856 | -700150777 | 700150777H1 | SATMON007 | g1747293 | BLASTN | 708 | 1e−50 | 89 |
| 6857 | -700155610 | 700155610H1 | SATMON009 | g1049254 | BLASTN | 311 | 1e−15 | 64 |
| 6858 | -700163331 | 700163331H1 | SATMON013 | g534915 | BLASTN | 751 | 1e−53 | 77 |
| 6859 | -700171438 | 700171438H1 | SATMON013 | g2258073 | BLASTN | 256 | 1e−10 | 76 |
| 6860 | -700193866 | 700193866H1 | SATMON014 | g166633 | BLASTN | 494 | 1e−32 | 64 |
| 6861 | -700202576 | 700202576H1 | SATMON003 | g2668746 | BLASTX | 214 | 1e−23 | 84 |
| 6862 | -700206487 | 700206487H1 | SATMON003 | g2570501 | BLASTX | 174 | 1e−17 | 86 |
| 6863 | -700216624 | 700216624H1 | SATMON016 | g1747293 | BLASTN | 936 | 1e−82 | 84 |
| 6864 | -700217292 | 700217292H1 | SATMON016 | g2668746 | BLASTX | 214 | 1e−23 | 100 |
| 6865 | -700240889 | 700240889H1 | SATMON010 | g2570500 | BLASTN | 639 | 1e−47 | 84 |
| 6866 | -700242309 | 700242309H1 | SATMON010 | g1747293 | BLASTN | 621 | 1e−42 | 69 |
| 6867 | -700347658 | 700347658H1 | SATMON023 | g2668746 | BLASTX | 215 | 1e−23 | 95 |
| 6868 | -700349391 | 700349391H1 | SATMON023 | g1049255 | BLASTX | 174 | 1e−17 | 52 |
| 6869 | -700427206 | 700427206H1 | SATMONN01 | g1049254 | BLASTN | 292 | 1e−33 | 90 |
| 6870 | -700451045 | 700451045H1 | SATMON028 | g1049255 | BLASTX | 55 | 1e−10 | 72 |
| 6871 | -700454151 | 700454151H1 | SATMON029 | g2668745 | BLASTN | 172 | 1e−10 | 90 |
| 6872 | -700454532 | 700454532H1 | SATMON029 | g2668745 | BLASTN | 259 | 1e−38 | 93 |
| 6873 | -700475488 | 700475488H1 | SATMON025 | g1747293 | BLASTN | 1126 | 1e−84 | 90 |
| 6874 | -700552133 | 700552133H1 | SATMON022 | g457744 | BLASTX | 176 | 1e−19 | 68 |
| 6875 | -700571086 | 700571086H1 | SATMON030 | g1747293 | BLASTN | 1429 | 1e−110 | 88 |
| 6876 | -700572341 | 700572341H1 | SATMON030 | g1747293 | BLASTN | 475 | 1e−70 | 89 |
| 6877 | -700611864 | 700611864H1 | SATMON022 | g2668745 | BLASTN | 203 | 1e−9 | 84 |
| 6878 | -701166871 | 701166871H1 | SATMONN04 | g1049255 | BLASTX | 105 | 1e−13 | 72 |
| 6879 | 107 | 700622451H1 | SATMON034 | g2668745 | BLASTN | 1645 | 1e−129 | 100 |
| 6880 | 107 | 700571235H1 | SATMON030 | g2668745 | BLASTN | 1406 | 1e−125 | 98 |
| 6881 | 107 | 700266126H1 | SATMON017 | g2668745 | BLASTN | 1145 | 1e−121 | 100 |
| 6882 | 107 | 700621607H1 | SATMON034 | g2668745 | BLASTN | 1375 | 1e−121 | 99 |
| 6883 | 107 | 700345080H1 | SATMON021 | g2668745 | BLASTN | 1195 | 1e−117 | 100 |
| 6884 | 107 | 700624257H1 | SATMON034 | g2668745 | BLASTN | 825 | 1e−115 | 100 |
| 6885 | 107 | 700030359H1 | SATMON003 | g2668745 | BLASTN | 1470 | 1e−114 | 100 |
| 6886 | 107 | 700214462H1 | SATMON016 | g2668745 | BLASTN | 1223 | 1e−110 | 98 |
| 6887 | 107 | 700356050H1 | SATMON024 | g2668745 | BLASTN | 1430 | 1e−110 | 100 |
| 6888 | 107 | 701181128H1 | SATMONN06 | g2668745 | BLASTN | 1368 | 1e−105 | 98 |
| 6889 | 107 | 700349795H1 | SATMON023 | g2668745 | BLASTN | 1370 | 1e−105 | 95 |
| 6890 | 107 | 700473278H1 | SATMON025 | g2668745 | BLASTN | 1355 | 1e−104 | 100 |
| 6891 | 107 | 700157057H1 | SATMON012 | g2668745 | BLASTN | 1345 | 1e−103 | 100 |
| 6892 | 107 | 700625505H1 | SATMON034 | g2668745 | BLASTN | 762 | 1e−100 | 96 |
| 6893 | 107 | 700219661H1 | SATMON011 | g2668745 | BLASTN | 942 | 1e−98 | 99 |
| 6894 | 107 | 700619032H1 | SATMON034 | g2668745 | BLASTN | 989 | 1e−98 | 96 |
| 6895 | 107 | 700620065H1 | SATMON034 | g2668745 | BLASTN | 1069 | 1e−98 | 94 |
| 6896 | 107 | 700569179H1 | SATMON030 | g2668745 | BLASTN | 1233 | 1e−97 | 98 |
| 6897 | 107 | 700156773H1 | SATMON012 | g2668745 | BLASTN | 1276 | 1e−97 | 99 |
| 6898 | 107 | 700207120H1 | SATMON017 | g2668745 | BLASTN | 740 | 1e−96 | 99 |
| 6899 | 107 | 700030407H1 | SATMON003 | g2668745 | BLASTN | 480 | 1e−95 | 98 |

TABLE A*-continued

| Seq No. | Cluster ID | CloneID | Library | NCBI gi | Method | Score | P-value | % Ident |
|---|---|---|---|---|---|---|---|---|
| 6900 | 107 | 700457309H1 | SATMON029 | g2668745 | BLASTN | 979 | 1e−95 | 99 |
| 6901 | 107 | 700195681H1 | SATMON014 | g2668745 | BLASTN | 1246 | 1e−95 | 99 |
| 6902 | 107 | 700444838H1 | SATMON027 | g2668745 | BLASTN | 1249 | 1e−95 | 96 |
| 6903 | 107 | 700581619H1 | SATMON031 | g2668745 | BLASTN | 943 | 1e−94 | 96 |
| 6904 | 107 | 700351021H1 | SATMON023 | g2668745 | BLASTN | 853 | 1e−91 | 92 |
| 6905 | 107 | 700205723H1 | SATMON003 | g2668745 | BLASTN | 1138 | 1e−91 | 95 |
| 6906 | 107 | 700159712H1 | SATMON012 | g2668745 | BLASTN | 1199 | 1e−91 | 94 |
| 6907 | 107 | 700158937H1 | SATMON012 | g2668745 | BLASTN | 1132 | 1e−90 | 96 |
| 6908 | 107 | 700336255H1 | SATMON019 | g2668745 | BLASTN | 489 | 1e−85 | 94 |
| 6909 | 107 | 700422922H1 | SATMONN01 | g2668745 | BLASTN | 642 | 1e−84 | 95 |
| 6910 | 107 | 700347429H1 | SATMON023 | g2668745 | BLASTN | 891 | 1e−83 | 92 |
| 6911 | 107 | 700350695H1 | SATMON023 | g2668745 | BLASTN | 960 | 1e−83 | 91 |
| 6912 | 107 | 700212988H1 | SATMON016 | g2668745 | BLASTN | 988 | 1e−82 | 96 |
| 6913 | 107 | 700345278H1 | SATMON021 | g2668745 | BLASTN | 989 | 1e−82 | 95 |
| 6914 | 107 | 700264475H1 | SATMON017 | g2668745 | BLASTN | 1089 | 1e−82 | 99 |
| 6915 | 107 | 700211923H1 | SATMON016 | g2668745 | BLASTN | 991 | 1e−81 | 94 |
| 6916 | 107 | 700620974H1 | SATMON034 | g2668745 | BLASTN | 907 | 1e−80 | 92 |
| 6917 | 107 | 700156401H1 | SATMON012 | g2668745 | BLASTN | 1058 | 1e−79 | 90 |
| 6918 | 107 | 700172547H1 | SATMON013 | g2668745 | BLASTN | 1042 | 1e−78 | 96 |
| 6919 | 107 | 700552384H1 | SATMON022 | g2668745 | BLASTN | 916 | 1e−76 | 96 |
| 6920 | 107 | 700219926H1 | SATMON011 | g2668745 | BLASTN | 1005 | 1e−75 | 100 |
| 6921 | 107 | 700357492H1 | SATMON024 | g2668745 | BLASTN | 610 | 1e−74 | 99 |
| 6922 | 107 | 700343365H1 | SATMON021 | g2668745 | BLASTN | 891 | 1e−74 | 94 |
| 6923 | 107 | 700018618H1 | SATMON001 | g2668745 | BLASTN | 1001 | 1e−74 | 93 |
| 6924 | 107 | 700570755H1 | SATMON030 | g2668745 | BLASTN | 845 | 1e−71 | 93 |
| 6925 | 107 | 700194777H1 | SATMON014 | g2668745 | BLASTN | 940 | 1e−69 | 100 |
| 6926 | 107 | 700453790H1 | SATMON029 | g2668745 | BLASTN | 925 | 1e−68 | 92 |
| 6927 | 107 | 700197306H1 | SATMON014 | g2668745 | BLASTN | 928 | 1e−68 | 85 |
| 6928 | 107 | 700355750H1 | SATMON024 | g2668745 | BLASTN | 393 | 1e−66 | 93 |
| 6929 | 107 | 700172940H1 | SATMON013 | g2668745 | BLASTN | 902 | 1e−66 | 97 |
| 6930 | 107 | 700102133H1 | SATMON010 | g2668745 | BLASTN | 850 | 1e−62 | 100 |
| 6931 | 107 | 700350332H1 | SATMON023 | g2668745 | BLASTN | 539 | 1e−57 | 97 |
| 6932 | 107 | 700450285H1 | SATMON028 | g2668745 | BLASTN | 750 | 1e−53 | 100 |
| 6933 | 107 | 700165003H1 | SATMON013 | g2668745 | BLASTN | 548 | 1e−52 | 83 |
| 6934 | 107 | 700016136H1 | SATMON001 | g2668745 | BLASTN | 527 | 1e−50 | 85 |
| 6935 | 107 | 700171557H1 | SATMON013 | g2668745 | BLASTN | 714 | 1e−50 | 95 |
| 6936 | 107 | 700238156H1 | SATMON010 | g2668745 | BLASTN | 715 | 1e−50 | 96 |
| 6937 | 107 | 700425175H1 | SATMONN01 | g2668745 | BLASTN | 698 | 1e−49 | 94 |
| 6938 | 107 | 700354402H1 | SATMON024 | g2668745 | BLASTN | 616 | 1e−48 | 91 |
| 6939 | 107 | 700159204H1 | SATMON012 | g2668745 | BLASTN | 617 | 1e−42 | 94 |
| 6940 | 107 | 700623602H1 | SATMON034 | g2668745 | BLASTN | 460 | 1e−38 | 100 |
| 6941 | 107 | 700612844H1 | SATMON033 | g2668745 | BLASTN | 421 | 1e−36 | 84 |
| 6942 | 107 | 700621062H2 | SATMON034 | g2668745 | BLASTN | 285 | 1e−25 | 89 |
| 6943 | 107 | 700335685H1 | SATMON019 | g2668745 | BLASTN | 339 | 1e−25 | 91 |
| 6944 | 1381 | 700454845H1 | SATMON029 | g1747293 | BLASTN | 746 | 1e−72 | 85 |
| 6945 | 1381 | 700455149H1 | SATMON029 | g1747293 | BLASTN | 836 | 1e−66 | 84 |
| 6946 | 1381 | 700455537H1 | SATMON029 | g1747293 | BLASTN | 330 | 1e−29 | 80 |
| 6947 | 1381 | 700615620H1 | SATMON033 | g1747294 | BLASTX | 105 | 1e−16 | 98 |
| 6948 | 1381 | 700454648H1 | SATMON029 | g1747293 | BLASTN | 288 | 1e−15 | 78 |
| 6949 | 13843 | 700334949H1 | SATMON019 | g2570500 | BLASTN | 680 | 1e−55 | 83 |
| 6950 | 13843 | 700346817H1 | SATMON021 | g2570500 | BLASTN | 705 | 1e−54 | 83 |
| 6951 | 13843 | 700103380H1 | SATMON010 | g2570500 | BLASTN | 710 | 1e−54 | 83 |
| 6952 | 13843 | 700348280H1 | SATMON023 | g2570500 | BLASTN | 669 | 1e−51 | 83 |
| 6953 | 13843 | 700453203H1 | SATMON028 | g2570500 | BLASTN | 659 | 1e−50 | 82 |
| 6954 | 13843 | 700381101H1 | SATMON023 | g2570500 | BLASTN | 621 | 1e−47 | 82 |
| 6955 | 13843 | 700347617H1 | SATMON023 | g2570500 | BLASTN | 592 | 1e−44 | 85 |
| 6956 | 13843 | 700043259H1 | SATMON004 | g2570500 | BLASTN | 530 | 1e−39 | 84 |
| 6957 | 13843 | 701184447H1 | SATMONN06 | g2570500 | BLASTN | 481 | 1e−35 | 78 |
| 6958 | 18427 | 700355977H1 | SATMON024 | g1747295 | BLASTN | 1056 | 1e−81 | 92 |
| 6959 | 18427 | 700265262H1 | SATMON017 | g1747295 | BLASTN | 626 | 1e−77 | 90 |
| 6960 | 20656 | 700075743H1 | SATMON007 | g1747295 | BLASTN | 734 | 1e−52 | 87 |
| 6961 | 20656 | 700571658H1 | SATMON030 | g1747295 | BLASTN | 480 | 1e−29 | 84 |
| 6962 | 21076 | 700088795H1 | SATMON011 | g1049254 | BLASTN | 420 | 1e−24 | 64 |
| 6963 | 21076 | 700241354H1 | SATMON010 | g166634 | BLASTX | 201 | 1e−20 | 58 |
| 6964 | 21267 | 700050595H1 | SATMON003 | g1747293 | BLASTN | 445 | 1e−32 | 83 |
| 6965 | 21267 | 700090051H1 | SATMON011 | g1747293 | BLASTN | 239 | 1e−23 | 74 |
| 6966 | 24066 | 700423113H1 | SATMONN01 | g457744 | BLASTX | 124 | 1e−23 | 54 |
| 6967 | 24266 | 700577157H1 | SATMON031 | g2570500 | BLASTN | 1001 | 1e−74 | 89 |
| 6968 | 2531 | 700099364H1 | SATMON009 | g2570500 | BLASTN | 669 | 1e−51 | 86 |
| 6969 | 2531 | 700336387H1 | SATMON019 | g2570500 | BLASTN | 389 | 1e−47 | 85 |
| 6970 | 2531 | 700217095H1 | SATMON016 | g2570500 | BLASTN | 451 | 1e−33 | 86 |
| 6971 | 2531 | 700155869H1 | SATMON007 | g2570500 | BLASTN | 385 | 1e−27 | 89 |
| 6972 | 2531 | 700575534H1 | SATMON030 | g2570500 | BLASTN | 365 | 1e−26 | 88 |
| 6973 | 2531 | 700163562H1 | SATMON013 | g2570501 | BLASTX | 145 | 1e−24 | 94 |
| 6974 | 2544 | 700076138H1 | SATMON007 | g1747295 | BLASTN | 1334 | 1e−102 | 90 |
| 6975 | 2544 | 700381158H1 | SATMON023 | g1747295 | BLASTN | 962 | 1e−92 | 89 |
| 6976 | 2544 | 700050877H1 | SATMON003 | g1747295 | BLASTN | 933 | 1e−85 | 87 |

TABLE A*-continued

| Seq No. | Cluster ID | CloneID | Library | NCBI gi | Method | Score | P-value | % Ident |
|---|---|---|---|---|---|---|---|---|
| 6977 | 2544 | 700450220H1 | SATMON028 | g1747295 | BLASTN | 1105 | 1e-85 | 90 |
| 6978 | 2544 | 700050516H1 | SATMON003 | g1747295 | BLASTN | 574 | 1e-75 | 91 |
| 6979 | 2544 | 700620486H1 | SATMON034 | g1049254 | BLASTN | 734 | 1e-54 | 94 |
| 6980 | 293 | 700474550H1 | SATMON025 | g1049254 | BLASTN | 1359 | 1e-110 | 97 |
| 6981 | 293 | 700218212H1 | SATMON016 | g1049254 | BLASTN | 1411 | 1e-108 | 99 |
| 6982 | 293 | 700468143H1 | SATMON025 | g1049254 | BLASTN | 1397 | 1e-107 | 97 |
| 6983 | 293 | 700101735H1 | SATMON009 | g1049254 | BLASTN | 1364 | 1e-104 | 98 |
| 6984 | 293 | 700454255H1 | SATMON029 | g1049254 | BLASTN | 1333 | 1e-102 | 97 |
| 6985 | 293 | 700051815H1 | SATMON003 | g1049254 | BLASTN | 1256 | 1e-95 | 96 |
| 6986 | 293 | 700623739H1 | SATMON025 | g1049254 | BLASTN | 1245 | 1e-94 | 92 |
| 6987 | 293 | 700577880H1 | SATMON031 | g1049254 | BLASTN | 1218 | 1e-92 | 94 |
| 6988 | 293 | 700457170H1 | SATMON029 | g1049254 | BLASTN | 1198 | 1e-91 | 93 |
| 6989 | 293 | 700476606H1 | SATMON025 | g1049254 | BLASTN | 1204 | 1e-91 | 92 |
| 6990 | 293 | 700620920H1 | SATMON034 | g1049254 | BLASTN | 1179 | 1e-89 | 94 |
| 6991 | 293 | 700100479H1 | SATMON009 | g1747293 | BLASTN | 1164 | 1e-88 | 87 |
| 6992 | 293 | 700551082H1 | SATMON022 | g1747293 | BLASTN | 1151 | 1e-87 | 92 |
| 6993 | 293 | 700156615H1 | SATMON012 | g1049254 | BLASTN | 1152 | 1e-87 | 94 |
| 6994 | 293 | 700161538H1 | SATMON012 | g1049254 | BLASTN | 1143 | 1e-86 | 98 |
| 6995 | 293 | 700157125H1 | SATMON012 | g1049254 | BLASTN | 1115 | 1e-84 | 93 |
| 6996 | 293 | 700173068H1 | SATMON013 | g1049254 | BLASTN | 1121 | 1e-84 | 94 |
| 6997 | 293 | 700050620H1 | SATMON003 | g1049254 | BLASTN | 481 | 1e-82 | 90 |
| 6998 | 293 | 700622261H1 | SATMON034 | g1049254 | BLASTN | 614 | 1e-76 | 97 |
| 6999 | 293 | 700043120H1 | SATMON004 | g1747293 | BLASTN | 1014 | 1e-75 | 87 |
| 7000 | 293 | 700215855H1 | SATMON016 | g1049254 | BLASTN | 985 | 1e-73 | 100 |
| 7001 | 293 | 700098048H1 | SATMON009 | g1049254 | BLASTN | 912 | 1e-72 | 95 |
| 7002 | 293 | 700021133H1 | SATMON001 | g1049254 | BLASTN | 546 | 1e-71 | 93 |
| 7003 | 293 | 700021236H1 | SATMON001 | g1049254 | BLASTN | 963 | 1e-71 | 90 |
| 7004 | 293 | 700431153H1 | SATMONN01 | g1747293 | BLASTN | 510 | 1e-68 | 85 |
| 7005 | 293 | 700444425H1 | SATMON026 | g1747293 | BLASTN | 569 | 1e-67 | 82 |
| 7006 | 293 | 700160941H1 | SATMON012 | g1747293 | BLASTN | 504 | 1e-66 | 87 |
| 7007 | 293 | 700160760H1 | SATMON012 | g1747293 | BLASTN | 906 | 1e-66 | 86 |
| 7008 | 293 | 700439081H1 | SATMON026 | g1049254 | BLASTN | 909 | 1e-66 | 92 |
| 7009 | 293 | 700444194H1 | SATMON027 | g1747293 | BLASTN | 887 | 1e-65 | 84 |
| 7010 | 293 | 700217965H1 | SATMON016 | g1747293 | BLASTN | 855 | 1e-62 | 91 |
| 7011 | 293 | 700456962H1 | SATMON029 | g1747293 | BLASTN | 496 | 1e-61 | 78 |
| 7012 | 293 | 700438388H1 | SATMON026 | g1049254 | BLASTN | 668 | 1e-52 | 98 |
| 7013 | 293 | 700623436H1 | SATMON034 | g1747293 | BLASTN | 696 | 1e-49 | 82 |
| 7014 | 293 | 700472039H1 | SATMON025 | g1049254 | BLASTN | 629 | 1e-43 | 98 |
| 7015 | 293 | 700624180H1 | SATMON034 | g1747293 | BLASTN | 395 | 1e-35 | 82 |
| 7016 | 293 | 700162157H1 | SATMON012 | g1747294 | BLASTX | 185 | 1e-18 | 97 |
| 7017 | 293 | 700162372H1 | SATMON012 | g1049255 | BLASTX | 132 | 1e-10 | 100 |
| 7018 | 3131 | 700624482H1 | SATMON034 | g1747295 | BLASTN | 1155 | 1e-95 | 87 |
| 7019 | 3131 | 700075221H1 | SATMON007 | g1747295 | BLASTN | 1228 | 1e-93 | 89 |
| 7020 | 3131 | 700213731H1 | SATMON016 | g1747295 | BLASTN | 1095 | 1e-84 | 89 |
| 7021 | 3131 | 700215864H1 | SATMON016 | g1747295 | BLASTN | 1120 | 1e-84 | 90 |
| 7022 | 3131 | 700465076H1 | SATMON025 | g1747295 | BLASTN | 1084 | 1e-81 | 89 |
| 7023 | 3131 | 700077092H1 | SATMON007 | g1747295 | BLASTN | 998 | 1e-74 | 83 |
| 7024 | 32364 | 700204306H1 | SATMON003 | g2668745 | BLASTN | 471 | 1e-28 | 74 |
| 7025 | 32671 | 700451634H1 | SATMON028 | g1747293 | BLASTN | 578 | 1e-73 | 87 |
| 7026 | 32856 | 700166756H1 | SATMON013 | g534915 | BLASTN | 744 | 1e-53 | 76 |
| 7027 | 32856 | 700042535H1 | SATMON004 | g534915 | BLASTN | 644 | 1e-44 | 73 |
| 7028 | 337 | 700242009H1 | SATMON010 | g1747293 | BLASTN | 1049 | 1e-78 | 90 |
| 7029 | 337 | 700624035H1 | SATMON034 | g1747293 | BLASTN | 1008 | 1e-75 | 85 |
| 7030 | 337 | 700266136H1 | SATMON017 | g1747293 | BLASTN | 999 | 1e-74 | 84 |
| 7031 | 337 | 700220713H1 | SATMON011 | g1747293 | BLASTN | 752 | 1e-56 | 90 |
| 7032 | 3384 | 700237775H1 | SATMON010 | g2258073 | BLASTN | 911 | 1e-67 | 81 |
| 7033 | 3384 | 700342456H1 | SATMON021 | g2258073 | BLASTN | 648 | 1e-64 | 78 |
| 7034 | 3384 | 700073654H1 | SATMON007 | g2668745 | BLASTN | 860 | 1e-63 | 78 |
| 7035 | 3384 | 700577805H1 | SATMON031 | g2258073 | BLASTN | 840 | 1e-61 | 78 |
| 7036 | 3384 | 700028881H1 | SATMON003 | g534915 | BLASTN | 835 | 1e-60 | 78 |
| 7037 | 3384 | 700215076H1 | SATMON016 | g534915 | BLASTN | 824 | 1e-59 | 78 |
| 7038 | 3384 | 700017479H1 | SATMON001 | g534915 | BLASTN | 766 | 1e-55 | 80 |
| 7039 | 3384 | 700204495H1 | SATMON003 | g534915 | BLASTN | 373 | 1e-51 | 81 |
| 7040 | 3384 | 700196795H1 | SATMON014 | g2570500 | BLASTN | 579 | 1e-39 | 80 |
| 7041 | 3384 | 700018612H1 | SATMON001 | g2668745 | BLASTN | 518 | 1e-34 | 76 |
| 7042 | 3384 | 700102142H1 | SATMON010 | g2668745 | BLASTN | 539 | 1e-34 | 78 |
| 7043 | 3384 | 700348430H1 | SATMON023 | g534915 | BLASTN | 489 | 1e-30 | 78 |
| 7044 | 3384 | 700439515H1 | SATMON026 | g534915 | BLASTN | 437 | 1e-27 | 75 |
| 7045 | 3384 | 700074977H1 | SATMON007 | g534915 | BLASTN | 434 | 1e-25 | 76 |
| 7046 | 3384 | 700023120H1 | SATMON003 | g534916 | BLASTX | 208 | 1e-22 | 78 |
| 7047 | 3384 | 700615213H1 | SATMON033 | g2570501 | BLASTX | 125 | 1e-21 | 93 |
| 7048 | 3384 | 700074109H1 | SATMON007 | g2668746 | BLASTX | 197 | 1e-20 | 72 |
| 7049 | 3384 | 700026094H1 | SATMON003 | g534916 | BLASTX | 184 | 1e-18 | 75 |
| 7050 | 3384 | 700549517H1 | SATMON022 | g2668746 | BLASTX | 172 | 1e-17 | 75 |
| 7051 | 3384 | 700030347H1 | SATMON003 | g2668746 | BLASTX | 171 | 1e-16 | 77 |
| 7052 | 3384 | 700221176H1 | SATMON011 | g2668746 | BLASTX | 171 | 1e-16 | 77 |
| 7053 | 3384 | 700433360H1 | SATMONN01 | g2668746 | BLASTX | 95 | 1e-13 | 74 |

TABLE A*-continued

| Seq No. | Cluster ID | CloneID | Library | NCBI gi | Method | Score | P-value | % Ident |
|---|---|---|---|---|---|---|---|---|
| 7054 | 3817 | 700047790H1 | SATMON003 | g1747295 | BLASTN | 412 | 1e-57 | 85 |
| 7055 | 3817 | 700266224H1 | SATMON017 | g1747295 | BLASTN | 473 | 1e-50 | 85 |
| 7056 | 3817 | 700209335H1 | SATMON016 | g1747295 | BLASTN | 503 | 1e-42 | 86 |
| 7057 | 3817 | 700089769H1 | SATMON011 | g1747295 | BLASTN | 487 | 1e-40 | 85 |
| 7058 | 3817 | 700151762H1 | SATMON007 | g1747295 | BLASTN | 457 | 1e-37 | 87 |
| 7059 | 3817 | 700449259H1 | SATMON028 | g1747295 | BLASTN | 339 | 1e-19 | 81 |
| 7060 | 5000 | 700026151H1 | SATMON003 | g2903 | BLASTX | 261 | 1e-28 | 54 |
| 7061 | 5000 | 700347165H1 | SATMON021 | g2624379 | BLASTX | 223 | 1e-24 | 51 |
| 7062 | 5000 | 700430341H1 | SATMONN01 | g2903 | BLASTX | 185 | 1e-18 | 56 |
| 7063 | 5000 | 700457781H1 | SATMON029 | g2903 | BLASTX | 133 | 1e-16 | 49 |
| 7064 | 5861 | 700104993H1 | SATMON010 | g2258073 | BLASTN | 456 | 1e-27 | 73 |
| 7065 | 5861 | 700203452H1 | SATMON003 | g2258073 | BLASTN | 428 | 1e-26 | 72 |
| 7066 | 5861 | 700105585H1 | SATMON010 | g534916 | BLASTX | 149 | 1e-13 | 84 |
| 7067 | 5861 | 700240805H1 | SATMON010 | g534916 | BLASTX | 131 | 1e-11 | 82 |
| 7068 | 5861 | 700030336H1 | SATMON003 | g534916 | BLASTX | 120 | 1e-9 | 82 |
| 7069 | 5861 | 700217859H1 | SATMON016 | g534916 | BLASTX | 120 | 1e-9 | 82 |
| 7070 | 6315 | 700473069H1 | SATMON025 | g1747295 | BLASTN | 1200 | 1e-91 | 89 |
| 7071 | 6315 | 700151232H1 | SATMON007 | g1747295 | BLASTN | 1130 | 1e-85 | 90 |
| 7072 | 6315 | 700103088H1 | SATMON010 | g1747295 | BLASTN | 1132 | 1e-85 | 88 |
| 7073 | 6315 | 700450086H2 | SATMON028 | g1747295 | BLASTN | 591 | 1e-84 | 90 |
| 7074 | 6315 | 700458843H1 | SATMON029 | g1747295 | BLASTN | 822 | 1e-67 | 89 |
| 7075 | 6315 | 700165715H1 | SATMON013 | g1747295 | BLASTN | 494 | 1e-63 | 89 |
| 7076 | 6315 | 700352887H1 | SATMON024 | g1747295 | BLASTN | 606 | 1e-41 | 86 |
| 7077 | 707 | 700206525H1 | SATMON003 | g1747295 | BLASTN | 1386 | 1e-106 | 91 |
| 7078 | 707 | 700096774H1 | SATMON008 | g1747295 | BLASTN | 1264 | 1e-96 | 90 |
| 7079 | 707 | 700466734H1 | SATMON025 | g1747295 | BLASTN | 1078 | 1e-89 | 90 |
| 7080 | 707 | 700332548H1 | SATMON019 | g1747295 | BLASTN | 1179 | 1e-89 | 89 |
| 7081 | 707 | 700085122H1 | SATMON011 | g1747295 | BLASTN | 1171 | 1e-88 | 92 |
| 7082 | 707 | 700207180H1 | SATMON017 | g1747295 | BLASTN | 1159 | 1e-87 | 88 |
| 7083 | 707 | 700333910H1 | SATMON019 | g1747295 | BLASTN | 1134 | 1e-85 | 92 |
| 7084 | 707 | 700223824H1 | SATMON011 | g1747295 | BLASTN | 1122 | 1e-84 | 91 |
| 7085 | 707 | 700222034H1 | SATMON011 | g1747295 | BLASTN | 1102 | 1e-82 | 88 |
| 7086 | 707 | 700570554H1 | SATMON030 | g1747295 | BLASTN | 848 | 1e-81 | 86 |
| 7087 | 707 | 700241783H1 | SATMON010 | g1747295 | BLASTN | 1090 | 1e-81 | 89 |
| 7088 | 707 | 700224305H1 | SATMON011 | g1747295 | BLASTN | 1031 | 1e-77 | 85 |
| 7089 | 707 | 700458382H1 | SATMON029 | g1747295 | BLASTN | 993 | 1e-73 | 89 |
| 7090 | 707 | 700151266H1 | SATMON007 | g1747295 | BLASTN | 671 | 1e-47 | 86 |
| 7091 | 707 | 700470565H1 | SATMON025 | g1747295 | BLASTN | 404 | 1e-46 | 86 |
| 7092 | 707 | 700207802H1 | SATMON016 | g1747295 | BLASTN | 543 | 1e-43 | 87 |
| 7093 | 7540 | 700049926H1 | SATMON003 | g1747295 | BLASTN | 718 | 1e-50 | 87 |
| 7094 | 7540 | 700458612H1 | SATMON029 | g1747295 | BLASTN | 670 | 1e-46 | 83 |
| 7095 | -L1431590 | LIB143-006-Q1-E1-C9 | LIB143 | g16347 | BLASTN | 286 | 1e-13 | 61 |
| 7096 | -L1433414 | LIB143-026-Q1-E1-C3 | LIB143 | g2258073 | BLASTN | 480 | 1e-29 | 70 |
| 7097 | -L1482832 | LIB148-009-Q1-E1-D8 | LIB148 | g2258073 | BLASTN | 1086 | 1e-81 | 78 |
| 7098 | -L30593394 | LIB3059-029-Q1-K1-A12 | LIB3059 | g1747295 | BLASTN | 488 | 1e-91 | 82 |
| 7099 | -L30593582 | LIB3059-031-Q1-K1-C7 | LIB3059 | g1747293 | BLASTN | 807 | 1e-71 | 86 |
| 7100 | -L30674379 | LIB3067-042-Q1-K1-H8 | LIB3067 | g2668745 | BLASTN | 305 | 1e-21 | 68 |
| 7101 | -L30675338 | LIB3067-035-Q1-K1-H12 | LIB3067 | g1747293 | BLASTN | 436 | 1e-25 | 80 |
| 7102 | -L30784040 | LIB3078-029-Q1-K1-D6 | LIB3078 | g1747293 | BLASTN | 523 | 1e-53 | 70 |
| 7103 | 107 | LIB3059-036-Q1-K1-B10 | LIB3059 | g2668745 | BLASTN | 1965 | 1e-166 | 100 |
| 7104 | 107 | LIB3061-035-Q1-K1-C9 | LIB3061 | g2668745 | BLASTN | 948 | 1e-138 | 93 |
| 7105 | 107 | LIB3061-032-Q1-K1-A12 | LIB3061 | g2668745 | BLASTN | 1685 | 1e-138 | 96 |
| 7106 | 107 | LIB3062-044-Q1-K1-F8 | LIB3062 | g2668745 | BLASTN | 1492 | 1e-134 | 95 |
| 7107 | 107 | LIB3068-025-Q1-K1-E5 | LIB3068 | g2668745 | BLASTN | 1687 | 1e-132 | 96 |
| 7108 | 107 | LIB3067-022-Q1-K1-D11 | LIB3067 | g2668745 | BLASTN | 1581 | 1e-128 | 91 |
| 7109 | 107 | LIB3067-016-Q1-K1-G4 | LIB3067 | g2668745 | BLASTN | 1305 | 1e-126 | 97 |
| 7110 | 107 | LIB3067-029-Q1-K1-C6 | LIB3067 | g2668745 | BLASTN | 1560 | 1e-125 | 90 |
| 7111 | 107 | LIB189-031-Q1-E1-D3 | LIB189 | g2668745 | BLASTN | 897 | 1e-81 | 85 |
| 7112 | 24066 | LIB3069-047-Q1-K1-C4 | LIB3069 | g166634 | BLASTX | 173 | 1e-45 | 55 |

TABLE A*-continued

| Seq No. | Cluster ID | CloneID | Library | NCBI gi | Method | Score | P-value | % Ident |
|---|---|---|---|---|---|---|---|---|
| 7113 | 24266 | LIB3069-006-Q1-K1-F4 | LIB3069 | g2570500 | BLASTN | 717 | 1e−57 | 83 |
| 7114 | 293 | LIB3060-032-Q1-K1-D3 | LIB3060 | g1049254 | BLASTN | 2144 | 1e−170 | 97 |
| 7115 | 293 | LIB3066-051-Q1-K1-D3 | LIB3066 | g1049254 | BLASTN | 1603 | 1e−158 | 99 |
| 7116 | 293 | LIB3060-026-Q1-K1-G5 | LIB3060 | g1049254 | BLASTN | 1642 | 1e−155 | 92 |
| 7117 | 293 | LIB143-018-Q1-E1-D7 | LIB143 | g1049254 | BLASTN | 1249 | 1e−151 | 99 |
| 7118 | 293 | LIB189-005-Q1-E1-G2 | LIB189 | g1049254 | BLASTN | 1911 | 1e−150 | 98 |
| 7119 | 293 | LIB3059-035-Q1-K1-G7 | LIB3059 | g1049254 | BLASTN | 1860 | 1e−146 | 89 |
| 7120 | 293 | LIB3060-013-Q1-K1-D3 | LIB3060 | g1049254 | BLASTN | 1236 | 1e−144 | 95 |
| 7121 | 293 | LIB3060-010-Q1-K1-G9 | LIB3060 | g1049254 | BLASTN | 1171 | 1e−142 | 90 |
| 7122 | 293 | LIB143-031-Q1-E1-F9 | LIB143 | g1049254 | BLASTN | 1777 | 1e−139 | 97 |
| 7123 | 293 | LIB3067-034-Q1-K1-B4 | LIB3067 | g1049254 | BLASTN | 1558 | 1e−121 | 93 |
| 7124 | 293 | LIB3067-010-Q1-K1-A11 | LIB3067 | g1049254 | BLASTN | 901 | 1e−120 | 90 |
| 7125 | 293 | LIB3060-015-Q1-K1-G3 | LIB3060 | g1049254 | BLASTN | 1309 | 1e−106 | 87 |
| 7126 | 293 | LIB3059-024-Q1-K1-G11 | LIB3059 | g1049254 | BLASTN | 1255 | 1e−95 | 98 |
| 7127 | 293 | LIB3060-038-Q1-K1-B1 | LIB3060 | g1049254 | BLASTN | 1109 | 1e−83 | 87 |
| 7128 | 293 | LIB143-008-Q1-E1-B6 | LIB143 | g1747293 | BLASTN | 1042 | 1e−77 | 85 |
| 7129 | 293 | LIB143-021-Q1-E1-A12 | LIB143 | g1747293 | BLASTN | 951 | 1e−70 | 84 |
| 7130 | 293 | LIB143-037-Q1-E1-C3 | LIB143 | g1747293 | BLASTN | 858 | 1e−68 | 89 |
| 7131 | 293 | LIB3079-004-Q1-K1-D5 | LIB3079 | g1747293 | BLASTN | 826 | 1e−59 | 83 |
| 7132 | 293 | LIB143-028-Q1-E1-F3 | LIB143 | g1747293 | BLASTN | 598 | 1e−40 | 88 |
| 7133 | 293 | LIB3068-043-Q1-K1-A2 | LIB3068 | g633598 | BLASTN | 552 | 1e−34 | 78 |
| 7134 | 3131 | LIB3066-031-Q1-K1-E3 | LIB3066 | g1747295 | BLASTN | 1114 | 1e−98 | 85 |
| 7135 | 31637 | LIB143-001-Q1-E1-G11 | LIB143 | g1747293 | BLASTN | 472 | 1e−74 | 81 |
| 7136 | 32364 | LIB3066-001-Q1-K1-B7 | LIB3066 | g2668745 | BLASTN | 612 | 1e−40 | 73 |
| 7137 | 32671 | LIB143-061-Q1-E1-E10 | LIB143 | g1747293 | BLASTN | 1414 | 1e−116 | 85 |
| 7138 | 32671 | LIB189-020-Q1-E1-C10 | LIB189 | g1747293 | BLASTN | 1281 | 1e−97 | 86 |
| 7139 | 32856 | LIB189-028-Q1-E1-C4 | LIB189 | g534915 | BLASTN | 986 | 1e−73 | 73 |
| 7140 | 3384 | LIB143-026-Q1-E1-C1 | LIB143 | g534915 | BLASTN | 1284 | 1e−98 | 78 |
| 7141 | 3384 | LIB3068-013-Q1-K1-H2 | LIB3068 | g534915 | BLASTN | 1074 | 1e−80 | 78 |
| 7142 | 3384 | LIB3062-033-Q1-K1-D2 | LIB3062 | g2668745 | BLASTN | 1009 | 1e−75 | 76 |
| 7143 | 3384 | LIB3062-057-Q1-K1-B7 | LIB3062 | g2668745 | BLASTN | 801 | 1e−58 | 73 |
| 7144 | 3384 | LIB3062-001-Q1-K2-H5 | LIB3062 | g16347 | BLASTN | 802 | 1e−57 | 77 |
| 7145 | 3384 | LIB189-022-Q1-E1-D5 | LIB189 | g2668745 | BLASTN | 646 | 1e−43 | 75 |
| 7146 | 3384 | LIB189-012-Q1-E1-F4 | LIB189 | g2570501 | BLASTX | 138 | 1e−32 | 72 |
| 7147 | 5000 | LIB36-015-Q1-E1-D6 | LIB36 | g2624379 | BLASTX | 236 | 1e−41 | 51 |
| 7148 | 5000 | LIB83-016-Q1-E1-H7 | LIB83 | g4198 | BLASTN | 534 | 1e−33 | 61 |
| 7149 | 707 | LIB148-019-Q1-E1-H8 | LIB148 | g1747295 | BLASTN | 1506 | 1e−116 | 89 |
| 7150 | 707 | LIB3066-040-Q1-K1-D6 | LIB3066 | g1747295 | BLASTN | 1459 | 1e−112 | 82 |

TABLE A*-continued

| Seq No. | Cluster ID | CloneID | Library | NCBI gi | Method | Score | P-value | % Ident |
|---|---|---|---|---|---|---|---|---|
| 7151 | 707 | LIB148-004-Q1-E1-B10 | LIB148 | g1747295 | BLASTN | 1268 | 1e-109 | 84 |
| 7152 | 707 | LIB3068-036-Q1-K1-A10 | LIB3068 | g1747295 | BLASTN | 889 | 1e-102 | 83 |
| 7153 | 7540 | LIB143-025-Q1-E1-C10 | LIB143 | g1747295 | BLASTN | 903 | 1e-66 | 86 |
| 7154 | 7540 | LIB148-033-Q1-E1-A7 | LIB148 | g1747295 | BLASTN | 857 | 1e-65 | 87 |
| | | | SOYBEAN PYROPHOSPHATASE | | | | | |
| 7155 | -700651291 | 700651291H1 | SOYMON003 | g1049254 | BLASTN | 732 | 1e-52 | 84 |
| 7156 | -700652792 | 700652792H1 | SOYMON003 | g2653445 | BLASTN | 474 | 1e-39 | 88 |
| 7157 | -700656683 | 700656683H1 | SOYMON004 | g1747293 | BLASTN | 679 | 1e-59 | 84 |
| 7158 | -700660662 | 700660662H1 | SOYMON004 | g16347 | BLASTN | 540 | 1e-36 | 79 |
| 7159 | -700744202 | 700744202H1 | SOYMON013 | g485741 | BLASTN | 554 | 1e-44 | 74 |
| 7160 | -700755514 | 700755514H1 | SOYMON014 | g1747293 | BLASTN | 743 | 1e-53 | 78 |
| 7161 | -700837007 | 700837007H1 | SOYMON020 | g16347 | BLASTN | 776 | 1e-55 | 78 |
| 7162 | -700865679 | 700865679H1 | SOYMON016 | g2653445 | BLASTN | 250 | 1e-36 | 92 |
| 7163 | -700890647 | 700890647H1 | SOYMON024 | g790474 | BLASTN | 826 | 1e-60 | 81 |
| 7164 | -700942978 | 700942978H1 | SOYMON024 | g790478 | BLASTN | 605 | 1e-63 | 82 |
| 7165 | -700944280 | 700944280H1 | SOYMON024 | g790479 | BLASTX | 119 | 1e-10 | 76 |
| 7166 | -700974544 | 700974544H1 | SOYMON005 | g1103711 | BLASTN | 854 | 1e-62 | 83 |
| 7167 | -700984449 | 700984449H1 | SOYMON009 | g1103711 | BLASTN | 287 | 1e-12 | 71 |
| 7168 | -700989248 | 700989248H1 | SOYMON011 | g534915 | BLASTN | 276 | 1e-14 | 67 |
| 7169 | -701002440 | 701002440H1 | SOYMON018 | g2653445 | BLASTN | 784 | 1e-56 | 76 |
| 7170 | -701003295 | 701003295H1 | SOYMON019 | g1049255 | BLASTX | 73 | 1e-8 | 53 |
| 7171 | -701012101 | 701012101H1 | SOYMON019 | g2653445 | BLASTN | 592 | 1e-40 | 77 |
| 7172 | -701097188 | 701097188H1 | SOYMON028 | g2653445 | BLASTN | 557 | 1e-37 | 75 |
| 7173 | -701105007 | 701105007H1 | SOYMON036 | g2653445 | BLASTN | 455 | 1e-61 | 86 |
| 7174 | -701106870 | 701106870H1 | SOYMON036 | g790478 | BLASTN | 623 | 1e-47 | 75 |
| 7175 | -701122796 | 701122796H1 | SOYMON037 | g2258074 | BLASTN | 71 | 1e-15 | 73 |
| 7176 | -701124682 | 701124682H1 | SOYMON037 | g485743 | BLASTN | 713 | 1e-50 | 81 |
| 7177 | -701132123 | 701132123H1 | SOYMON038 | g790478 | BLASTN | 627 | 1e-43 | 81 |
| 7178 | -701136557 | 701136557H1 | SOYMON038 | g16347 | BLASTN | 376 | 1e-33 | 77 |
| 7179 | -701148551 | 701148551H1 | SOYMON031 | g2653445 | BLASTN | 756 | 1e-54 | 78 |
| 7180 | -701206188 | 701206188H1 | SOYMON035 | g166633 | BLASTN | 399 | 1e-48 | 81 |
| 7181 | -701211207 | 701211207H1 | SOYMON035 | g2653445 | BLASTN | 387 | 1e-28 | 77 |
| 7182 | 11662 | 700987644H1 | SOYMON009 | g1747294 | BLASTX | 122 | 1e-17 | 60 |
| 7183 | 13047 | 700955418H1 | SOYMON022 | g2653445 | BLASTN | 585 | 1e-82 | 91 |
| 7184 | 13047 | 701054053H1 | SOYMON032 | g2653445 | BLASTN | 1080 | 1e-81 | 87 |
| 7185 | 13047 | 700846717H1 | SOYMON021 | g2653445 | BLASTN | 1000 | 1e-79 | 91 |
| 7186 | 13047 | 700952212H1 | SOYMON022 | g2653445 | BLASTN | 1055 | 1e-79 | 90 |
| 7187 | 13047 | 701156608H1 | SOYMON031 | g2653445 | BLASTN | 648 | 1e-78 | 91 |
| 7188 | 13047 | 700959847H1 | SOYMON022 | g2653445 | BLASTN | 932 | 1e-76 | 91 |
| 7189 | 13047 | 700986383H1 | SOYMON009 | g2653445 | BLASTN | 1029 | 1e-76 | 87 |
| 7190 | 13047 | 700892594H1 | SOYMON024 | g2653445 | BLASTN | 1005 | 1e-74 | 87 |
| 7191 | 13047 | 700995882H1 | SOYMON011 | g2653445 | BLASTN | 515 | 1e-68 | 90 |
| 7192 | 13047 | 701099843H1 | SOYMON028 | g2653445 | BLASTN | 850 | 1e-61 | 90 |
| 7193 | 14021 | 700973215H1 | SOYMON005 | g2668745 | BLASTN | 435 | 1e-39 | 80 |
| 7194 | 14021 | 701109310H1 | SOYMON036 | g2668745 | BLASTN | 281 | 1e-25 | 83 |
| 7195 | 14021 | 700847609H1 | SOYMON021 | g534916 | BLASTX | 98 | 1e-12 | 74 |
| 7196 | 14580 | 700952058H1 | SOYMON022 | g2653445 | BLASTN | 954 | 1e-70 | 88 |
| 7197 | 14580 | 700756103H1 | SOYMON014 | g2653445 | BLASTN | 562 | 1e-66 | 84 |
| 7198 | 15316 | 700847173H1 | SOYMON021 | g534916 | BLASTX | 123 | 1e-10 | 66 |
| 7199 | 15316 | 700847165H1 | SOYMON021 | g534916 | BLASTX | 121 | 1e-9 | 66 |
| 7200 | 15698 | 700844601H1 | SOYMON021 | g2653445 | BLASTN | 976 | 1e-72 | 91 |
| 7201 | 15698 | 700904602H1 | SOYMON022 | g2653445 | BLASTN | 466 | 1e-62 | 85 |
| 7202 | 15698 | 701002118H1 | SOYMON018 | g2653445 | BLASTN | 860 | 1e-62 | 87 |
| 7203 | 16 | 701044831H1 | SOYMON032 | g485744 | BLASTX | 163 | 1e-17 | 73 |
| 7204 | 16 | 700891764H1 | SOYMON024 | g790479 | BLASTX | 172 | 1e-16 | 68 |
| 7205 | 16 | 700953633H1 | SOYMON022 | g485744 | BLASTX | 161 | 1e-15 | 73 |
| 7206 | 16 | 700753981H1 | SOYMON014 | g485744 | BLASTX | 159 | 1e-14 | 70 |
| 7207 | 16 | 701104248H1 | SOYMON036 | g485744 | BLASTX | 57 | 1e-8 | 68 |
| 7208 | 1820 | 700888545H1 | SOYMON024 | g2653445 | BLASTN | 271 | 1e-39 | 84 |
| 7209 | 1820 | 700954577H1 | SOYMON022 | g2653445 | BLASTN | 177 | 1e-37 | 80 |
| 7210 | 1820 | 700869270H1 | SOYMON016 | g2653445 | BLASTN | 173 | 1e-16 | 80 |
| 7211 | 1820 | 700792533H1 | SOYMON017 | g2653445 | BLASTN | 182 | 1e-15 | 80 |
| 7212 | 1820 | 700734996H1 | SOYMON010 | g2653445 | BLASTN | 173 | 1e-14 | 78 |
| 7213 | 19232 | 701061126H1 | SOYMON033 | g790474 | BLASTN | 935 | 1e-69 | 81 |
| 7214 | 19232 | 700962864H1 | SOYMON022 | g790474 | BLASTN | 874 | 1e-64 | 82 |
| 7215 | 20872 | 700754883H1 | SOYMON014 | g790478 | BLASTN | 824 | 1e-59 | 81 |
| 7216 | 20872 | 700971147H1 | SOYMON005 | g1103711 | BLASTN | 564 | 1e-54 | 79 |
| 7217 | 20885 | 700904547H1 | SOYMON022 | g485743 | BLASTN | 971 | 1e-72 | 86 |
| 7218 | 20885 | 700665391H1 | SOYMON005 | g485743 | BLASTN | 969 | 1e-71 | 86 |
| 7219 | 20885 | 700941185H1 | SOYMON024 | g2653445 | BLASTN | 868 | 1e-63 | 83 |
| 7220 | 20885 | 700660695H1 | SOYMON004 | g2653445 | BLASTN | 825 | 1e-59 | 85 |
| 7221 | 20885 | 701127185H1 | SOYMON037 | g1747293 | BLASTN | 463 | 1e-54 | 83 |

TABLE A*-continued

| Seq No. | Cluster ID | CloneID | Library | NCBI gi | Method | Score | P-value | % Ident |
|---|---|---|---|---|---|---|---|---|
| 7222 | 24940 | 701209525H1 | SOYMON035 | g2653445 | BLASTN | 789 | 1e−56 | 91 |
| 7223 | 24940 | 701213556H1 | SOYMON035 | g2653445 | BLASTN | 574 | 1e−38 | 93 |
| 7224 | 27239 | 700668618H1 | SOYMON006 | g1049255 | BLASTX | 179 | 1e−17 | 61 |
| 7225 | 2813 | 700797861H1 | SOYMON017 | g16347 | BLASTN | 731 | 1e−52 | 79 |
| 7226 | 2813 | 700944850H1 | SOYMON024 | g2570500 | BLASTN | 738 | 1e−52 | 82 |
| 7227 | 2813 | 701056207H1 | SOYMON032 | g2570500 | BLASTN | 556 | 1e−46 | 80 |
| 7228 | 2813 | 700605115H2 | SOYMON003 | g2570500 | BLASTN | 478 | 1e−42 | 80 |
| 7229 | 2813 | 700897063H1 | SOYMON027 | g2570500 | BLASTN | 596 | 1e−40 | 80 |
| 7230 | 2813 | 700561829H1 | SOYMON002 | g2570500 | BLASTN | 570 | 1e−38 | 80 |
| 7231 | 2813 | 701204883H1 | SOYMON035 | g2668745 | BLASTN | 545 | 1e−36 | 77 |
| 7232 | 2813 | 700754984H1 | SOYMON014 | g2570500 | BLASTN | 527 | 1e−35 | 75 |
| 7233 | 2813 | 700854552H1 | SOYMON023 | g2570500 | BLASTN | 536 | 1e−35 | 79 |
| 7234 | 2813 | 700873337H1 | SOYMON018 | g2570500 | BLASTN | 505 | 1e−33 | 75 |
| 7235 | 2813 | 700873349H1 | SOYMON018 | g2570500 | BLASTN | 506 | 1e−33 | 75 |
| 7236 | 2813 | 700952403H1 | SOYMON022 | g2668745 | BLASTN | 499 | 1e−32 | 76 |
| 7237 | 2813 | 700846561H1 | SOYMON021 | g2570500 | BLASTN | 488 | 1e−31 | 75 |
| 7238 | 2813 | 700953987H1 | SOYMON022 | g2570500 | BLASTN | 461 | 1e−29 | 75 |
| 7239 | 2813 | 700568667H1 | SOYMON002 | g2570500 | BLASTN | 296 | 1e−24 | 79 |
| 7240 | 2813 | 700895231H1 | SOYMON024 | g2258074 | BLASTX | 207 | 1e−22 | 80 |
| 7241 | 2813 | 701101791H1 | SOYMON028 | g2668746 | BLASTX | 147 | 1e−13 | 77 |
| 7242 | 4106 | 701011114H1 | SOYMON019 | g2653445 | BLASTN | 904 | 1e−76 | 90 |
| 7243 | 4106 | 700674046H1 | SOYMON007 | g2653445 | BLASTN | 989 | 1e−73 | 90 |
| 7244 | 4106 | 700967038H1 | SOYMON029 | g2653445 | BLASTN | 963 | 1e−71 | 90 |
| 7245 | 4106 | 700740792H1 | SOYMON012 | g2653445 | BLASTN | 911 | 1e−67 | 90 |
| 7246 | 4106 | 700872817H1 | SOYMON018 | g2653445 | BLASTN | 903 | 1e−66 | 89 |
| 7247 | 4106 | 700738286H1 | SOYMON012 | g2653446 | BLASTX | 95 | 1e−10 | 91 |
| 7248 | 4845 | 700566516H1 | SOYMON002 | g2653445 | BLASTN | 1358 | 1e−104 | 94 |
| 7249 | 4845 | 700978728H1 | SOYMON009 | g2653445 | BLASTN | 917 | 1e−88 | 95 |
| 7250 | 4845 | 700907549H1 | SOYMON022 | g2653445 | BLASTN | 1168 | 1e−88 | 94 |
| 7251 | 4845 | 700908149H1 | SOYMON022 | g2653445 | BLASTN | 1156 | 1e−87 | 92 |
| 7252 | 4845 | 700559351H1 | SOYMON001 | g2653445 | BLASTN | 973 | 1e−86 | 90 |
| 7253 | 4845 | 700898914H1 | SOYMON027 | g2653445 | BLASTN | 1140 | 1e−86 | 93 |
| 7254 | 4845 | 700946269H1 | SOYMON024 | g2653445 | BLASTN | 1132 | 1e−85 | 91 |
| 7255 | 4845 | 701011513H1 | SOYMON019 | g2653445 | BLASTN | 1124 | 1e−84 | 92 |
| 7256 | 4845 | 700785951H2 | SOYMON011 | g2653445 | BLASTN | 1114 | 1e−83 | 92 |
| 7257 | 4845 | 701003561H1 | SOYMON019 | g2653445 | BLASTN | 1093 | 1e−82 | 92 |
| 7258 | 4845 | 700755340H1 | SOYMON014 | g2653445 | BLASTN | 1097 | 1e−82 | 93 |
| 7259 | 4845 | 700756774H1 | SOYMON014 | g2653445 | BLASTN | 950 | 1e−81 | 92 |
| 7260 | 4845 | 700564820H1 | SOYMON002 | g2653445 | BLASTN | 989 | 1e−81 | 87 |
| 7261 | 4845 | 700902381H1 | SOYMON027 | g2653445 | BLASTN | 1055 | 1e−79 | 95 |
| 7262 | 4845 | 700970334H1 | SOYMON005 | g2653445 | BLASTN | 978 | 1e−77 | 86 |
| 7263 | 4845 | 700656490H1 | SOYMON004 | g2653445 | BLASTN | 941 | 1e−73 | 91 |
| 7264 | 4845 | 700871681H1 | SOYMON018 | g2653445 | BLASTN | 974 | 1e−72 | 92 |
| 7265 | 4845 | 701153255H1 | SOYMON031 | g2653445 | BLASTN | 758 | 1e−65 | 94 |
| 7266 | 4845 | 701049483H1 | SOYMON032 | g2653445 | BLASTN | 865 | 1e−65 | 88 |
| 7267 | 4845 | 700796611H1 | SOYMON017 | g2653445 | BLASTN | 577 | 1e−59 | 86 |
| 7268 | 4845 | 700863103H1 | SOYMON023 | g2653445 | BLASTN | 771 | 1e−59 | 91 |
| 7269 | 4845 | 700795148H1 | SOYMON017 | g2653445 | BLASTN | 631 | 1e−57 | 83 |
| 7270 | 4845 | 701099340H1 | SOYMON028 | g2653445 | BLASTN | 678 | 1e−47 | 86 |
| 7271 | 4845 | 701097793H1 | SOYMON028 | g2653445 | BLASTN | 571 | 1e−38 | 88 |
| 7272 | 5440 | 701049119H1 | SOYMON032 | g2653445 | BLASTN | 1116 | 1e−84 | 89 |
| 7273 | 5440 | 701135152H1 | SOYMON038 | g2653445 | BLASTN | 703 | 1e−72 | 90 |
| 7274 | 5440 | 701001376H1 | SOYMON018 | g2653445 | BLASTN | 611 | 1e−67 | 89 |
| 7275 | 5440 | 701011545H1 | SOYMON019 | g2653445 | BLASTN | 907 | 1e−66 | 87 |
| 7276 | 5440 | 700738622H1 | SOYMON012 | g2653445 | BLASTN | 827 | 1e−60 | 88 |
| 7277 | 5440 | 700844506H1 | SOYMON021 | g2653445 | BLASTN | 838 | 1e−60 | 87 |
| 7278 | 5440 | 700547904H1 | SOYMON001 | g2653445 | BLASTN | 820 | 1e−59 | 87 |
| 7279 | 5440 | 701136362H1 | SOYMON038 | g2653445 | BLASTN | 825 | 1e−59 | 85 |
| 7280 | 5440 | 700794050H1 | SOYMON017 | g2653445 | BLASTN | 793 | 1e−57 | 84 |
| 7281 | 5440 | 700952580H1 | SOYMON022 | g2653445 | BLASTN | 798 | 1e−57 | 88 |
| 7282 | 5440 | 700563827H1 | SOYMON002 | g2653445 | BLASTN | 735 | 1e−56 | 82 |
| 7283 | 5440 | 700952567H1 | SOYMON022 | g2653445 | BLASTN | 783 | 1e−56 | 88 |
| 7284 | 5440 | 700953831H1 | SOYMON022 | g2653445 | BLASTN | 746 | 1e−53 | 87 |
| 7285 | 5440 | 700749982H1 | SOYMON013 | g2653445 | BLASTN | 397 | 1e−50 | 87 |
| 7286 | 5440 | 700686154H1 | SOYMON008 | g2653445 | BLASTN | 458 | 1e−48 | 84 |
| 7287 | 5440 | 700904783H1 | SOYMON022 | g2653445 | BLASTN | 461 | 1e−48 | 88 |
| 7288 | 5440 | 700952870H1 | SOYMON022 | g2653445 | BLASTN | 685 | 1e−48 | 87 |
| 7289 | 5440 | 700961948H1 | SOYMON022 | g2653445 | BLASTN | 675 | 1e−47 | 82 |
| 7290 | 5440 | 701210118H1 | SOYMON035 | g2653445 | BLASTN | 418 | 1e−45 | 85 |
| 7291 | 5440 | 700906779H1 | SOYMON022 | g2653445 | BLASTN | 631 | 1e−43 | 84 |
| 7292 | 5440 | 700833390H1 | SOYMON019 | g2653445 | BLASTN | 239 | 1e−36 | 87 |
| 7293 | 5440 | 700990989H1 | SOYMON011 | g2653445 | BLASTN | 545 | 1e−36 | 85 |
| 7294 | 5440 | 701103017H1 | SOYMON028 | g2653445 | BLASTN | 439 | 1e−27 | 85 |
| 7295 | 5440 | 700978736H1 | SOYMON009 | g2653446 | BLASTX | 124 | 1e−16 | 57 |
| 7296 | 7894 | 700795920H1 | SOYMON017 | g2653445 | BLASTN | 1016 | 1e−75 | 87 |
| 7297 | 7894 | 700888375H1 | SOYMON024 | g2653445 | BLASTN | 742 | 1e−66 | 88 |
| 7298 | 8040 | 701121224H1 | SOYMON037 | g534915 | BLASTN | 298 | 1e−14 | 77 |

TABLE A*-continued

| Seq No. | Cluster ID | CloneID | Library | NCBI gi | Method | Score | P-value | % Ident |
|---|---|---|---|---|---|---|---|---|
| 7299 | 8040 | 700743066H1 | SOYMON012 | g2668746 | BLASTX | 140 | 1e−12 | 80 |
| 7300 | 8531 | 701005139H1 | SOYMON019 | g2258073 | BLASTN | 871 | 1e−63 | 79 |
| 7301 | 8531 | 701008308H1 | SOYMON019 | g534915 | BLASTN | 789 | 1e−57 | 76 |
| 7302 | 8531 | 700559054H1 | SOYMON001 | g2570500 | BLASTN | 790 | 1e−57 | 77 |
| 7303 | 8531 | 700790983H1 | SOYMON011 | g2258073 | BLASTN | 431 | 1e−52 | 77 |
| 7304 | 8531 | 701007949H1 | SOYMON019 | g2570500 | BLASTN | 404 | 1e−41 | 70 |
| 7305 | 8531 | 701123827H1 | SOYMON037 | g534915 | BLASTN | 436 | 1e−26 | 75 |
| 7306 | 8531 | 701013616H1 | SOYMON019 | g534915 | BLASTN | 431 | 1e−25 | 78 |
| 7307 | 8531 | 701013624H1 | SOYMON019 | g534916 | BLASTX | 210 | 1e−22 | 84 |
| 7308 | 8531 | 700888553H1 | SOYMON024 | g534916 | BLASTX | 174 | 1e−17 | 91 |
| 7309 | 8531 | 701106256H1 | SOYMON036 | g534916 | BLASTX | 174 | 1e−17 | 84 |
| 7310 | 8531 | 701214976H1 | SOYMON035 | g534916 | BLASTX | 165 | 1e−16 | 88 |
| 7311 | 8531 | 700565624H1 | SOYMON002 | g2570501 | BLASTX | 169 | 1e−16 | 85 |
| 7312 | 8531 | 701121092H1 | SOYMON037 | g2570501 | BLASTX | 110 | 1e−15 | 60 |
| 7313 | 8531 | 700788808H2 | SOYMON011 | g534916 | BLASTX | 159 | 1e−15 | 88 |
| 7314 | 8531 | 701099192H1 | SOYMON028 | g534916 | BLASTX | 159 | 1e−15 | 96 |
| 7315 | 8531 | 700889521H1 | SOYMON024 | g534916 | BLASTX | 162 | 1e−15 | 90 |
| 7316 | 8531 | 700971218H1 | SOYMON005 | g534916 | BLASTX | 137 | 1e−12 | 90 |
| 7317 | 8531 | 701099236H1 | SOYMON028 | g534916 | BLASTX | 131 | 1e−10 | 75 |
| 7318 | 8531 | 700648547H1 | SOYMON003 | g534916 | BLASTX | 49 | 1e−9 | 57 |
| 7319 | 8531 | 700834052H1 | SOYMON019 | g534916 | BLASTX | 118 | 1e−9 | 92 |
| 7320 | 9059 | 700906027H1 | SOYMON022 | g2653445 | BLASTN | 1150 | 1e−86 | 94 |
| 7321 | 9059 | 700751263H1 | SOYMON014 | g2653445 | BLASTN | 1131 | 1e−85 | 95 |
| 7322 | 9059 | 701208611H1 | SOYMON035 | g2653445 | BLASTN | 666 | 1e−83 | 91 |
| 7323 | 9059 | 700832676H1 | SOYMON019 | g2653445 | BLASTN | 1078 | 1e−80 | 93 |
| 7324 | 9059 | 700979128H1 | SOYMON009 | g2653445 | BLASTN | 381 | 1e−71 | 90 |
| 7325 | 9059 | 700751040H1 | SOYMON014 | g2653445 | BLASTN | 872 | 1e−63 | 86 |
| 7326 | 9059 | 700957555H1 | SOYMON022 | g2653445 | BLASTN | 565 | 1e−40 | 86 |
| 7327 | 13047 | LIB3028-012-Q1-B1-B8 | LIB3028 | g2653445 | BLASTN | 1120 | 1e−116 | 89 |
| 7328 | 13047 | LIB3028-012-Q1-B1-A6 | LIB3028 | g2653445 | BLASTN | 1424 | 1e−115 | 91 |
| 7329 | 16 | LIB3040-003-Q1-E1-F6 | LIB3040 | g633598 | BLASTN | 523 | 1e−51 | 74 |
| 7330 | 16 | LIB3051-114-Q1-K1-G5 | LIB3051 | g790478 | BLASTN | 457 | 1e−48 | 79 |
| 7331 | 16 | LIB3039-020-Q1-E1-A2 | LIB3039 | g790478 | BLASTN | 338 | 1e−30 | 74 |
| 7332 | 1820 | LIB3065-010-Q1-N1-H3 | LIB3065 | g2653445 | BLASTN | 173 | 1e−10 | 88 |
| 7333 | 20885 | LIB3051-070-Q1-K1-B12 | LIB3051 | g2653445 | BLASTN | 1058 | 1e−110 | 77 |
| 7334 | 27239 | LIB3051-010-Q1-E1-G8 | LIB3051 | g1747293 | BLASTN | 544 | 1e−34 | 73 |
| 7335 | 2813 | LIB3028-026-Q1-B1-B7 | LIB3028 | g2570500 | BLASTN | 1029 | 1e−77 | 80 |
| 7336 | 4845 | LIB3039-007-Q1-E1-H3 | LIB3039 | g2653445 | BLASTN | 1826 | 1e−143 | 94 |
| 7337 | 4845 | LIB3050-012-Q1-E1-B11 | LIB3050 | g2653445 | BLASTN | 1597 | 1e−124 | 91 |
| 7338 | 8040 | LIB3049-005-Q1-E1-A7 | LIB3049 | g2570501 | BLASTX | 154 | 1e−32 | 61 |
| 7339 | 8531 | LIB3050-013-Q1-E1-G8 | LIB3050 | g2570500 | BLASTN | 748 | 1e−53 | 72 |
| 7340 | 8531 | LIB3073-025-Q1-K1-D6 | LIB3073 | g534915 | BLASTN | 711 | 1e−49 | 78 |
| 7341 | 8531 | LIB3050-012-Q1-E1-D1 | LIB3050 | g2258074 | BLASTX | 93 | 1e−31 | 74 |

Table Headings

Cluster ID

A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. The cluster ID entries in the table refer to the cluster with which the particular clone in each row is associated.

Clone ID

The clone ID number refers to the particular clone in the PhytoSeq database. Each clone ID entry in the table refers to the clone whose sequence is used for (1) the sequence comparison whose scores are presented and/or (2) assignment to the particular cluster which is presented. Note that a clone may be included in this table even if its sequence comparison scores fail to meet the minimum standards for similarity. In such a case, the clone is included due solely to its association with a particular cluster for which sequences of one or more other member clones possess the required level of similarity.

Library

The library ID refers to the particular cDNA library from which a given clone is obtained. Each cDNA library is associated with the particular tissue(s), line(s) and developmental stage(s) from which it is isolated.

NCBI gi

Each sequence in the GenBank public database is arbitrarily assigned a unique NCBI gi (National Center for Biotechnology Information GenBank Identifier) number. In this table, the NCBI gi number which is associated (in the same row) with a given clone refers to the particular GenBank sequence which is used in the sequence comparison. This entry is omitted when a clone is included solely due to its association with a particular cluster.

Method

The entry in the "Method" column of the table refers to the type of BLAST search that is used for the sequence comparison. "CLUSTER" is entered when the sequence comparison scores for a given clone fail to meet the minimum values required for significant similarity. In such cases, the clone is listed in the table solely as a result of its association with a given cluster for which sequences of one or more other member clones possess the required level of similarity.

Score

Each entry in the "Score" column of the table refers to the BLAST score that is generated by sequence comparison of the designated clone with the designated GenBank sequence using the designated BLAST method. This entry is omitted when a clone is included solely due to its association with a particular cluster. If the program used to determine the hit is HMMSW then the score refers to HMMSW score.

P-Value

The entries in the P-Value column refer to the probability that such matches occur by chance.

% Ident

The entries in the "% Ident" column of the table refer to the percentage of identically matched nucleotides (or residues) that exist along the length of that portion of the sequences which is aligned by the BLAST comparison to generate the statistical scores presented. This entry is omitted when a clone is included solely due to its association with a particular cluster.

SEQUENCE LISTING (7341 sequences)

SEQ ID NO: 1 - DNA, 67 bp, Zea mays
  unsure (1)...(67): unsure at all n locations
  Clone ID: 700430856H1
cgacaccgtgttaagttaatatataactggtgctttttatttaanaaannnaanaaaaanaaaaaaa

SEQ ID NO: 2 - DNA, 142 bp, Zea mays
  Clone ID: 700433144H1
ctctatacctgctgctacaaaactactgcaacgcctatatatacatggggtgaggaacatgtgaatgcaagctccggctatcatatacatgtaatatggatacaaactatatatataaatccgccgaggcgccgacaatact

SEQ ID NO: 3 - DNA, 142 bp, Zea mays
  Clone ID: 700433148H1
ctctatacctgctgctacaaaactactgcaacgcctatatatacttggggtgaggaacatgtgaatgcaagctccggctatcatatacatgtaatatggatacaaactatatatataaatccgccgaggcgccgacaatact

SEQ ID NO: 4 - DNA, 319 bp, Zea mays
  Clone ID: 700098783H1
gcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgacgccgctgtcgacggacgacctgctgaagcaggtggactacctgctgcgcaacggctggataccctgcctcgagttcagcaag

SEQ ID NO: 5 - DNA, 323 bp, Zea mays
  Clone ID: 700097213H1
cgacctgctgaagcaggtggactacctgctgcgcaacggctggataccctgcctcgagttcagcaaggtcggcttcgtgtaccgcgagaactccacctccccgtgctactacgacggccgctactggaccatgtggaagcatgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgcccc

SEQ ID NO: 6 - DNA, 330 bp, Zea mays
  Clone ID: 700097673H1
gcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctacta

SEQ ID NO: 7 - DNA, 310 bp, Zea mays
  Clone ID: 700101767H1
agcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctg

SEQ ID NO: 8 - DNA, 318 bp, Zea mays
  Clone ID: 700100001H1
gtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcaccgacgccacgcaagtgtacaaggagctg

SEQ ID NO: 9 - DNA, 316 bp, Zea mays
  Clone ID: 700097382H1
agcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagt

SEQ ID NO: 10 - DNA, 317 bp, Zea mays
  Clone ID: 700099925H1
agcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcg

SEQ ID NO: 11 - DNA, 315 bp, Zea mays
  Clone ID: 700098235H1
caagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcg

SEQ ID NO: 12 - DNA, 302 bp, Zea mays
  Clone ID: 700093043H1
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactac

SEQ ID NO: 13 - DNA, 315 bp, Zea mays
  Clone ID: 700089802H1
agcaagcaagcagcgagtacatacatactaggcagccaggcagccatggcgcccaccgtgatgatggcctcgtcggccaccgccgtcgctccgttccaggggctcaagtccacgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagt

SEQ ID NO: 14 - DNA, 297 bp, Zea mays
  Clone ID: 700101196H1
gccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggct

SEQ ID NO: 15 - DNA, 309 bp, Zea mays
  Clone ID: 700097309H1
caagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccct

SEQ ID NO: 16 - DNA, 305 bp, Zea mays
  Clone ID: 700100270H1
agcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgc

SEQ ID NO: 17 - DNA, 312 bp, Zea mays
  Clone ID: 700208152H1
caacgcgtccgggacctgggcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaa

SEQ ID NO: 18 - DNA, 322 bp, Zea mays
  unsure (1)...(322): unsure at all n locations
  Clone ID: 700215709H1
caagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagangctgtcgtacctgcngccgctgtcgagggangacttgctgaagcagtggacnacctgctgcgnaaggt

SEQ ID NO: 19 - DNA, 316 bp, Zea mays
  Clone ID: 700100795H1
accacgcgtccgcggacggtgggccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatg

SEQ ID NO: 20 - DNA, 309 bp, Zea mays
  Clone ID: 700097496H1
cccacgcgtccgcccacgcgtccggcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgt

SEQ ID NO: 21 - DNA, 298 bp, Zea mays
  Clone ID: 700099783H1
caagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacgg

SEQ ID NO: 22 - DNA, 278 bp, Zea mays
  Clone ID: 700044355H1
caagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacct

SEQ ID NO: 23 - DNA, 310 bp, Zea mays
  Clone ID: 700099951H1
caagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgatctgctgaagcaggtggactacctgctgcgcaacggctggatac

SEQ ID NO: 24 - DNA, 315 bp, Zea mays
  Clone ID: 700100228H1
agcaagcagcgagtacatacatactaggcagccaggcagccatggcgcccaccgtgatgatggcctcgtcggccaccgccgtcgctccgttccagggggtcaagtcggccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttca

SEQ ID NO: 25 - DNA, 291 bp, Zea mays
  Clone ID: 700042150H1
gccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagg

SEQ ID NO: 26 - DNA, 276 bp, Zea mays
  Clone ID: 700045728H1
gcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggacta

SEQ ID NO: 27 - DNA, 310 bp, Zea mays
  Clone ID: 700098561H1
agcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacgtgctgaagcaggtggactacatgctgcgcaacggctggataccctgcctcga

SEQ ID NO: 28 - DNA, 303 bp, Zea mays
  Clone ID: 700100271H1
agcaagcaagcagcgagtacatgcatactgggcagccaggcagccatggcgcccaccgtgatgatggcctcgtcggccaccgccgtcgctccgttccaggggctcaagtccaccgccagcctctgcgtcgcccggcgctcctccagaagcctcggcaacgtcagcaacggcggaaggatgcggtgcatgcaggtgtggccggcctacggcaacaagaagttcgagacgctgtcgtacctgccgccgctgtcgacggacgacctgctgaagcaggtggagtacctgctgcgcaaccgctggata

SEQ ID NO: 29 - DNA, 307 bp, Zea mays
  Clone ID: 700211770H1
agcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggata

SEQ ID NO: 30 - DNA, 311 bp, Zea mays
  Clone ID: 700095614H1
agcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgacacgctgtcgtacctgccgccgctgtcgacggacgacctgctgaagcaggtggaccacctgctgcgcaacggctggactacctgcctcgag

SEQ ID NO: 31 - DNA, 283 bp, Zea mays
  Clone ID: 700577012H1
caagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggacta

SEQ ID NO: 32 - DNA, 284 bp, Zea mays
  Clone ID: 700100637H1
agcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggact

SEQ ID NO: 33 - DNA, 279 bp, Zea mays
  Clone ID: 700045636H1
ggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcga

SEQ ID NO: 34 - DNA, 291 bp, Zea mays
  Clone ID: 700210942H1
agcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgc

SEQ ID NO: 35 - DNA, 290 bp, Zea mays
  Clone ID: 700213737H1
agcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcagtggactacctgctgcgc

SEQ ID NO: 36 - DNA, 312 bp, Zea mays
  Clone ID: 700097664H1
agcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgaaggacgacctgctgaagcaggtggactacctgctgcgc

SEQ ID NO: 37 - DNA, 286 bp, Zea mays
  Clone ID: 700212658H1
caagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacct

SEQ ID NO: 38 - DNA, 296 bp, Zea mays
  Clone ID: 700101672H1
cccacgcgtccgagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggact

SEQ ID NO: 39 - DNA, 283 bp, Zea mays
  Clone ID: 700053379H1
agcaagcaagcaagcagcgagtacatacatactaggcagccaggcagccatggcgcccaccgtgatgatggcctcgtcggccaccgccgtcgctccgttccaggggctcaagtccacctccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggac

SEQ ID NO: 40 - DNA, 265 bp, Zea mays
  Clone ID: 700025653H1
tactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactagctgctgcg

SEQ ID NO: 41 - DNA, 286 bp, Zea mays
  Clone ID: 700333193H1
aagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggacta

SEQ ID NO: 42 - DNA, 312 bp, Zea mays
  Clone ID: 700211830H1
cggacgcgtgggcaagcaagcaagcagcgagtacatacatactaggcagccaggcagccatggcgcccaacgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccgcctacggcaacaagaagttcgagacgctgtcgtacctgccgccgctgtcgacggacgacctgctgaagccagtggactacctgctgcgcaacggctg

SEQ ID NO: 43 - DNA, 326 bp, Zea mays
  Clone ID: 700097362H1
gctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcc

SEQ ID NO: 44 - DNA, 276 bp, Zea mays
  Clone ID: 700214096H1
caagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaag

SEQ ID NO: 45 - DNA, 272 bp, Zea mays
  Clone ID: 700042186H1
aagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggt

SEQ ID NO: 46 - DNA, 325 bp, Zea mays
  Clone ID: 700097564H1
agctcgatctactactactactagctggtacacatactagccagcctgccagccagcttgccatggcgcccaccgtgatgatggcctcgtcggcaaccgccgtcggcccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccggcgctgtcgacggacgacctgcttaagcaggtggactacctgctgcgcaacggctggataccctg

SEQ ID NO: 47 - DNA, 291 bp, Zea mays
  Clone ID: 700097886H1
cccacgcgtccggcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgacgctgtcgacggacgacctgctgaagcaggtggact

SEQ ID NO: 48 - DNA, 258 bp, Zea mays
  Clone ID: 700043286H1
ggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctg

SEQ ID NO: 49 - DNA, 291 bp, Zea mays
  Clone ID: 700356225H1
ctgcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgccgtcgacggacgacctgctgaagcaggtggactacctgctgcgcaac

SEQ ID NO: 50 - DNA, 289 bp, Zea mays
  Clone ID: 700046066H1
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcagtgtggccggcctacggcaacaagaagttcgagacgctgtcgtacctgccgccgctgtcgacggacgacctgctgaag

SEQ ID NO: 51 - DNA, 276 bp, Zea mays
  Clone ID: 700433801H1
atcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgactgctgaagcagtgga

SEQ ID NO: 52 - DNA, 259 bp, Zea mays
  Clone ID: 701185535H1
ccggagccggccatcccgtcgcacactctccccctctatatatgccgtcggtgtgggggagcctactacaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaa

SEQ ID NO: 53 - DNA, 264 bp, Zea mays
  Clone ID: 700044292H1
agcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctg

SEQ ID NO: 54 - DNA, 268 bp, Zea mays
  Clone ID: 700053495H1
gcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaa

SEQ ID NO: 55 - DNA, 285 bp, Zea mays
  Clone ID: 700053373H1
cggacgcgtggctggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttg

SEQ ID NO: 56 - DNA, 250 bp, Zea mays
  Clone ID: 700224630H1
gtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccac

SEQ ID NO: 57 - DNA, 297 bp, Zea mays
  Clone ID: 700046049H1
atcctacccggacgccttccaccgcgtcatcggcttcgagaacatcaagcagacgcatgcgtcacttcatcgcctacaagcccccgggcagcgactagaccgctgccgccggccgccccccgccggctagctagctagctagctcctgcgtgagctagtagctagtgccatgcgtcgtctctgtcgttcagctttgcttcgggtcaccgtgtaccctttgcttgcttggtttcttctttccttttgtcctgtttttttcatcttttccccggccatggttcctttgctttccagcag

SEQ ID NO: 58 - DNA, 257 bp, Zea mays
  Clone ID: 700045078H1
ctccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagct

SEQ ID NO: 59 - DNA, 275 bp, Zea mays
  Clone ID: 700046107H1
caagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcg

SEQ ID NO: 60 - DNA, 258 bp, Zea mays
  Clone ID: 700045287H1
gcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccgg

SEQ ID NO: 61 - DNA, 298 bp, Zea mays
  Clone ID: 700210539H1
actactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaac

SEQ ID NO: 62 - DNA, 269 bp, Zea mays
  Clone ID: 700212887H1
caagcaagcaagcagcgagtacatacatactaggcatccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctg

SEQ ID NO: 63 - DNA, 269 bp, Zea mays
  Clone ID: 700421770H1
cggctcgagagcaagcaagcagcgagtacatacatactaggcagccaggcagccatggcgaccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacga

SEQ ID NO: 64 - DNA, 300 bp, Zea mays
  Clone ID: 700211658H1
catggactgtgtgttgcccatcccaattcccaaccccaaccaaaccaaacacgcgtgcaggtgtggccggcctacggaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgt

SEQ ID NO: 65 - DNA, 265 bp, Zea mays
  Clone ID: 701182334H1
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcaccaacggcggaaggatccggtgcatgcaggtgtggccggcctacggcaacaagaagttcgagacgctgtcgtacctgccgcc

SEQ ID NO: 66 - DNA, 238 bp, Zea mays
  Clone ID: 700044245H1
cagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaag

SEQ ID NO: 67 - DNA, 262 bp, Zea mays
  Clone ID: 700045992H1
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcatcggcggaaggatccggtgcatgcaggtgtggccggcctacggcaacaagaagttcgagacgctgtcgtacctgcc

SEQ ID NO: 68 - DNA, 312 bp, Zea mays
  unsure (1)...(312): unsure at all n locations
  Clone ID: 700215027H1
aagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggctacggcaacaagaagttcgagncntgtcgtactgccgccgctgtcgacggacgactgctgaagccagtggatacctgtgcgcaacggctggatacctgctcgattcanaagt

SEQ ID NO: 69 - DNA, 228 bp, Zea mays
  Clone ID: 700042688H1
gcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtac

SEQ ID NO: 70 - DNA, 236 bp, Zea mays
  Clone ID: 700044947H1
cgccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaa

SEQ ID NO: 71 - DNA, 249 bp, Zea mays
  Clone ID: 700045847H1
agcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgcc

SEQ ID NO: 72 - DNA, 241 bp, Zea mays
  Clone ID: 700215351H1
gctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgtgtcgtacctgccgccgtg

SEQ ID NO: 73 - DNA, 314 bp, Zea mays
  Clone ID: 700094920H1
gctcgatctactactactactagctggtacacatactagccagcctgccagccagcttgccatggcgcccaccgtgatgatggcctcgtcggcaaccgcccgtcgccccgttcaagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggc

SEQ ID NO: 74 - DNA, 248 bp, Zea mays
  Clone ID: 700044201H1
ttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcgtgagctagtagctagtgccatgcgtcgtctctgtcgttcggtt

SEQ ID NO: 75 - DNA, 285 bp, Zea mays
  Clone ID: 700335684H1
agcaagcaagcaagcagcgagtacatacatactaggcagccaggcagccatggcgcccaccgtgatgatggcctcgtcggccaccgccgtcgctccgttccaggggctcaagtccaccgccagccggcccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggacta

SEQ ID NO: 76 - DNA, 307 bp, Zea mays
  Clone ID: 700101503H1
cccacgcgtccgagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccggtgtcgacggacgacctgctgaagcaggtggactacctgctgcgcaacggctgg

SEQ ID NO: 77 - DNA, 294 bp, Zea mays
  Clone ID: 700099376H1
tctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagccagtggactacct

SEQ ID NO: 78 - DNA, 291 bp, Zea mays
  Clone ID: 700099542H1
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacgtgctgaagc

SEQ ID NO: 79 - DNA, 235 bp, Zea mays
  Clone ID: 700046244H1
aagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcg

SEQ ID NO: 80 - DNA, 287 bp, Zea mays
  Clone ID: 700088638H1
agctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaag

SEQ ID NO: 81 - DNA, 242 bp, Zea mays
  Clone ID: 700044223H1
gctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaag

SEQ ID NO: 82 - DNA, 232 bp, Zea mays
  Clone ID: 700042573H1
actactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaa

SEQ ID NO: 83 - DNA, 279 bp, Zea mays
  Clone ID: 700214068H1
cccacgcgtccgcccacgcgtccgcccacgcgtccggcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcg

SEQ ID NO: 84 - DNA, 229 bp, Zea mays
  Clone ID: 700198026H1
caagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcg

SEQ ID NO: 85 - DNA, 292 bp, Zea mays
  Clone ID: 700045910H1
agcaagcaagctcgatctactactactactagctggtacacatacgagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctg

SEQ ID NO: 86 - DNA, 286 bp, Zea mays
  Clone ID: 700097189H1
caagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacg

SEQ ID NO: 87 - DNA, 276 bp, Zea mays
  Clone ID: 700042282H1
ctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacga

SEQ ID NO: 88 - DNA, 244 bp, Zea mays
  Clone ID: 700045136H1
aagcaagctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggca

SEQ ID NO: 89 - DNA, 273 bp, Zea mays
  Clone ID: 700097141H1
agctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacgg

SEQ ID NO: 90 - DNA, 212 bp, Zea mays
  Clone ID: 700025538H1
gctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggaacaagaag

SEQ ID NO: 91 - DNA, 276 bp, Zea mays
  Clone ID: 700042620H1
gctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcga

SEQ ID NO: 92 - DNA, 266 bp, Zea mays
  Clone ID: 700042070H1
actactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgac

SEQ ID NO: 93 - DNA, 261 bp, Zea mays
  Clone ID: 700218243H1
caagcaagcaagcaagcagcgagtacatacatactaggcagccaggcagccatggacgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgtgtcgtacctgccgccgctgtcgacg

SEQ ID NO: 94 - DNA, 270 bp, Zea mays
  Clone ID: 700043362H1
ctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgc

SEQ ID NO: 95 - DNA, 269 bp, Zea mays
  Clone ID: 700043484H1
aagcaagctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgta

SEQ ID NO: 96 - DNA, 258 bp, Zea mays
  Clone ID: 700042923H1
ccgacgccttccaccgcgtcatcggcttcgacaacatcaagcagacgcatgcgtcagcttcatcgcctacaagcccccgggcagcgactagaccgcgcccgccggccgccccccgccggctagctagctagctagctcctgcgtgactagtagctaactccatgcgtcgtctctgtcgttcggttttgcttcgggtcaccgtgtaccctttgcttgcttggtttcttctttccttttttccttttttttcttcttttc

SEQ ID NO: 97 - DNA, 226 bp, Zea mays
  Clone ID: 700441659H1
ccgcagccaggcagccatggcgcccaccgtgatgatggcctcgtcggccaccgccgtcgctccgttccagggcctcaagtccaccgccaggctccccgtcgcccgccgctcctccagaagcctcggcaacgtcagcaacggcggaaggatccggtgcatgcaggtgtggccggcctacggcaacaagatgttcgagacgctgtcgtacctgccgccgttgtcgacg

SEQ ID NO: 98 - DNA, 265 bp, Zea mays
  Clone ID: 700044543H1
gctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacc

SEQ ID NO: 99 - DNA, 198 bp, Zea mays
  Clone ID: 700214747H1
cggacgcgtggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaag

SEQ ID NO: 100 - DNA, 271 bp, Zea mays
  unsure (1)...(271): unsure at all n locations
  Clone ID: 700084502H1
cccacgcgtccggcaagcaagctcgatctactactactactagctggtacacatactagccagcctgccagccagcttgccatggcgcccaccgtgatgatggcctcgtcggcaaccggcgtcgccccgttccagggtctcaagtccgccgccagcctncccgtcgcccgccgcagcaccaggagcctcggcaacgtcagcaacggcggaaggatccggtgcatgcaggtgtggccggcctacggcaacaagaagttcgagacgctgtcgt

SEQ ID NO: 101 - DNA, 242 bp, Zea mays
  Clone ID: 700046322H1
tactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgct

SEQ ID NO: 102 - DNA, 194 bp, Zea mays
  unsure (1)...(194): unsure at all n locations
  Clone ID: 700216096H1
gctggtacacatactagccagcctgccagccagcttgccatggcgcccaccgtgatgatggcctcgtcggnaacngncgtcgcnccgttccagggtctcaagtccgccgncagnctccccgtcgcccgncgcagcaccaggagcctcggcaacgtnagcaanggcggaaggatccggtgcatgcaggtgtggng

SEQ ID NO: 103 - DNA, 259 bp, Zea mays
  Clone ID: 700043871H1
aagcaagctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgaga

SEQ ID NO: 104 - DNA, 250 bp, Zea mays
  Clone ID: 700429382H1
gctagtagctagctagtgccatgcgtcgtctctgtcgttcggttttgcttcggggtcaccgtaccctttgcttgcttggtttcttctttcctttttcctttttttttttcttttccccggccatggttcctttgctttccagttttctctgctggatgtgatgtatccattgttgcaagctgggccttgcattggctacctctatacctgctgctacaaaactactgaacgcctatatatacttggggtg

SEQ ID NO: 105 - DNA, 199 bp, Zea mays
  Clone ID: 700442416H1
aataagcaagcagcgagtacatacatactaggcagccaggcagccatggcgcccaccgtgatgatagcctcgtcggccaccgccgtcgctccgttccaggggctcaagtccaccgccagcatccccgtcgcccgccgctcctccagaagcctcggcaacgtcagcaacggcggaaggatccggtgcatgcaggtagtgg

SEQ ID NO: 106 - DNA, 306 bp, Zea mays
  Clone ID: 700208826H1
accacgcgtccgcaacgcgccgggacctggcgagctgcgcgagaactccacctccccgtactactacgacggccgctactggaccatgtggacgctgcccaagttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcctccgggcagcgactagaccgcgcccgctggctgccccgccggctagctactactagctctgcgtga

SEQ ID NO: 107 - DNA, 200 bp, Zea mays
  Clone ID: 700209462H1
agcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcgaaagtttccggtgcatgcaggtgt

SEQ ID NO: 108 - DNA, 316 bp, Zea mays
  unsure (1)...(316): unsure at all n locations
  Clone ID: 700209449H1
nccacgcgtccgcggaccgtggcgacgtggnaagctcgatctactactactactagctggtacacatactagccagactgccagccagcttgccatggcgcccaccgtgatgatggcctcgtcggcaaccgccgtcgccccgttccagggtctcaagtccgccgccagcctccccgtcggccgacgcagcaccaggagcctcggcaacgtcagcaacggcggaaggctccggtgcatgcaggtgtggccggcctacggcaacaagaagttcgagacgctgtcgtacctgacagcgctgtcgacagacgacctgctg

SEQ ID NO: 109 - DNA, 179 bp, Zea mays
  Clone ID: 700354501H1
agcagccaggcagccatggcgcccaccgtgatgatggcctcgtcggccaccgccgtcgctccgttccaggggctcaagtccaccgccagcctcaccgtcgcccgcagctcctccagaagcctcggcaacgtcagcaacggcggaaggatccggtgcatgcaggtgtggccggcttacgg

SEQ ID NO: 110 - DNA, 132 bp, Zea mays
  Clone ID: 700099672H1
gcaagcaagcagcgagtacatacatactaggcagccaggcagccatggcgcccaccgtgatgatggcctcgtcggccaccgccgtcggtccgttccagggggtcaagtccaccgccagcctccccatcgccc

SEQ ID NO: 111 - DNA, 200 bp, Zea mays
  unsure (1)...(200): unsure at all n locations
  Clone ID: 700216452H1
agttttttttgtnagcagcnggtatagaggtagccaatgcaaggccatgcttgcaacaatggatacatcacatccagcagagaaaactggaaagcaaaggaaccatggccggggaaaagaaaaaaaaaaggnaaaaggaaagaagaaaccaagcaagcaaagggtacggtgaccccgaagcaaaaccgaacgacagagac

SEQ ID NO: 112 - DNA, 123 bp, Zea mays
  Clone ID: 700097732H1
cggacggtgggtcgatctactactactactagctggtacacatactagccagcctgccagccagcttgccatggcgcccaccgtgatgatggcctcgtcggcaaccgccgtcgccccgttcca

SEQ ID NO: 113 - DNA, 119 bp, Zea mays
  Clone ID: 700334324H1
caagcaagctcgatctactactactactagctggtacacatactagccagcctgccagccagcttgcgatggcgcccaccgtgatgatggcctcgtcggcaaccgccgtcgccccgttc

SEQ ID NO: 114 - DNA, 327 bp, Zea mays
  Clone ID: 700098206H1
aggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctccttttttttccctttatctcatcatttcttttctcctgcatgcaatggttccttttgcttccaacaattctcctgctgatgtatccagcatggcatcatccatctacaattacgtacgtagtgcaacgact

SEQ ID NO: 115 - DNA, 277 bp, Zea mays
  Clone ID: 700443785H1
ctcgagccgccatgttcggctgcaccgacgccacgcaggtgtacaaggagctgcaggaggcactcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctcctttttttcccctttatctcatca

SEQ ID NO: 116 - DNA, 286 bp, Zea mays
  Clone ID: 700444325H1
ctcgagccgccatgttcggctgcaccgacgccacgcaggtgtacaaggagctgcaggagaccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctccttttttttccctttatctcatcatttcttttc

SEQ ID NO: 117 - DNA, 208 bp, Zea mays
  Clone ID: 700096125H1
tttgcttccaacaattctcctgctgatgtatccagcatggcatcatccatctacaattacgtacgtagtgcaacgactgtcgattcgttgggtgaggaacatatatgtgaatgcaagctccggctaccatacatgtgtaatgtgtaatagatatatatacaaaactgccgaggcgccgacaatactttaataactggtccttttatat

SEQ ID NO: 118 - DNA, 255 bp, Zea mays
  Clone ID: 700447385H1
ctcgagccgccatgttcggctgcaccgacaccaagcaggtgtacaaggagctgcaggagtacatcgccgcgtacccggacgccttccaccgagtcatcggcttcgacaacgtcaggcagacgcagtgcgtcagcttacatcgcctactagccccccggcagcgagtagagtccgtggctagatagacccatggccatgcatctgcatgttgatcggatcaccttcttgcattggttcctactaatcactcccccc

SEQ ID NO: 119 - DNA, 166 bp, Zea mays
  Clone ID: 700101184H1
ataaaaggaccagttattaaagtattgtcggcgcctcggcagttttgtatatatatctattacacattacacatgtatggtagccggagcttgcattcacatatatggtcctcacccaacgaatcgacagtcgttgcactacgtacgtaattgtagatggatgatg

SEQ ID NO: 120 - DNA, 140 bp, Zea mays
  Clone ID: 700042451H1
caattacgtacgtagtgcaacgactgtcgattcgttgggtgaggaacatatatgtgaatgcaagctccggctaccatacatgtgtaatgtgtaatagatatatatacaaaactgccgaggcgccgacaatactttaaaaa

SEQ ID NO: 121 - DNA, 322 bp, Zea mays
  Clone ID: LIB189-012-Q1-E1-F5
cggcgacctaccaggcttatcagcctaaccgtcctacatcagcgtccacaaagcgtccgaccatgcttccgacacggttctgttactaacatgtttacttccattgtgggtaacgtatttggattctaagccttacgcgctctacatttggaggatatacgacttccccctgcgtagtcacgaactttctaaggtcctcctcacggtatccaagttgacagggataagttgaacaagtacggtcgtcctttactatgatatactactaaaccataaataggattatccgcatcacacttactgtacagcgtattatcattgt

SEQ ID NO: 122 - DNA, 423 bp, Zea mays
  unsure (1)...(423): unsure at all n locations
  Clone ID: LIB189-022-Q1-E1-A5
tnagtgtctacgcggtggncttgnttttancaaagntnatcaaancntannctcacaaccatttatgcgctggnaagaccgtnttgtcattngtgccnanncaatttataangcacaagcnnaanctggtganatcaagggncattacntgantgcgactgcaggtacatgcgaagaaatgattaatacagntgtatttgcaatgganttatgggttcctantgtnatgcatgactacttancaggaggattcaacgcaaatactactttgtctcantattgccgcnacaacgggcaacttctcanattcaaccgagcaatncatgcantattgntccncacangaatcatgggaagcatttcgtgtagnaacttaaancatnccntagtccgggggaaattcatatccacnccggtacatat

SEQ ID NO: 123 - DNA, 183 bp, Zea mays
  Clone ID: LIB3060-004-Q1-K1-D4
cgttcctggggacccatatcaatatatctgttatgtagcttatccattagacctatttgaagagggttctattactaacatatttactttcattgtgggtaacgtatttagttgcaaagccttacacgctctacttttggaggatctacgaattccccctggtgattcaaaaacttttcaagg

SEQ ID NO: 124 - DNA, 163 bp, Zea mays
  Clone ID: LIB3060-005-Q1-K1-A3
ggtacatggacaactgtttggactgatggacttaccagtcttgatcgttacaaaggacgatgctatcacatcgagcccgttcctggggacccagatcaatatatctgttatgtagcttatccattagacctatttgaaaaaggtttctggtactaacatgttt

SEQ ID NO: 125 - DNA, 452 bp, Zea mays
  Clone ID: LIB3060-040-Q1-K1-G6
tcggcaagcaagcaagcagcgtgtatttacatactaggcagccaggcagccagggcgcccaccttgatggtggcctcgtctgccaccgccgtcgctcctgtccagggtctcaagtccaccttcagccttcccatctcccgccgctccttcagaatcctttgcttcttcttcatctgcatattttatccttttcattcattttttttctttttttctttaatttttatttatttataatttcattttttattatttttttatttttttttatttattttatttattttatttattttatttttgttgtgattttatttatttttttattttattattatattattttattctatttatttattttatttttatattatttatttatattttttattttctattctattttttataattttttttattatcttttttattttatttttttttat

SEQ ID NO: 126 - DNA, 244 bp, Zea mays
  unsure (1)...(244): unsure at all n locations
  Clone ID: LIB3060-050-Q1-K1-E5
agatatgtgttactaatgtngttccatccctgtgagacccgttcactacagntaggactgtcccggcttcgacccacgcgtctcgacagaaacccccctgctgtattcatacaacttctccacggtaccttctcacggtatcacaagttggaaaggttataaggttgaacaagtgactgtctgtcctttattggcgatgtactattacaaccaataattgtagatttatccctcaataaaatta

SEQ ID NO: 127 - DNA, 158 bp, Zea mays
  Clone ID: LIB3062-029-Q1-K1-F9
tcaagcaagcaagcagcgagttcatacttactacgcagccaggcagccatggggccgagcgcgatgatggcctggtctgcgaccgccttcgctcccatacagtgtctcacgttcaccgtcagcctctccgtagccaggcgctcctccataagcctatg

SEQ ID NO: 128 - DNA, 437 bp, Zea mays
  unsure (1)...(437): unsure at all n locations
  Clone ID: LIB3062-015-Q1-K1-E9
tggatggagggtttgtgcctagctacagacttagnatcactacctttccatctcgatgtgggatgcagccaacgtacgctcccacccgttgatggccttgattgtcaccaccttcgatcccttccagaagtctcaagtacaccgccaaccgtgcccatagcccaccactcctccagaatcctcggcaacatcatcaacggcagaacgatcccgctcatacatgtatagccggcctaccgcaacaagaagttcgagacactttcatacctgccaccgctttccaccgacgacctgctgaatcatagtcactacctgctgctcaacgactggatacaccttactctaactaaaacaggtcggattcgtgtaccgtgaaaactccacctacccttgctactacaaccgccagtactggaccatgtctgaatctgcccata

SEQ ID NO: 129 - DNA, 371 bp, Zea mays
  Clone ID: LIB3062-057-Q1-K1-G7
ctaggcagccaggcagccatggcgcccaccgtgatgatggccttgtcggccaccgccgtcgctccgttccatgggctggagttcaccgacagtcttcccgacgaccggcgctgctccagaagcctatgtaacgttagcaacggcggaaggatccggtgcatgcaagggtggtcggactacggaaacacgaagttctagactctgtagtacctggcggcgattgcgacagacgacctgcttgagcaatgtgactaccatgatgtgcaacggctggataccctggctctagttcataccggacagatatgagtaccgtgagaacttcatctaaccgtgctaattcgaactgcgttactggaccatgcgaaagc

SEQ ID NO: 130 - DNA, 428 bp, Zea mays
  Clone ID: LIB3067-018-Q1-K1-F10
cccactcgttcggactagctctagttgctgaggaatattttactggtacatggacaactggttcgactgatagactcaccagcctggatcgttacaaaggacgatgctatcacatcgagcccgttcctggggactcatatcaatatatctgttatgtagctcatccataagacctatacgacgagggctctgatactaacatgtttaattacattgagcgtaacgtgttcgacgtcaaagccttacgcgctatacatacgtaggatctactaatttccactgcttattcaaaatctttgcaagcttcaatctacacggtatccaagttagaaacgcttaacttgaacaagtaccgttgttctttattgggatgggctatgtaacctataatgggatcatcctcgaaaaattacggtacagcgtgctat

SEQ ID NO: 131 - DNA, 466 bp, Zea mays
  unsure (1)...(466): unsure at all n locations
  Clone ID: LIB3068-020-Q1-K1-A6
tganatcaaggggcantacttgaatgcnactgcangtccatgcgannaaatgatnangagagctgtatttgcnngggaattangggnacctattgtaangcatgantncttaacaggaggattcnccgcatatactactttgnctnattattgncganacaacngnctacttctttacattcacngagcaatgcatgcanntattgatagacagaaaaatcatggtatgcatttccgngnattagctaaagcattgcgnntgtcgggnggagatcatatccactccggnacaacatnnnngtaagttacgaaggggaacgcnaaataactttaggntttggnganntattgcncgatgatnctattgaaaaaanatcgttcttgcggtatctgttttnacttcaagactgggtatncattccaagtggtatacccngnggnttnttgggggntattcatgttaggg

SEQ ID NO: 132 - DNA, 404 bp, Zea mays
  unsure (1)...(404): unsure at all n locations
  Clone ID: LIB3068-050-Q1-K1-B9
ccacaatggaagtaaacatgttagtaacgnatttggtttcaaagccttnggcgctctacgtttggaggatctacnaattccccctgcttattcaaaaactttccaaggtccgcctnacggnatccaagttgaaagggataagttgaacaagtacngtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggatagaccgtttcggntnannaagcctnnngagcnatcannattnatantnntnaatggcatgcccnntacnatgnntnnttaanccttnggtntntgtacttt

SEQ ID NO: 133 - DNA, 395 bp, Zea mays
  unsure (1)...(395): unsure at all n locations
  Clone ID: LIB3068-016-Q1-K1-D3
atgatgaactgctatgnttgaactgntngtanagttcaaatctctacttcccctcgacccacgcgtacgttatgtcaccacatacagaaactaaaccaattcctgtatttaaacctgctgtcaatgattagaaacggactatactacaccccggagtacgaaaccaaggatactgatatcttcacagcattcccattaactactcatatccaaactcctcctgaagaatcatgagctgcagtagactgccaatcttctactagcacatgtacaactgtatgcactgatacacttaccagacttgatcgatacaaacgaccatgctatcacatcgagcccgtttctagggacccatatcaatatatctgttatgtagcttattcattatacctatt

SEQ ID NO: 134 - DNA, 312 bp, Zea mays
  Clone ID: LIB3078-015-Q1-K1-A3
gatcggatcaccttcttgcattgggtcctctgtctctcttcctactttacactcccggtatcgcatcatctcttttctactgcatgcaatggtctcttttgcttacaacaattctcctgctgatgtatccagcatggcatcatacatctacaattacgtacgtagtgcaacgactgccgattcgttgcgtgacgaacatatatgcgaatgcaagctgcgactaccatacatgcataatgagtgataaatatatatacaaaactgactaagcgccgaccatactctaataactggtccaaaacattataacaa

SEQ ID NO: 135 - DNA, 314 bp, Zea mays
  Clone ID: LIB3078-006-Q1-K1-A3
cccacgcgtccgcggacgcttgagcggattcatggtcacacacgtggggggctcttagggcgcctcccaggtgtacaaggagctgcatgaggccatcaaatcctacccggacgccttccaccgcgtcatcgacttaaacaacatcaagcatacacactgcgtcagcttcatcacctacaagcccccggtcagcgactataccgagctcgtcggccgtcctcctgcggctagctagctagctagctcctgcgtgagctaatagctagtgccatgcgtagtctatgacgatcggttttgcttcaagtcaccgtgta

SEQ ID NO: 136 - DNA, 226 bp, Zea mays
  unsure (1)...(226): unsure at all n locations
  Clone ID: LIB3078-006-Q1-K1-C8
cgtgcttctgcagcttacttacttgctntgtattgtcgatccgcctctagacccacgcttgcgggacacctccgtagctccatatcatgggctcaactgcattttcaacctatcatctcccggcctcctgcaaatcctctcaacttcatctaaccctaatggattccctgcatgcaggtatgttcggcctaccccaacaagaaattcgagactctctcatacctac

SEQ ID NO: 137 - DNA, 301 bp, Zea mays
  Clone ID: LIB3078-053-Q1-K1-B1
accgtcgtcgctacgttccaggggctctaggacaccggcaggctccccgtcttccttcgctggtccataagcctcggcagcgtcagcaacgagatggaaggatccggtgcatgcatgtgtgtacgttctacggtaacaagaagttttagacgctgtcatacctgccggcgctttcgatagacgacctgctgaaccatgctgactacctgctgttcaacagttggataccctggcttgagttcaccaaggtcagcttcttgtaccgtcgagaacgttacctatattgagctactaccactgg

SEQ ID NO: 138 - DNA, 376 bp, Zea mays
  unsure (1)...(376): unsure at all n locations
  Clone ID: LIB3078-034-Q1-K1-C1
gcntacnnatactcngangcnnttccataagccnacgnaacgatcancaacaggggggaaggatccnntncatgcatgngtgnccggctctacgancaacnataaggatcgagacnctttaatacgtacnacgtgctntnaagggacganctgttgaagcagntggactanctgntgagcaangnatggataccctgcctcgagttcatcaangtantgattcntgtaccgngagaactacanacntncncgtgctactacgacataacgctactggaccatgtgngaagctgtccatgtnnganctgcaaccgacgccacccacgtgtacannggagctgcangaggtcatcanatttancccggacgcctttca

SEQ ID NO: 139 - DNA, 454 bp, Zea mays
  unsure (1)...(454): unsure at all n locations
  Clone ID: LIB3078-039-Q1-K1-H12
ggggcattacttgaatgcgactgcaggtacatgctaagaaatgattaagagagctggatttgnggggnaattaggggntnctattgtaatgcatgactacttaacaggaggattcaccncanatactactttgtctnattattgccgngacancggcctacttnttcacattcaccgagcaatgcatgcagttattgatagacagaaaaaatnatggtatgcatttncntgtattaactaaagcattgcgtatgtnggggggagaacnttttcacttccgtncaattttanggaagttatnaggggaacgcnnaaataacntttaggttttggnnattaatgtgcnatnattttattnaaaaagatgntcttggngtatnnttttaatcatnaatnggnatanatccatgggntatctnttggnttttnggntnatcattttnggctatttcaa

SEQ ID NO: 140 - DNA, 276 bp, Zea mays
  Clone ID: LIB36-008-Q1-E1-E1
gcagcctgtcgtaggactcggtagtcctaggtcgccccgcgcgtccgtgctgaagcaggtggactacctgctgcgcaacggctggataccctgcctcgagttcagcacggtcggcttcgtgtaccgcgagaactccacctccccgtgctactacgactgccgctactggaccatgtggaagctgcccatgttcggctgcaacgactccacccaggtgtacacggagctccaggaggcgatcaagacctacccggaggccttccaccgcgtcatcgg

SEQ ID NO: 141 - DNA, 464 bp, Zea mays
  unsure (1)...(464): unsure at all n locations
  Clone ID: LIB36-020-Q1-E1-H9
gggtgcgcgtagcgtcaactgcaacgactacgagactctactgtcgacgcaacactctatagttgcgtcgtattaatncntcagacgaagctatcacatctaactcgttcctgaggacgcagatccatatagctgttacggttgcttatccattacacctagttcaatatggttcggttccgatcatgtctacttccattgcaggtaacgtaattggtttcaaagccttacgcgctctacgtttcggcgatctactaattccccctgcttagtcaaaaactttccaaggtccgcctcacagtaaccaagttgaaatggataagttgaacaagtacggtcgtcctttactgggatgtactattcaaccaaaattgggattatccgcaccaaattactgtacagcgtgttatgagtgtctactcagtgggcttgattttacaatagatgatgagaacgtaaactca

SEQ ID NO: 142 - DNA, 401 bp, Zea mays
  unsure (1)...(401): unsure at all n locations
  Clone ID: LIB36-018-Q1-E1-D9
gtttggaggatctacaaattccccctgcttattcaaaaactttccaaggtccgcctcacggtatccaagttgaaagggataagttnaacaagtacggtcgtcctttantgggatgtactantaaaccaanattgggattatccgcaaaaaattncggtagagcgtgtnangagtgtcnangcggtggacttgatttnaccaaagatgatgaanacgtaaactcnnaancatttatgcnctggagagaccgttttgtcttttgtgccgantcnntttanaangcanancgcggaanttggtgnaaatcanggngncattngnntgantgctacnnncaggtanntgnngaagagnnggngnangagannngnntttcgcgaaggggaattagggggttccca

SEQ ID NO: 143 - DNA, 330 bp, Zea mays
  Clone ID: LIB84-004-Q1-E1-A2
cggacacttgggcggaagcgtgggctgccgcgcaacggctggatatcctgcgacgagttcagcaaggtcggcttcgtataccgcgagaactccagctccccgtgccactacgaatgccgctacaggaccatgttgaagctgccgatgttctgctgcatctacgccacccaggtgtcaacggatctgcacgatgccatcaaatcctacccggacgccttccacggcgtcagctgattctacaacatcaagcacacgcacttcgtcagcttcatcacctacaagccccctggcagctgactcatcgctcccggcgtgccgaccacgccggtt

SEQ ID NO: 144 - DNA, 303 bp, Zea mays
  Clone ID: LIB84-015-Q1-E1-B4
cactttctttaggatttttttttctatgggtatcctgattgtaaaaggcatccagtcgctttgagaccaacaatatttgatcgccttccagaattcagaacctgcggctaattcaccacgccatttgcaagctgctttgataatttcagtaccttcacgagcaagatctcgcccttcgttacgagcttgtacacaggcgtcgaacgccacacgattagctgctgcaccaggtgcatttccccaaggatgtccgaaagttccgccaccaaattgtaatacggaatcatctccaaagatttcggt

SEQ ID NO: 145 - DNA, 463 bp, Zea mays
  Clone ID: LIB36-014-Q1-E1-C4
cattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcaacagctaatcgtgtggctttagaagcctgtgtacaagctcgtaacaaagggcgcg

SEQ ID NO: 146 - DNA, 462 bp, Zea mays
  unsure (1)...(462): unsure at all n locations
  Clone ID: LIB36-014-Q1-E1-B6
caaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatnatatccactccggtacagtagtaggtaagttag

SEQ ID NO: 147 - DNA, 477 bp, Zea mays
  unsure (1)...(477): unsure at all n locations
  Clone ID: LIB3068-005-Q1-K1-B1
cttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttatacccggtggcttctgggggtatcatgtttggcatatgccagctctgacccgaaatctttngagatnatt

SEQ ID NO: 148 - DNA, 469 bp, Zea mays
  unsure (1)...(469): unsure at all n locations
  Clone ID: LIB3066-053-Q1-K1-H3
ctcacaaccatttatgcgctggagagaccgttttgtcttttgtgccgaagcaatttataaagcacnggccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtnagttagaaggggaacgcgaaataactttaggttttgttgatttattgcccgatgatttattgaaaaaagatcggtctcgcngtatcttt

SEQ ID NO: 149 - DNA, 456 bp, Zea mays
  unsure (1)...(456): unsure at all n locations
  Clone ID: LIB36-016-Q2-E2-F11
ctcantattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaag

SEQ ID NO: 150 - DNA, 456 bp, Zea mays
  unsure (1)...(456): unsure at all n locations
  Clone ID: LIB3068-022-Q1-K1-C10
caaaaaattacggtagagcgtgttatgagtgtctacgcggtggacttgattttaccaaagntgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatattcacttcngtacagtaggtaggt

SEQ ID NO: 151 - DNA, 448 bp, Zea mays
  unsure (1)...(448): unsure at all n locations
  Clone ID: LIB3078-007-Q1-K1-B11
attaaaccaaaattgggattatccgcaaaaaattanggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatgggtatgcatttccgtgtattagctaaagcattgcgtatgtccggg

SEQ ID NO: 152 - DNA, 449 bp, Zea mays
  unsure (1)...(449): unsure at all n locations
  Clone ID: LIB3078-049-Q1-K1-A1
gaaaacgtaaactcacaaccatttatgcgctggagagaccgttttggnttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggntttggtgatttattgccnatgatttt

SEQ ID NO: 153 - DNA, 432 bp, Zea mays
  Clone ID: LIB3060-016-Q1-K1-C8
gccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacagga

SEQ ID NO: 154 - DNA, 437 bp, Zea mays
  unsure (1)...(437): unsure at all n locations
  Clone ID: LIB189-012-Q1-E1-F10
aaacgtaaactcacaaccatttatgcgctggagagaccgttttgtcttttgtgccgaancaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcnaaataactttangttttgntganttaatgc

SEQ ID NO: 155 - DNA, 429 bp, Zea mays
  Clone ID: LIB3078-049-Q1-K1-G3
gggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctat

SEQ ID NO: 156 - DNA, 440 bp, Zea mays
  unsure (1)...(440): unsure at all n locations
  Clone ID: LIB3060-025-Q1-K1-H1
tngggattatccgcaaaaaattacggtngagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgcccgcgacaacggnctacttnttcacattcaccgagcaatgcatgcagttattgatagacagaaaaatcatggtatgcatttccgtgtattagctaaagcattgcgtatgtcggggggga

SEQ ID NO: 157 - DNA, 433 bp, Zea mays
  unsure (1)...(433): unsure at all n locations
  Clone ID: LIB3060-016-Q1-K1-D2
gccttacgcgctctacgtttggaggatntacgaattccccctgcttattcaaaaactnnncaagggncgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggag

SEQ ID NO: 158 - DNA, 438 bp, Zea mays
  unsure (1)...(438): unsure at all n locations
  Clone ID: LIB189-029-Q1-E1-H11
tatgtaccttatccattacacctatttgaagagggttctgttactaacatgtttacttccattgtgggtaacgtatttggtttcaaagccttacgcgctctacgtttggaggatctacnaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccggaaactggtgaaatcaaggggcattacttgaatgcnactgcagg

SEQ ID NO: 159 - DNA, 421 bp, Zea mays
  Clone ID: LIB36-021-Q1-E1-H9
taccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgaatgtctacgcggtggacttgattttaccaaagatgatgaaaacgtaaactcacaaccatttatgcgctgg

SEQ ID NO: 160 - DNA, 418 bp, Zea mays
  Clone ID: LIB84-008-Q1-E1-G8
tgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagc

SEQ ID NO: 161 - DNA, 437 bp, Zea mays
  unsure (1)...(437): unsure at all n locations
  Clone ID: LIB36-021-Q1-E1-B7
ggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcngtggacttgattttaccaanagatgatgaaaacgtaaactcacaaccanttatgcgctgggagaagaacg

SEQ ID NO: 162 - DNA, 460 bp, Zea mays
  unsure (1)...(460): unsure at all n locations
  Clone ID: LIB189-016-Q1-E1-A3
cgtttcagcactgtcacntgcagtgcggtcgaggtccaaagtccaggacgcgtccgattaaaactggtgttaaggattataaattgacttactacaccccggagtacgaaaccaaggatactgatatcttggcagcattccgagtaactcctcagctcggggttccgcctgaagaagcaggagctgcagtagcggcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatcaacgaattccccctgcttattcaaaaac

SEQ ID NO: 163 - DNA, 431 bp, Zea mays
  unsure (1)...(431): unsure at all n locations
  Clone ID: LIB3060-052-Q1-K1-B5
gtaactcctcagctcggggtttcgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgatactaacatgtttacttccattgtgggtaacgtatttggtttcaaagccttacgcgctctacgtttggaggatctacgaattcccgctgcttattcaaaaactttccaaggtccgnctcacggtatccaagttgaaagggataagttgaacaagtacggtcgtcctttattgggatgtactattaaaccaaaattgggattatccgcaaaaaatta

SEQ ID NO: 164 - DNA, 457 bp, Zea mays
  unsure (1)...(457>: unsure at all n locations
  Clone ID: LIB3078-023-Q1-K1-F3
atgaaaacgtaaactcacaaccatttatgcgctggagagaccgttttgcttttgtgccgnagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggnctacttcttcacattcaccgagcaatgcatgcagttattgatagacagaaaaatcatggtatgcatttccgtgtattagctaaagcattgcgtatgtcggggggagatcatatccactccggtcagtagtaggtaaagttagaaaggggaacgcgaaataactttaggntttggtgatttattgcgccatgattttattga

SEQ ID NO: 165 - DNA, 444 bp, Zea mays
  unsure (1)...(444): unsure at all n locations
  Clone ID: LIB3066-005-Q1-K1-D11
gctgtatttgcaagggaattaggggttcctattgtaatgcatgactacttaacaggaggangncacggnaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccanctntgacccnaatctttggagatgattnccgatttac

SEQ ID NO: 166 - DNA, 450 bp, Zea mays
  unsure (1)...(450): unsure at all n locations
  Clone ID: LIB189-023-Q1-E1-H10
catatgtcgtcgtgcngtacctacantannncgncgntggccccacgcgtacgctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggaaaagttgaacaagtacggtcgtcctttaatgggatgttctattaaaccaaaattgggattatccgc

SEQ ID NO: 167 - DNA, 443 bp, Zea mays
  unsure (1)...(443): unsure at all n locations
  Clone ID: LIB189-004-Q1-E1-B6
gattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaancatggtatgccatttccgtgtataacctaaagcattgctatgtcggggggagtnatatccactccggtacagtagtaggtaagttagaaggggaacgcgaaataactttaggtttgg

SEQ ID NO: 168 - DNA, 432 bp, Zea mays
  unsure (1)...(432): unsure at all n locations
  Clone ID: LIB3078-018-Q1-K1-F2
cattattgccgcgacaacggcctacttcttcacattcaccgagcaangcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattcccgtattacaatttggtggaggaactttaggacatccttggggaaatgcacctggtgcaacaacttaatcgtgtggctttaa

SEQ ID NO: 169 - DNA, 432 bp, Zea mays
  unsure (1)...(432): unsure at all n locations
  Clone ID: LIB3066-003-Q1-K1-F3
gggcattacttgaatgcgactgcaggtacatgcgaagaaatgattgngagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcncggtatctttttcactcangactgggnatncatgccaagngttttaaccgtnggntttngg

SEQ ID NO: 170 - DNA, 446 bp, Zea mays
  unsure (1)...(446): unsure at all n locations
  Clone ID: LIB3062-053-Q1-K1-D2
cattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggaaaanccgtttggncttttgtgcccgaacaattataaaggccaagccgaaactggtgaaatcaaggggcattacttgaatgcnctgcaggtcatgcgaagaaatgattaagaga

SEQ ID NO: 171 - DNA, 435 bp, Zea mays
  unsure (1)...(432): unsure at all n locations
  Clone ID: LIB3069-017-Q1-K1-E6
gatggacttaccagtcttgatcgttacaaatgacgatgctatcacatcgagcccgttcctggggacccagatcaatatatctgntatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgctnacggtatccaagttgaaagggataagttgaacaagtacngtcgncctttattgggatgtactattaaaccaaaattgggattatccgcaaaaaattcggtagagcgtgttatgagtgtctacgcggtggacttgattttaccaaagatgatgaaaacgtaaactcacaaccatttatgcgctgganagaccg

SEQ ID NO: 172 - DNA, 425 bp, Zea mays
  unsure (1)...(425): unsure at all n locations
  Clone ID: LIB3078-054-Q1-K1-H4
cgcngtggacttgattttaccaaagatgatgaanacgtngactcacaaccatttatgcgctggagagaccgntttgtcttttgtgccgaagcaatttataaagcacaagccgaaactggtgaaatcaaggggcattacttgaatgcgactgcangtacatgcnaagaaatgattaagagagctgnatttgcaagggaattaggggttcctattgtaatgcatgactacttaacaggaggattcaccgcaaatactactttgtctcattattgccgngacaacggcctacttcttcacattcaccgagcaatgcatgcaggtattgatagacagaaaaatcatggnatgcattnccgtgtattagctaaagcattgcgtatgtcggggggagatcatattcacttcngtacantaatangtaagtt

SEQ ID NO: 173 - DNA, 413 bp, Zea mays
  unsure (1)...(413): unsure at all n locations
  Clone ID: LIB3060-036-Q1-K1-F5
ccaagttgaaagggataagttgaacaagtacggtcgtcctttatggggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgnaaaatctacttggcctcattattgccgngacaacggcntatttnttnana

SEQ ID NO: 174 - DNA, 394 bp, Zea mays
  Clone ID: LIB3078-014-Q1-K1-E11
cgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcg

SEQ ID NO: 175 - DNA, 446 bp, Zea mays
  unsure (1)...(446): unsure at all n locations
  Clone ID: LIB3066-015-Q1-K1-D8
aacatgtttacttccattgtgggtaacggatttggtggncaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaaagccgaaactggtgaaatcaaaggggcattacttgaatgcgactggaggtacatgccaaagaaatgattaaaaaagctgganttggcaagggaattaagg

SEQ ID NO: 176 - DNA, 360 bp, Zea mays
  Clone ID: LIB3068-016-Q1-K1-D2
ttatgtcaccacaaacagaaactaaagcaagtgttggatttaaagctggtgttaaggattagaaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatggttacttcca

SEQ ID NO: 177 - DNA, 432 bp, Zea mays
  unsure (1)...(432): unsure at all n locations
  Clone ID: LIB189-011-Q1-E1-F8
agagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctgganagaccgttttgtcttttgtgccngaagcaatttataaagcacaagccgaaactggtgaaatcaaagggggcattacttgaatgcaactgcanggtanatgcnaaanaaatgatt

SEQ ID NO: 178 - DNA, 451 bp, Zea mays
  unsure (1)...(451): unsure at all n locations
  Clone ID: LIB3060-002-Q1-K2-B4
gttctgttactaacatgtttacttccattgtgggtaacgtatttggtttcaaagcctnncgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgtttgtcttttgtgccgaagcaatttataaagcacaagccgaaactggtgaaatcaagggggcattactttgaatgcgactgcaggtacatgccaaagaaaatgattaaagaagagctgnattttgcaaggga

SEQ ID NO: 179 - DNA, 433 bp, Zea mays
  unsure (1)...(433): unsure at all n locations
  Clone ID: LIB3078-004-Q1-K1-G9
gaggatctacgaattccccctgcttattcaaaaactttccaaggtccgcctcacggnnnncaagttgaaagggataagttgaacaagtacggtcgtcctttattgggatgtactattaaaccaaaattgggattatccgcaaaaaattacggtagagcgtgttatgagtgtctacgcggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgnagggacatgccgaagaaatggataagaaaacctgatttgcaaggggaattaggggtnctatggnaatgcatgactacttaacaggaggattcaccggaaatactact

SEQ ID NO: 180 - DNA, 423 bp, Zea mays
  unsure (1)...(423): unsure at all n locations
  Clone ID: LIB189-031-Q1-E1-A5
acccaagcgtcngtgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcantgcgtatgtccggggggaaatnatatccactcccggtacaantagtaggtaanttagaaggggaac

SEQ ID NO: 181 - DNA, 422 bp, Zea mays
  unsure (1)...(422): unsure at all n locations
  Clone ID: LIB36-019-Q1-E1-F7
cacggtggacttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttancaggaggattcaccgcanatactactttgtctcattattgccgcgacaacggcctacttcttcacattcactgagcantgcatgcagttattgatagacagaagaatcatggtatgcatttcccgtgtattagcnaaangcattgcgtatgtccggggggagatcatntccnctccggtacngtagttgg

SEQ ID NO: 182 - DNA, 407 bp, Zea mays
  unsure (1)...(407): unsure at all n locations
  Clone ID: LIB84-030-Q1-E1-G10
catatccactccggtacagtagtaggtaagttagaaggggaacgcgaaataactttaggttttgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaanggcgcgatcttgctcgtgaaggtaatgaaattatcaaagcaaccttgcaaatggantgctgaaactaaccccaaccttg

SEQ ID NO: 183 - DNA, 453 bp, Zea mays
  unsure (1)...(453): unsure at all n locations
  Clone ID: LIB3062-031-Q1-K1-A10
gacgcggtggactngattttaccaangatgattnanncntaaactcacaaccatttatncgcnggagagnccgttttgtcttggggtgccgaagcaatttataaagcacaagccgaaactggtgaaatcaaggggcattacttgaatgcgactgcaggtacatgcgaagaaatgattaatagagctgtatttgcaagggaattaggggttcctattgtaatgcatgactacttaacaggaggattaccgcaaatactactttgtctcattattgncgcgacaacggcctacttcttnacattcaccgagcaatgcatgcagttattgatagacagaaaaatcatggtatgcatttccgngtattagctaaaagcattgccgtatgtctgggggagatcatatncactccggtacaagtataggtaagttanaangggaacnccaaaatacctt

SEQ ID NO: 184 - DNA, 431 bp, Zea mays
  unsure (1)...(431): unsure at all n locations
  Clone ID: LIB3078-014-Q1-K1-E2
gtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtcggggggagatcatatccactccggtacagtagtaggtaagttagaaggggaacgccaaataactttaggntttggtgatttattgcgccatgattttattgnaaaanaatcggtcttgcggggatcttttttacttaagantgggnattcctgcccagggggtata

SEQ ID NO: 185 - DNA, 432 bp, Zea mays
  unsure (1)...(432): unsure at all n locations
  Clone ID: LIB189-020-Q1-E1-G2
agcttatccattagacctatttgaanagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccanaattgggattatccgcaaaaaattacggtagagcgtgttatgagtgtctacgcggtggacttgattttaccaaagatgatgaaaacgtaaactcacaancatttatgcgctgganaagaccgttttgtcctttgtgccnnangcaatttatnnagcacaagcccgaaactggntgaaatccaaggggcattacttgaatgcgaac

SEQ ID NO: 186 - DNA, 441 bp, Zea mays
  unsure (1)...(441): unsure at all n locations
  Clone ID: LIB189-003-Q1-E1-G6
cnaagatgatnaaaacgttaactcacaaacatttntncgctggagagacngttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatactactttgtctcattattgccgcgacaacggcctacttcttcacattcaccgagcaatgcatgcagttattgatagacagaaaaatcatggtatgcatttccgtgtattagctaaagcattgcgtatgtccgggggganattatnnnccncnccgggtanantantaggtaaatttaaaaggggaaccccnaaataaccttaaggttt

SEQ ID NO: 187 - DNA, 406 bp, Zea mays
  Clone ID: LIB3060-009-Q1-K1-F8
gagggacttatgtcaccacaaacagaaactaaagcaagtgttggatttaaagctggtgttaaggattataaattgacttactacaccccggagtacgaaaccaaggatactgatatcttggcagcattccgagtaactcctcagctctgggttccgcctgaagaagcaagagctgcagtagctgcggaatcttctactggtacatggacaactgtttggactgatggacttaccagtcttgatcgttacaaaggacgatgctatcacatcgagcccgttcctgggtacccagatcaatatatgtgttatgtagcttatccattatacctatttgaagagggttctgttactaacatgtttactttcattgtgggtaacgtatttggtttcaaagccttacgcgctc

SEQ ID NO: 188 - DNA, 508 bp, Zea mays
  unsure (1)...(508): unsure at all n locations
  Clone ID: LIB3078-011-Q1-K1-C10
gtgcnnngtgngttnnnnaaggccttganngangtancggtcnncggnctcggnaattcccgggtgcgacgccagcgccgtccgcgccgaaataaccttnntaggttttgttgatttattgtcgcgatgattttatntgaaaaagatcgggggtcgcggtatncttgttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcacatntgatggtttcaaagcgatggataccattat

SEQ ID NO: 189 - DNA, 353 bp, Zea mays
  Clone ID: LIB3066-027-Q1-K1-H12
gtcgttgtgagaattcttaattcatgagttgtatggagggacttatgtcaccacaaacagaggctaaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaatgacgatgctatcacatcgagcccgttcctggggacccagatcaatatatctggaatgtagcttat

SEQ ID NO: 190 - DNA, 423 bp, Zea mays
  unsure (1)...(423): unsure at all n locations
  Clone ID: LIB84-005-Q1-E1-B4
cgacataactttaggttttgttgatttattgcgcgatgattttattgaaaaagatcgttctcgcggtatctttttcactcangactgggtatccatgccaggtgttataccggtggnttctgggggtattcangtttggcatatgccagctctgaccganatctttggagatgattccgtattacaatttggtggnggaactttaggacatccttggggaaatgcacctggtgcaacaagctaatccgtgtggctttagaagcctgtgtacaagctcgtaacganngggcgcgatcttgctcgtgaaggtaatgaaattatcaaagcagcttgcaaatggagtgctgaaactagccgcagcttgtgananatggggaggagatcaaatttgatnggctncaanangcgaatggatacatataa

SEQ ID NO: 191 - DNA, 365 bp, Zea mays
  unsure (1)...(365): unsure at all n locations
  Clone ID: LIB3078-027-Q1-K1-E11
gcggtatctttttcactcaggactgggtatccatgccaggtgttataccggtggcttctgggggtattcatgtttggcatatgccagctctgaccgaaatctttggagatgattccgtattacaatttggtggaggaactttaggacatccttggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaaattgatggtttcaaagcgatggataccatttttaaataaanaaaa

SEQ ID NO: 192 - DNA, 334 bp, Zea mays
  Clone ID: LIB36-016-Q2-E2-G10
ctcaggactgggtatccatgccaggtgttataccggtggcttctgggggtattcatgtttggcatatgccagctctgaccgaaatctttggagatgattccgtattacaatttggtggaggaactttaggacatccttggggaaatgcatctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccat

SEQ ID NO: 193 - DNA, 407 bp, Zea mays
  Clone ID: LIB3060-020-Q1-K1-H7
ctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcggtctttattgggatgtactatttaaaccaaattggga

SEQ ID NO: 194 - DNA, 412 bp, Zea mays
  unsure (1)...(412): unsure at all n locations
  Clone ID: LIB3068-045-Q1-K1-F6
cggttattttcccccgacctgcncgcacggacggncncgnncggaaatnccggggcggaccaagccgtcgggaaaatcttaattcattaagtggtagggagggcactatgtcaccacaaacagaaattgaagcaagtgttggatttaaagctggtgttaaggattataaattgacttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaagacgatgctatcacatcgagcccgttcctggggacccaaatcaatatatctgttatgtagc

SEQ ID NO: 195 - DNA, 444 bp, Zea mays
  Clone ID: LIB3060-048-Q1-K1-C5
aatgtgtatctgaaaagaggggagtgtgatctggggatgcttcatccggtcaagaggggagagagataaaccatgcgtccgttcaggttgacgctgcgcctgaagaagcaggagctgaagaggatgaggaatgttttagtgatacatggacaactgattggactgatggacttaccagtcttgatcgttacaaaggacgatgctatcacatcgagcccgttcctggggacccagatcaatatatctgttatgtagcttatacattagacctatttgaagagggttctgttactaacatgtttacttccattgtgggtaacgtatttggtttcaaagccttacgcgctctacgttaggaggatctacgaattccccctgcttaatcaaaaactttccaaggtccgcctcacggtatccaagttgaaagggataagttgaacaagt

SEQ ID NO: 196 - DNA, 439 bp, Zea mays
  unsure (1)...(439): unsure at all n locations
  Clone ID: LIB3078-028-Q1-K1-G7
catatccactccggtacagtagtaggtaagttagaaggggaacgcgaaataactttaggttntgttgatttattgcgcgatgattttattgaaaaagatcgttctcgcggtatctttttcactcaggactgggtatccatgccaggtgttataccggtggcttctgggggtattcatgtttggcatatgccagctctgaccgaaatctttggagatgattcccgtattacaatttggtggaggaactttangacatncttgggggaaatgcacctgggtgcagcaactaatcgtgtggcttaaaaancctgtgtccaagctcgtaacgaagggcccgaccttgctcggaaaggtaatgaaatntcaaagcacttgcaaatggagtgctnactaccgaacttgggaaatttggaagggacnaattgtngttcaaaggatg

SEQ ID NO: 197 - DNA, 445 bp, Zea mays
  unsure (1)...(445): unsure at all n locations
  Clone ID: LIB3078-008-Q1-K1-F7
cttgattttaccaaagatgatgaaaacgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcaccgcaaatctactttgnctcattattgccgngacaacggnctacttctttcacattcaccgagccatgcatgcagntattggnttgacngaaaaatcatgggatncattttcgtggattannttaagcantgggtatgtcngggggagatcatnttcacttcnggtcantnnttggtaaatttaaagggaacnccaaataaccntnnggt

SEQ ID NO: 198 - DNA, 473 bp, Zea mays
  unsure (1)...(473): unsure at all n locations
  Clone ID: LIB3078-035-Q1-K1-H4
attaaaccaaaattgggattatcccgcaaaaaattacggtagagcgtgttatgagtgtctacgcggtggacttgattttaccaaagatgatgaaaaccgtaaactcacaaccatttatgcgctggagagaccgttttgtcttttgtgccgaagcaatttataaagcacaagccgaaactggtgaaatcaaggggcattacttgaatgcgactgcaggtacatgcgaagaaatgattaagagagctgtatttgcaagggaattaggggttcctattgtaatgcatgactacttaacaggaggattcacccgcaaatactactttgtctcattattggcgnaccaccggctaatttttnacattcaccgagcaatgcattcanntatttgatagacagaaaaatnatngtatgcatttncgggtttancttaagcattgngtttgtngggggggggacatttcnntncggtccnt

SEQ ID NO: 199 - DNA, 424 bp, Zea mays
  Clone ID: LIB36-015-Q1-E1-E1
cggacacgtgggcggacgcgtgggctgttatgtagcttatccattagacctatttgaagagggttctgttactaacatgtttacttccattgtgggtaacgtatttggtttcaaagccttacgcgctctacgtttggaggatctacgaattccccctgcttattcaaaaactttccaaggtccgcctcacggtatccaagttgaaagggataagttgaacaagtacggtcgtcctttattgggatgtactattaaaccaaaattgggattatccgcaaaaaattacggtagagcgtgttatgagtgtctacgcggtggacttgattttaccaaaggatggtgagaacgtgaactcacagccatttatgccccgggagagaccgttttggtctttgtgccgaagcaatttcaaaagcacaagccg

SEQ ID NO: 200 - DNA, 405 bp, Zea mays
  Clone ID: LIB3060-029-Q1-K1-E10
gagaattcttaattcatgagttgtaaggagggtcttatggcaccacaaaccggaactggaaccaggggtggatttaaagctggtggtaaaggttataaattggcttactacaccccggagtacgaaaccaaggatactgatatcttggcagcattccgagtaactcctcagctcggggttccgcctgaagaagcaggagctgcagtagctgcggaatcttctactggtacatggacaactgtttggactgatggacttaccagtcttgatcgttacaaaggacgatgctatcacatcgagcccgttcctggggacccagatcaatatatctgttatgtagcttatccattagacctatttgaagagggttctgttactaacatgtttacttccattgtgggtaac

SEQ ID NO: 201 - DNA, 285 bp, Zea mays
  unsure (1)...(285): unsure at all n locations
  Clone ID: LIB3060-038-Q1-K1-B8
ctttgtctcattattgccgcgacaacggcctacttcttcanntngnccgagcaatgcatgcagttattgatagacagaaaaatcatggtatgcatttccgtgtattagctaaagcattgcgtatgtcggggggagatcatatccactccggtacagtagtaggtaagttagaaggggaacgcgaaataactttaggttttgttgatttattgcgcgatgattttattgaaaaagatcgttctcgcggtatctttttcactcangactgggtatccatgcccnaaa

SEQ ID NO: 202 - DNA, 326 bp, Zea mays
  Clone ID: LIB189-026-Q1-E1-D9
acggggggtattcatgtttggcatatgccagctctgaccgaaatctttggagatgattccgtattacaatttggtggatgaactttaggacatccttggggaattgcacctggtgcagcagctaatcgtgtggctttaaaagcctgtgtacaagctcgtaacgaagggcgcgatcttgctcgtgaaggtaatgaaattatcatagcagcttgcaaatggagtgctgaactacccgcagcttgtgaaatatggaaggagatcaaatttgatggtttcaaagcgatggataccatatacaataaaagcaaagccgcaacagtcaaaaa

SEQ ID NO: 203 - DNA, 406 bp, Zea mays
  unsure (1)...(406): unsure at all n locations
  Clone ID: LIB189-034-Q1-E1-D10
tatctccgccgctctacctncactaaacttccggcggccccacgcgtcaggacgcccttttttttttttttttatatggtatccaacactttgaaaccatcaaatttgatctccttccatatttcacaagctgcggctagttcagcactccatttgcaagctggggggataatttcattaccttcacgagcaagatggcgcccttcgttacgagcttgtacacaggcttctaaagccacacgattagctgctgcaccagctgcatttccccaacgatgtcctaaagttcctccaccaaattgtaatacggaatcatctccaaagatttcggtcagagctggcatatgccaaacatgaatattttttttttcaccggtataacacctggcattgatacccagtcctg

SEQ ID NO: 204 - DNA, 348 bp, Zea mays
  Clone ID: LIB189-023-Q1-E1-F3
acccacgcgtccgcatgccaggtgttataccggttggctttctggggggttattcaaggtttgtggcaaaatgccaagctctggaaccgaaatcctttggagaatgatttccgtattacaatttgggggagggaactttaggacatcctgggggaaatgcacctggggcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatat

SEQ ID NO: 205 - DNA, 352 bp, Zea mays
  Clone ID: LIB83-001-Q1-E1-E9
agggctcgcagtggtacgctgtgagtacggcccgacattccgaggtcgacccagtcgtccgcacacgcgtacgcggacgcgtgggtggggaaatgcacctggtgcagcagctaatcgtgtggctttagaagcctgtgtacaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatataaaataggcgtcgttttagaacgtcgtgacggggaaaacccggggcgttacgcagcttaatcgcgttg

SEQ ID NO: 206 - DNA, 298 bp, Zea mays
  Clone ID: LIB189-021-Q1-E1-D6
aggacgcgtgggcggacgcgtgggcaagctcgtaacgaagggcgcgatcttgctcgtgaaggtaatgaaattatcaaagcagcttgcaaatggagtgctgaactagccgcagcttgtgaaatatggaaggagatcaaatttgatggtttcaaagcgatggataccatataaaaaaaaaaaaccaaaaaaaaaaaaacaaaaaacaaaaacaacccacaaaaacaacacaaacacaagaaaaagaaaaccaaaacaaaaaaaaaaaagggggggccccccaaagggttcaaacctaagt

SEQ ID NO: 207 - DNA, 403 bp, Zea mays
  Clone ID: LIB3060-026-Q1-K1-C3
caaatgcacggtttaataacgaaccgtgttaacttaccataacaacaactcaattcctatcgagttccgtcctatcgaattcctatagtaaaattcctataggatagaacgtacacagggtgtacacattatatatgaatgaaacatattcattaacttaagcatactcctttttttatttaatgagttgatattaattaaatatcttttttttttagatttttgcaaaggtttcatttacgcctaatccatatcgagtagaccctgtcgttgtgagaattcttaattcatgagttgtaaggagggacttatgtcaccacaaacagaaactaaagcaagtgttggatttaaagctggtggtaaagattataaattggcttactacaccccggaatacgaaacc

SEQ ID NO: 208 - DNA, 391 bp, Zea mays
  Clone ID: LIB189-018-Q1-E1-E9
caaatccacggtttaataacgaaccgtgttaacttaccataacaacaactcaattcctatcgaattccttcctatcgaattcctatagtaaaattcctataggatagaacgtacacagggtgtacacattatatatgaatgaaacatattcattaacttaagcatactcctttttttatttaatgagttgatattaattaaatatcttttttttttagatttttgcaaaggtttcatttacgcctaatccatatcgagtagaccctgtcgttgtgagaattcttaattcatgagttgtagggagggacttatgtcaccacaaacagaaactaaagcaagtgttggatttaaagctggtgttaaggattataaattgacttactaaaccccg

SEQ ID NO: 209 - DNA, 438 bp, Zea mays
  Clone ID: LIB3060-020-Q1-K1-A10
caaatccacggtttaataacgaaccgtgttaacttaccataacaacaactcaattcctatcgaggtccttgctatcgaattcctatagtaaaattcctataggatagaacgtacacagggtgtacacattatatatgaatgaaacatattcattaacttaagcatactcctttttttatttaatgagttgatattaattaaatatctttttttttagatttttgcaaaggtttcatttacgcctaatccatatcgagtagaccctgtcgttgtgagaattcttaattcatgagttgtacggagggacttatgtcaccacaaacagaaactaaagcaagtgtgggattaaaggctggggttaaggatattaaattgacttactacacccgggagtacgaaaccaaggatactgatatcttggcagcattccgagtaact

SEQ ID NO: 210 - DNA, 438 bp, Zea mays
  Clone ID: LIB3078-018-Q1-K1-H8
gcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagct

SEQ ID NO: 211 - DNA, 433 bp, Zea mays
  Clone ID: LIB36-009-Q1-E1-E12
aagcaagaaagcaagcagcgagtacatacatactatgcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggtggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtatcgcgagaactccacctccccgtgctactacgacggccgctactggaccatgtggaagctgcccatgttcggctgcaacgacgccaccca

SEQ ID NO: 212 - DNA, 433 bp, Zea mays
  Clone ID: LIB3078-013-Q1-K1-H11
atccggtgcatgcaggtgtggccggcctacggcaacaagaagttcgagacgctgtcgtacctgccgcggctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcg

SEQ ID NO: 213 - DNA, 414 bp, Zea mays
  Clone ID: LIB83-007-Q1-E1-C9
agcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgc

SEQ ID NO: 214 - DNA, 442 bp, Zea mays
  Clone ID: LIB36-014-Q1-E1-H9
ccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgcccccgccg

SEQ ID NO: 215 - DNA, 409 bp, Zea mays
  Clone ID: LIB3066-002-Q1-K1-B12
agcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatg

SEQ ID NO: 216 - DNA, 458 bp, Zea mays
  Clone ID: LIB3062-036-Q1-K1-F11
gccaggcaggcatggcgcccaccgtgatgatggcctcgtcggccaccgccgtcgctccgttccaggggctcaaggccagggccagcctcccggtcgcccggcgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccatgtgtacaaagagctgcaggaagccatcaaatcctacccggacgccttccaccgcgtcatcggc

SEQ ID NO: 217 - DNA, 428 bp, Zea mays
  Clone ID: LIB36-007-Q1-E1-G2
cccaagcgtacgaagcaagcagcgagtacatacatactaggcagccaggcagccatggcgcccaccgtgatgatggcctcgtcggccaccgccgtcgctccgttccaggggctcaagtccaccggcagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgccatgttcggctgcaacgac

SEQ ID NO: 218 - DNA, 441 bp, Zea mays
  unsure (1)...(441): unsure at all n locations
  Clone ID: LIB3078-006-Q1-K1-C7
ggccaccgccgtcgctccgttccaggggctcaagtccaccgccagcctccccatcgcccgccgctcctgcagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctncccgtgctactacgacggccgctactggaccatgtggaagctgcccatgttcggctgcaacgacgccacccaggtgtacaaggagctgcangaggccatcaaatcctacccggacgccttccaccgcgtcatcggcttcgacaacatcaagcagacgca

SEQ ID NO: 219 - DNA, 413 bp, Zea mays
  Clone ID: LIB3078-034-Q1-K1-B7
gcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatc

SEQ ID NO: 220 - DNA, 381 bp, Zea mays
  Clone ID: LIB36-009-Q1-E1-H2
agcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtgggctacctgctgcgcaacggctggataccctgcctcgagttcagcaagggcggcttcgtgtaccgcgagaactccacctccccgtgctactacgacggccgctactgga

SEQ ID NO: 221 - DNA, 411 bp, Zea mays
  Clone ID: LIB36-020-Q1-E1-F10
agctagcagcagagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgttgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttccgctgc

SEQ ID NO: 222 - DNA, 437 bp, Zea mays
  Clone ID: LIB3078-053-Q1-K1-D9
cccacgcgtccgcggacgcgtgggtccaggggctcaagtccaccgccagcctccccatggcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaag

SEQ ID NO: 223 - DNA, 434 bp, Zea mays
  Clone ID: LIB83-015-Q1-E1-B8
cccacgcgtccggcaagcaagcaagcagcgagtacatacatactaggcagccatgcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacga

SEQ ID NO: 224 - DNA, 434 bp, Zea mays
  Clone ID: LIB36-004-Q1-E1-D2
caagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcatgtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtg

SEQ ID NO: 225 - DNA, 443 bp, Zea mays
  unsure (1)...(443): unsure at all n locations
  Clone ID: LIB83-011-Q1-E1-H7
aagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcaagcaaggtcggcttcgtgtaccgcgagaactccacctccccgtgctactacgacgggcgctactgggccatttggaancnncccaagttttgggggtnaaangaccccacccaggtgtt

SEQ ID NO: 226 - DNA, 416 bp, Zea mays
  Clone ID: LIB3078-018-Q1-K1-H1
agcaagcagcgagtacatacatactaggcagccaggcagccatggcgcccaccggatgatggcctcggcggccagcggcgtcgctccgttccaggggctcaagtccaccgccagcctccccgtcgcccgccgctcctccagaagcctcggcaacgtcagcaacggcggaaggatccggtgcatgcaagtgtggccggcctacggcaacaagaagttcgagacgctgtcgtacctgccgccgctgtcgacggacgacctgctgaagcaggtggactacctgctgcgcaacggctggataccctgcctcgagttcagcaaggtccgcttcgtgtaccgcgagaactccacctccccgtgctactacgactgccgctactggaccatgtggaagctgcccatgttcggctgcaacgacg

SEQ ID NO: 227 - DNA, 480 bp, Zea mays
  unsure (1)...(480): unsure at all n locations
  Clone ID: LIB189-030-Q1-E1-E9
cggtggcgcaacgtcacctcgtccgtgccggtcgtacattaacgggtccacgcacgcgtccgcaccacgagtccgcggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagccccgggcagcgactagaccgcgccncgcggccggccccccgccggctagctatagctcctgcg

SEQ ID NO: 228 - DNA, 419 bp, Zea mays
  Clone ID: LIB189-006-Q1-E1-F9
acccacgcgtccgcccacgcgtccgcctgcctcgagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcgtgagctagtagctagtgccatgcgtcgtctctgtcgttcggttttgcttcgggtcaccgtgtaccctttgcctgcctgggttcctcct

SEQ ID NO: 229 - DNA, 441 bp, Zea mays
  Clone ID: LIB36-022-Q1-E1-H3
atctgtcactctggcaggcacaggacttagactcgtgggtcgacgcaagcctctacagtgagtcagtacatacgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacgggcgctact

SEQ ID NO: 230 - DNA, 453 bp, Zea mays
  unsure (1)...(453): unsure at all n locations
  Clone ID: LIB83-011-Q1-E1-D3
ggtacatacatactaggcagccaggcagccatgggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgaaggacgacctgctgaagcaagtggactacctgctgcgcaacggctggataccctgcctcgagttcaacaaggtcgggttcgtgttaccgcgagaactccacctcccccgtgctactacnacggccgctactggaccatgtgggaactgccangtttcnggntgcaaanaagcccnccccnnnttnnanggggttttcagggggcntnaattcnt

SEQ ID NO: 231 - DNA, 344 bp, Zea mays
  Clone ID: LIB3062-047-Q1-K1-B2
agcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcga

SEQ ID NO: 232 - DNA, 455 bp, Zea mays
  unsure (1)...(455): unsure at all n locations
  Clone ID: LIB36-016-Q2-E2-D9
agcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatgtggaagctgcccatgttcggctgcancgacgccacgcaggtgtt

SEQ ID NO: 233 - DNA, 424 bp, Zea mays
  Clone ID: LIB36-021-Q1-E1-G3
accgtcacctagcaagccattacctagactagtgggtccacgcaagcctctagaatgagtcgtatcaagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcgtgagctagtagctagtgccatgcgtcgtctctgtcgttcggttttgcttcgggtcaccgt

SEQ ID NO: 234 - DNA, 364 bp, Zea mays
  Clone ID: LIB3078-004-Q1-K1-B4
gccgtcgctccgttccaggggctcaagtccaccgtcagcctccccgtcgcccgtcgcgcctggagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgatactggaccatgtggaagctgcccatgttcggctgcaacgacgccacccaggtgtacaaggagctgc

SEQ ID NO: 235 - DNA, 382 bp, Zea mays
  unsure (1)...(382): unsure at all n locations
  Clone ID: LIB3068-056-Q1-K1-C6
cccacgcgtccgcaagcaagctttcagctagtacatacatactanncanccaggcagcgatggctcccaccgtgatgatngcctcntcngccaccgccgtcgctccgttccaggggctcaagtccaccgccagcctccccgtcgcccgccgctcctccagaagcctcggcaacgtcagcaacggcggaaggatccggtgcatgcaagtgtggccggcctacggcaacaagaagttcgagacgctgtcgtacctgccgccgctgtcgacggacgacctgcttaagcaggtggactacctgctgcgcaacggctggataccctgcctcgagttcagcaaggtcggcttcgtgtaccgcgagaactccaccttcccgtgctacta

SEQ ID NO: 236 - DNA, 423 bp, Zea mays
  Clone ID: LIB3078-052-Q1-K1-F8
gagttcagcaaggtcggcttcgtgtaccgcgagaactccacctccccgtgctactacgacggccgctactggaccatgtggaagctgcccatgttcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctagctagctagctcctgcgtgagctagtagctagtgccatgcgtcgtctctgtcgttcggttttgcttccggtcaccgtgtaccctttgcttgcttgggttcttcttttcttttttccttttttttcttcttttccccggccat

SEQ ID NO: 237 - DNA, 425 bp, Zea mays
  Clone ID: LIB36-021-Q1-E1-A6
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaatggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactctagctccccgtgctactacgacggccgctactggaccatgtggaagctgcccatg

SEQ ID NO: 238 - DNA, 389 bp, Zea mays
  Clone ID: LIB189-028-Q1-E1-B12
accacgagtccgcggacgcgtgggccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaagtgtacaaggagctgcaggaggccatcaaatcctacccggacgccttc

SEQ ID NO: 239 - DNA, 399 bp, Zea mays
  Clone ID: LIB83-005-Q1-E1-B3
agcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgc

SEQ ID NO: 240 - DNA, 360 bp, Zea mays
  unsure (1)...(360): unsure at all n locations
  Clone ID: LIB3060-020-Q1-K1-G10
agcagcgagtacatacatactaggcagccaggcagccatggcgcccaccgtgatgatggcctcgtgggccaccgccgtcgctccgttccaggggctcaagtccaccgtcagcctccccgtcgcccgccgctcctccagaagcctcggcaacgtcagcaacggcggaaggatccggtgcatgcaggtgtggccggcctacggcaacaagaagttcgagacgctgtcgtacctgccgncgctgtcgacggacgacctgctgaagcaggtggactacctgctgcgcaacggctggataccctgcctcgagttcagcaaggtcngcttcgtgtaccgcgagaactccaccctcccgtgctacta

SEQ ID NO: 241 - DNA, 446 bp, Zea mays
  Clone ID: LIB36-013-Q1-E1-E6
cccaagcaagcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcatgtggactacctgctgcccaacggctggataccctgcctcgagttcagcaagctcgggttcgtgtaccgcgagaactccacctcgtcgtgctactacgaccgccgctactggaccatgtggaagctgcccatgttcggctgcacg

SEQ ID NO: 242 - DNA, 415 bp, Zea mays
  Clone ID: LIB84-015-Q1-E1-E1
ggcccggctcgatctaatactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccagctccccgtgcgactacgacgggcgctactggaccaggtgg

SEQ ID NO: 243 - DNA, 381 bp, Zea mays
  Clone ID: LIB36-006-Q1-E1-E10
agcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccaactccccg

SEQ ID NO: 244 - DNA, 415 bp, Zea mays
  Clone ID: LIB84-027-Q1-E1-H12
ctcacgcggctgtgtcggcgttatgccggctaggctctaccgactcgtcagcacgcaagcaagcagcgagtacatacatactatgcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgccgcgcaacggctggataccctgcctcgagttcagcaaggtcggcttcgtgtaccgcgagaactccaactccccgtg

SEQ ID NO: 245 - DNA, 399 bp, Zea mays
  unsure (1)...(399): unsure at all n locations
  Clone ID: LIB3067-001-Q1-K1-B11
gctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctncccgtgctactacgat

SEQ ID NO: 246 - DNA, 416 bp, Zea mays
  Clone ID: LIB3062-016-Q1-K1-D11
cgcccaccgtgatgatggccttgtcggccaccgccgtcgatccgttccaggggctcaggtccaccgccaggctccccgttgcccggcgttcctccagaagcctaggcaacgtcagcaacggctgaaggatccggtacatgcatgtgtggacggcctacagcaacaagaaggtcaagacgctggcgtacctgccgacgctgtcgaccgacgacctgctgaagctggtggactacctactgcgcaacgggtggataccctgcctcgagttcaacaaggtcggcttcgtgtaccgcgagaactccaccttcccgtgctactacgacagccgctactggaccatgtggaatctgcccatgtcactctgcaacgaccccacccaggtgtacaaggagctgcatgaggccattaaatcctac

SEQ ID NO: 247 - DNA, 368 bp, Zea mays
  Clone ID: LIB3060-013-Q1-K1-D6
acgagctcgatctactactactactagctggtacacatactagccagcctgccagccagcttgccgtggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaagtgtggccggcctacggcaacaagaagttcgagacgctgtcgtacctgccgacggtgtcgacggacgacctgctgaagcaggtggactacctgctgcgcaacggctggataccctgcctcgagttcagcaagctcgggttcgtgtaccgcgagaac

SEQ ID NO: 248 - DNA, 416 bp, Zea mays
  unsure (1)...(416): unsure at all n locations
  Clone ID: LIB3078-028-Q1-K1-F4
ctcctgcagaagcctcggcaacgtcagcaacggcggaaggatccggtgcatgcaggtgtggccgggctacggcaacaagaagttcgagacgctgtcgtacctgccgccgctgtcgactgacgacctgctgaagcaggtggactacctgctgcgcaacggctggataccctgcctcgagttcagcaaggtcaggcttcgtgtaccgcgagaactccacctccccgtgctactacgacggccgttactggaccatgtggaagctgcccatgttcggctgcaacgacgccacccaggtgtacaaggagctgcaggaggccatcaaatcctacccggacgccttccaccgcgtnatcggcttcgacaacatcaagcagacgcagtgcgtcagcttcatcgnctacaagcccccgggcaga

SEQ ID NO: 249 - DNA, 418 bp, Zea mays
  unsure (1)...(418): unsure at all n locations
  Clone ID: LIB3067-027-Q1-K1-A8
gctagctcgatctactactactactactagctggtacacatactagccatcctgccagccagccagcttgccatggcgcccaccgtgatgatggcctcgtcggcaaccgccgtcgccccgttccagggtctcaagtccgccgtcagcctccccgtcgcccgccgcagcaccaggagcctcggcaacgtcagcaacggcggaaggatccggtgcatgcaggtgtggccggcctacggcaacaagaagttcgagacgctgtcgtacctgccgtcgctgtcgacggacgacctgctgaagcaggtggactacctgctgcgcaacggctggataccctgcctcgagttcagcaaggctcggttcgtgtaccgcgagaaccctcacctcncgtgctactacgatggccgctactggaccatgt

SEQ ID NO: 250 - DNA, 441 bp, Zea mays
  Clone ID: LIB189-034-Q1-E1-B9
ctctcttgccgctcgcaccttacctacaaccggcgtgctccacgcgtcagccaacacgtccgcccacgcgtccgcccacgcgtccgaacacgcgtccgatcgcccgccgctccaccagaagcctcggcaacgtcagcaacggcggaaggatccggtgcatgcaggtgtggccggcctacggcaacaagaagttcgagacgcggtcgtacctgccgccgctgtctacggacgacctgctgaagcacgtggactacctgctgcgcaacggctggataccctgcctccacttcagcaaggtcggcttcgtctaccccgagaactccacctccccgtgctactaccacggccgctactggaccatgttttttttttccatgttcggctgcaacgacaccacccacgtgtacaacgagctgcacgaggccaacaaatcctaccccg

SEQ ID NO: 251 - DNA, 317 bp, Zea mays
  Clone ID: LIB189-027-Q1-E1-C2
aggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctccccgtgctactacgacggccgctactggaccatg

SEQ ID NO: 252 - DNA, 364 bp, Zea mays
  unsure (1)...(364): unsure at all n locations
  Clone ID: LIB3060-034-Q1-K1-E7
agctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgncgctgtcgacggacgacctgctgaaacaagtggactacctgctgcgcaacggctggataccctgcctcgagttcagcaagctcgggttcgtgtaccgcgagaa

SEQ ID NO: 253 - DNA, 421 bp, Zea mays
  Clone ID: LIB36-010-Q1-E1-A10
cccacgcgtccgcccacgcgtccgcccacgcgtccgcctacgcgtccgcaagcaagcaagcaagcagcgagtacatacatactaggcagccaggcagccatggcgcccaccgtgatgatggcctcgtcggccaccgccgtctctccgttcgacgggctcaagtccatcgccagcctccccgtcgcccgccgctcctccagaagcctcggcaacgtcagcatcggcggtacgatccggtgcatgcaggtgtggccggcctacggcaacaagaagttcgagacgctgtcgtacctgccgccgctgtcgacggacgacctgctgaagcacgtggactacgtgctgcgcaacggctggataccctgcctcgagttcagcaatgtcggcttcgtgtaccgcgagaactcagctccccgtgctacta

SEQ ID NO: 254 - DNA, 364 bp, Zea mays
  Clone ID: LIB3078-040-Q1-K1-E5
gctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaac

SEQ ID NO: 255 - DNA, 368 bp, Zea mays
  Clone ID: LIB3078-052-Q1-K1-H4
cacctccccgtgctactacgacggccgctactggaccatgtggaagctgcccatgtgcggctgcaacgacgccacccaggtgtacaaggagctgcaggaggccatcaaatcctacccggacgccttccaccgcgtcatcggcttcgacaacatcaagcagacgcagtgcgtcagcttcatcgcctacaagcccccgggcagcgactagaccgcgcccgccggccgccccccgccggctagctatagctcctgcgtgagctagtagctagctagtgccatgcgtcgtctctgtcgttcggttttgctttcgggtcaccgtaccctttgcttgctgggttcttccttccctttttcctttttttttcttt

SEQ ID NO: 256 - DNA, 359 bp, Zea mays
  unsure (1)...(359): unsure at all n locations
  Clone ID: LIB3078-001-Q1-K1-B1
gcgcccacgcgtccggggtctcaagtccgccgccagcgtccccgtggcccgccgcagcaccaggagcctgggcaacgtgagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtgtaccgcgagaactccacctncccgtgctactacgacggccgctactggaccatgtggaagctgcccatgttcggctgcaccgacgccacgcaagtgtacaaggagc

SEQ ID NO: 257 - DNA, 367 bp, Zea mays
  Clone ID: LIB84-017-Q1-E1-D1
cccacacgtccggctcgatctactactactactagctggcacacatactagccagcctgccagccagcttgccatggcgcccaccgtgatgatggcctcgtcggcaaccgccgtcgccccgttccagcgtctcaagtctgccgccagcctctccgtcgcccgccgcagcaccaggagcctcggcaacgtcagcaacggcggaaggatccggtgcatgcaggtgttgccggcctacagcaacaagaacttcgagacgctgtcgtgcctgccgccgctgtcgacggacgacctgctgaagcaagtgggctacctgctgcgcaacggctggatagcctgcctcgagttcagcaacctcgggttcctgtag

SEQ ID NO: 258 - DNA, 316 bp, Zea mays
  unsure (1)...(316): unsure at all n locations
  Clone ID: LIB3060-034-Q1-K1-B7
ctactagctggtacacatactagccagtctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaagtgtggccggcctacggcaacaagaagttcgagacgctgtcgtacctgccgncgctgtcgacggacgacctgctgaaacaggtggactacctgctgcgcaacggctggataccctgcctcgagt

SEQ ID NO: 259 - DNA, 368 bp, Zea mays
  unsure (1)...(368): unsure at all n locations
  Clone ID: LIB3060-028-Q1-K1-D3
caagcaagcagcgagtacatacatactaggcagccaggcagccatggcgcccaccgtgatgagtggcctggtcggccaccgccgtcgcttccgttccaggggctcaagtccaccgccagcctccccatcgcccgccgctcctccagaagcctcggcaacgtcagcaacggcggaaggatccggtgcatgcaggtgtggccggcctactgcaacaagaagttcgagacgctgtcgtacctgccgncgctgtcgacggacgacctgctgaagcangtggactacctgctgcgcaacggctggataccctgcctcgagttcagcaaggtcggcttcgtgtaccgcgagaaccttcactccccgtgctacta

SEQ ID NO: 260 - DNA, 421 bp, Zea mays
  Clone ID: LIB36-017-Q1-E1-B8
gcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaagctcgggttcgtggtacgcgagaactccacctcccgtgctactacgacggccgctactggaccatgtggaagctgccc

SEQ ID NO: 261 - DNA, 427 bp, Zea mays
  Clone ID: LIB84-008-Q1-E1-G1
cttccaccgcgtcatcggcttcgacaacatcaagcagacgcagtgcgtcagcttcatcgcctacaagcccccgggcagcgactagatcgcgcccgccggccgccccccgccggctagctagctagctagctcctgcgtgagctagtagctagtgccatgcgtcgtctctgtcgttcggttttgcttcgggtcaccgtgtaccctttgcttgcttggtttcttctttcctttgttccttttattttcatcatttccccggccatgggtcctttgctttccatcagttctctgctggatgtgatgtatccattgttgcaatcatggccttgcattggctacctctatacgtgctacatggctactgcaacgcctatatatacttggggtgaggaacatgtgaatgcaagctccggctatcatatacatg

SEQ ID NO: 262 - DNA, 420 bp, Zea mays
  unsure (1)...(420): unsure at all n locations
  Clone ID: LIB3078-027-Q1-K1-D12
cggacgcgtacggcgacacgaagttcgataccctgtcctacctggcgtcgctgccgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccacccaagtgtacaaggagctgcaagaagccatcaaatcctacccggacgccttccaccgcgtcatcggcttcgacaacatcaagcagacgcagtgcgtcagcttcatcgnctacaagccccccggcagcgactagaccgngccccgccggccgcccccggcggctagctagctagctaagctctgcgtgagct

SEQ ID NO: 263 - DNA, 428 bp, Zea mays
  Clone ID: LIB36-010-Q1-E1-E7
cccacgcgtccgcccacgcgtccggcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcacgtggactacctgctgcgcaacggctggataacctgcctcgagttcaacaagctcgggttcgtgtaccgcgaaaactccaacctccccgtgctactacgacggccgctaact

SEQ ID NO: 264 - DNA, 230 bp, Zea mays
  Clone ID: LIB3068-029-Q1-K1-F6
gcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacct

SEQ ID NO: 265 - DNA, 384 bp, Zea mays
  Clone ID: LIB3060-014-Q1-K1-D9
agctcgatctactactactactagctgttacacatactagccatcctgccaggcagcgtgccatggcgcccaccgtgatgatggcctcgtcggcaaccgccgtcgccccgttccagtgtctcaagtccgccgccagcctccccgtcgtccgccgcagcaccaggagcctcggcaacgtcagcaacggcggaaggatccggtgcatgcaggtgtggccggcctacggcaacaagaagttcgagacgctgtcgtacctgccgccgctgtcgacggacgacctgctgaagcatgtggactacctgctgcccaacggctggataccctgcctcgagtcagcatgctcgggttcgtgtaccgcgagaactccacctacccgtgctacta

SEQ ID NO: 266 - DNA, 250 bp, Zea mays
  Clone ID: LIB3060-023-Q1-K1-H3
gcaagctcgatctactactactactagctggtacacatactagccagcctgccagccagcttgcgatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaggtgtggccgggctacggcaaccagaagttcgagacgct

SEQ ID NO: 267 - DNA, 379 bp, Zea mays
  unsure (1)...(379): unsure at all n locations
  Clone ID: LIB84-023-Q1-E1-B2
ttctcctgacggtgctggcatgacgtaacngcccggggcagcgtccagcagaatcgatctacgactactactagctggtacacatactagccagcctgccaaccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaaccgcgggaggatccggtgcatgcaggtgtggccggcctacggcaacaagaagttctagacgccgtcgtacctgccggccgctgtccacgggcgaactgctgaagcaagtggactacctgctgcacaacggctgggtaccccgcct

SEQ ID NO: 268 - DNA, 235 bp, Zea mays
  Clone ID: LIB3062-015-Q1-K1-H5
agacgctgtcgtacctgccgccgctgtttacggacgacctgctgaagcaggtggactggctgctgcgcaacggctggataccctgcctcgagttcagcaaggtcggcttcgtgtaccgcgagaactgcacctacccgtgctactacgacggccgctactggaccatgtggaagctgcccatgttctgctgcaacgacgccacccacgtgtacaaggaactgcaggaggccatcaa

SEQ ID NO: 269 - DNA, 273 bp, Zea mays
  Clone ID: LIB36-013-Q1-E1-H2
gcgtgtatgctgcggcgtcggacaacatggtcgagcacgcgtccgcccacgcatccggcaagctcgatctactactactactagctggtacacatactagccagcctgccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaagtgt

SEQ ID NO: 270 - DNA, 197 bp, Zea mays
  Clone ID: LIB36-009-Q1-E1-F4
gcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggaaacgtcagcaacggcggaaggatccggtgcatgcaagtgtggccggccta

SEQ ID NO: 271 - DNA, 126 bp, Zea mays
  Clone ID: 46-LIB84-007-Q1-E1-D6
agcaggtatagaggtagccaatgcaaggccatgattgcaacaatggatacatcacatccagcagagaactgctggaaagcaaaggaaccatggccggggaaaagaagaaaaaaaaaggaaaaaagg

SEQ ID NO: 272 - DNA, 89 bp, Zea mays
  Clone ID: LIB3078-054-Q1-K1-D12
tctctgctggatgtgatgtattcattgttgcaatcatggccgggcattggcgacctctatacctgctacaaaactactgcaacgcctat

SEQ ID NO: 273 - DNA, 103 bp, Zea mays
  Clone ID: LIB36-016-Q2-E2-D1
cccaagcgtccgcagacgcgtgggccagttttctctgctggatgtgatgtatccattgttgcaagcatggccttgcattggctacctctatacctgctgctac

SEQ ID NO: 274 - DNA, 438 bp, Zea mays
  Clone ID: LIB3066-019-Q1-K1-H5
tgcccatgttcggctgcaccgacgccacgcaggtgtacaaggagctgcaggaggccatcggcgcgtacccggacgccttccaccgcgtcatcggcttcgacaacgtcaggcagacgcagtgcgtcagcttcatcgcctacaagccccccggcagcgagtagagaccgtggctagatcgaccaatggccatgtctctgcctgttgatcggatcaccttcttgcattggttcctctctctctccctccttgtttttccctttatctcatcatttctttgctactgcatgcaatggttccttttgcttccaacaattctcctgctgatgtatccagcatggcatcatccatctacaattacgtacgtagtgcaacgactgtcgattcgttgggtgaggaacatatatgtgaatgcaagctccggctaccatacatgtgtaa

SEQ ID NO: 275 - DNA, 434 bp, Zea mays
  Clone ID: LIB36-005-Q1-E1-C10
agctgcaggaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctccttttttttccctttatctcatcatttcttttctcctgcatgcaatggttccttttgcttccaacaattctcctgctgatgtatccagcatggcatcatccatctacaattacgtacgtagtgcaacgactgtcgattcgttgggtgaggaacatatatgtgaatgcaagctccggctaccatacatgtgtaatgtgtaatagatatatatacaaaactgccgaggggc

SEQ ID NO: 276 - DNA, 408 bp, Zea mays
  Clone ID: LIB84-008-Q1-E1-E11
cgacggccgctactggaccatgtggaagctgcccatgttcggctgcaccgacgccacgcaggtacaaggagctgcaggaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctccttttttttccctttatctcatcatttcttttctcctgcatgcaatggttccttttgcttccaacaattctcctgctgatgtatccagcatggcatcatccatctacaattacgtacgtagtgcaacgactgtc

SEQ ID NO: 277 - DNA, 383 bp, Zea mays
  Clone ID: LIB36-010-Q1-E1-B4
ggaagctgcccatgttcggctgcaccgacgccacgcatgtgtacaaggagctgcaggaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctccttttttttccctttatctcatcatttcttttctcctgcatgcaatggttccttttgcttccaacaattctcctgctgatgtatccagcatggcatcatccatccacaaatacgtacgtagtgcaccgac

SEQ ID NO: 278 - DNA, 347 bp, Zea mays
  Clone ID: LIB36-017-Q1-E1-D2
gaggccatcgccgcgtacccggacgccttccaccgcgtcatcggcttcgacaacgtcaggcagacgcagtgcgtcagcttcatcgcctacaagccccccggcagcgagtagagaccgtggctagatcgacccatggccatgcctctgcctgttgatcggatcaccttcttgcattggttcctctctctctctccctccttttttttccctttatctcatcatttcttttctcctgcatgcaatggttccttttgcttccaacaagtctcctgctgatgtatccagcatggcatcatccatctacaattacgtacgttgtgcaacgactgtccgattcgttgggtgag

SEQ ID NO: 279 - DNA, 273 bp, Zea mays
  Clone ID: LIB83-005-Q1-E1-B2
gtagagaccgtggctagatcgacccatggccatgcctctgcctgttgatcggatcaccttcttgcattggttcctctctctctctccctccttttttttccctttatctcatcatttcttttctcctgcatgcaatggttccttttgcttccaacaattctcctgctgatgtatccagcatggcatcatccatctacaattacgtacgtagtgcaacgactgtcgattcgttgggtgaggaacatatatgtgaatgcaagctccggctaccat

SEQ ID NO: 280 - DNA, 278 bp, Zea mays
  Clone ID: LIB36-022-Q1-E1-E3
accatcataagcagtcgactactaggtcacgtgggtcgacccaagactctacagctaagtcgtatcacctgcatgcaatggttccttttgcttccaacaattctcctgctgatgtatccagcatggcatcatccatctacaattacgtacgtagtgcaacgactgtcgattcgttgggtgaggaacatatatgtgaatgcaagctccggctaccatacatgtgtaatgtgtaatagatatatatacaaaactgccgaggcgccgacaatactttaaaa

SEQ ID NO: 281 - DNA, 208 bp, Zea mays
  Clone ID: LIB84-006-Q1-E1-B2
agcaacatgtccgtaggcgtgcctaacatctagggtccaccgacgcgtccgaaacagtaacgtacgtagtgcaacgactgtcgattcgttgggtgaggaacatatatgtgaatgcaaactccgggctacatacatgtgtaatgtgtaatacatatatatacaaaactgccgaggcgccgacaatactttaataactgggccttttaat

SEQ ID NO: 282 - DNA, 116 bp, Glycine max
  Clone ID: 700646133H1
tgtagaagaacaagtagttgagaactagacggagaagcaaatggcttcgctcaatgatctcttccccagctagatatcactgtacacagtcccggcgccagcatggttcatccctg

SEQ ID NO: 283 - DNA, 238 bp, Glycine max
  unsure (1)...(238): unsure at all n locations
  Clone ID: 700680902H1
ctcaagtccatggctggcttctgcacaatgcagaacatgaatgacattatctccatagctagcaacggtggtagagtgcaatgcttgcangtgtggccaccagttggcaagaagaagtttgagactctttcctacctgctagaccttgatgatgcacaatttgcaaacgatagtagaataccttcttaggaatggatggatccttgttagatatcattggagcacgttcgtgtacgta

SEQ ID NO: 284 - DNA, 106 bp, Glycine max
  Clone ID: 700737728H1
ctcgagccgctcgagccggtagaataccttcttaggaagggatggattccttgcttggaagtcgagttggatcacggtttcgtgtaccgtgagttcaacatgtcat

SEQ ID NO: 285 - DNA, 155 bp, Glycine max
  Clone ID: 700873832H1
gttttcggacttcaatggaaattaatggatgagaactaacacaacacaatagcttattcattagttctcatccattaatttccattgaagtccgaaaacagaaaccaaaaatacaggatgagaactaatgaataagctattgtgttgtgttaatc

SEQ ID NO: 286 - DNA, 242 bp, Glycine max
  Clone ID: 700874452H1
gcaggagaacaagtagttgataactgagaaggagaagcagatggcgtcctcagtgatctctgccccagctggtaccactgtcaaccgtgccggtgccggcatggttgcgccattcactggcctcaaatccatggctggctgccccagcagaaggaccaagaatgacgttagctccattgctagcagcggtggaagagttcaatgcatgcaggtgtggccaccagttggcagagaagaagttt

SEQ ID NO: 287 - DNA, 267 bp, Glycine max
  unsure (1)...(267): unsure at all n locations
  Clone ID: 700993404H1
gnacaagtcgtngagnactangnaggagaagcaaatngcttcctcaatgatgtcttcacccagctgttancantgncanncgtnccggtnccggcatggttgctccantcactggcctcaagtccatgcgctggcntccccancaggnanaccaacaatgacattacctcnattgctaggnacggtggaaganngcaatgcatgcanntgtggncaccagttggcaanaannagtttgagactctttcctacngccagnccttgntg

SEQ ID NO: 288 - DNA, 104 bp, Glycine max
  unsure (1)...(104): unsure at all n locations
  Clone ID: 700995052H1
gaagaacaagtagttgagnnntaaganggagaagcaaatngcttcctcaatgatgctcttccncagcngtgntcagtgtnaaccntggcggtgccggnntggtt

SEQ ID NO: 289 - DNA, 276 bp, Glycine max
  Clone ID: 701118676H1
agccgcccttttttttttttttaatccattagtccccatccattaatttccattgaagtccgaaaacagaacccaaaaataaaggatgatgaaatctcatagggcaaaaacaaatgggaatgtagtttaggtacaacaaacaaagtggggtggataaagatgctttgcaaattttccaatgacttagaaccctgggggcttttaggcaatgagcctgttgcactgaacttggcgaacgttgtaaaatccaatgatacggatgaaaccattggggta

SEQ ID NO: 290 - DNA, 368 bp, Glycine max
  Clone ID: 700661710H1
ctctacctcgttcaagatcaaacattgattcttagttgcatagcccttgtcatatctctttttttaatcaaaaccttccattcaacacttatagttgaataaaatgtctgctgcaacttttgcagctcatattgctggggctggctttgtaggcttgaagtccaactcatcaaatctttgccccagtactggatccataggatggaaaaggaagattgtttcaaatggttctaaaacttactgcatgaagacatggaatcccatcaacaataagaagtttgaaacactgtcctacctgccacccctttcagatgaatccattgcaaaggagattgactacatgctcaagaagggatggatccttgcct

SEQ ID NO: 291 - DNA, 336 bp, Glycine max
  unsure (1)...(336): unsure at all n locations
  Clone ID: 700661109H1
gttatgtctaactctacctcgttcaagatcaaacattgattcttagntgcatagcccttgtcatatctcttnntttaatcaaaaccttccattcaacacttatagttgaataaaatgtctgctgcaacttttgcagctcatattgctggggctggctttgtaggcttgaagtccaactcatcaaatctttgccccagtactggatccataggatggaaaaggaagattgtttcaaatggttctaaaacttactgcatgaagacatggaatcccatcaacaataagaagtttgaaacactgtccnacctgccacncctttcagatgaatccattgct

SEQ ID NO: 292 - DNA, 336 bp, Glycine max
  Clone ID: 700680726H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtacaagagtgcaatgcatgcaggtgtggccaccagttggcacgaagaagtttgagactctttcctacctgccagaccttgatgatgcacaattggcaaaggaagtagaataccttcttaggaagggatggattccttgcttggaatt

SEQ ID NO: 293 - DNA, 352 bp, Glycine max
  unsure (1)...(352): unsure at all n locations
  Clone ID: 700680952H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagcagaagtttgagactctttcctacctgccagaccttgatgatgcacaatttgcanaggaagtagaataccttcttaggacaggatggattcctgcttggaattcgagttggagcacggtttcgtgtacc

SEQ ID NO: 294 - DNA, 352 bp, Glycine max
  Clone ID: 700680959H1
ctaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggaccccggtttcgtgtaccgtgagcacaacag

SEQ ID NO: 295 - DNA, 335 bp, Glycine max
  Clone ID: 700763859H1
gaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggatccttgcttggaattcgagttggaggcggtttcgtgtacgtg

SEQ ID NO: 296 - DNA, 303 bp, Glycine max
  Clone ID: 700557838H1
tgcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaatacc

SEQ ID NO: 297 - DNA, 297 bp, Glycine max
  Clone ID: 700558916H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaat

SEQ ID NO: 298 - DNA, 326 bp, Glycine max
  Clone ID: 700680502H1
ctcaagtccatggctggcttcgccaccaggaagaccaacaatgacattacttccattgctagcaacggtggaagagtgcaatgcatgcaggtgtggccaccagttggcaagaagaagattgagactctttcctacctgccagaccttgatgatgtacaattggcaaaggaagtagaataccttcttggaagggatggattccttgcttggaattcgagttggagcacggtttcgtgtaccgtgagcacaacaggtcaccaggatactacgatggacgctactggaccatgtggaagctgcctataattggttgcactgatgcttct

SEQ ID NO: 299 - DNA, 293 bp, Glycine max
  unsure (1)...(293): unsure at all n locations
  Clone ID: 700556877H1
gaagaacaagtagttgaganctaagaaggagaagcaaatggcttcctcaatgatctcttccccagctgttaccactgtcaaccgtgccggtgccggcatggttgctccattcactggcctcaagtccatggctggcttccccaccaggaaaccaacaatgacattacctccattgctagcaacggtggaagagtgcaatgcatgcaggtgtggccaccagttggcaagaagaagtttgagactctttcctacctgccagaccttgatgatgcacaattggcaaaggaagtaga

SEQ ID NO: 300 - DNA, 291 bp, Glycine max
  Clone ID: 700606206H1
gtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcacaacgttcgccaagtgcagtgcatcagcttcatcgcctacaagcccccaggcttctaagtgtgaaaaatttgcaaagcatttgtagccgccaccccactttgtttgtttgtacttaaactacattcccatttgtt

SEQ ID NO: 301 - DNA, 294 bp, Glycine max
  Clone ID: 700557609H1
agaacaagtagttgagaactaagaaggagaagcaaatggcttcctcaatgatctcttccccagctgttaccactgtccaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaa

SEQ ID NO: 302 - DNA, 280 bp, Glycine max
  Clone ID: 700646293H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggca

SEQ ID NO: 303 - DNA, 293 bp, Glycine max
  unsure (1)...(293): unsure at all n locations
  Clone ID: 700557441H1
agaacaagtagttgagaactaagaaggagaagcaaatggcttcctcaatgatctcttccccagctgttaccactgtncaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtntgagactctttcctacctgccagaccttgatgatgcacaattggcaaaggaagtaga

SEQ ID NO: 304 - DNA, 295 bp, Glycine max
  Clone ID: 700646203H1
aagtagttgagaactaagaaggagaagcaaatggcttctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttcgcaagaagaagtttgagactctttcctacctgccagaccttgatgatgcacaattggcacaggaagtagaatacttctt

SEQ ID NO: 305 - DNA, 285 bp, Glycine max
  Clone ID: 700787408H2
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaa

SEQ ID NO: 306 - DNA, 285 bp, Glycine max
  unsure (1)...(385): unsure at all n locations
  Clone ID: 700605320H2
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagtnggcaagaagaagtttgagactctttcctacctgccagaccttgatgatgcacaattggcaaagg

SEQ ID NO: 307 - DNA, 288 bp, Glycine max
  unsure (1)...(288): unsure at all n locations
  Clone ID: 700563581H1
cagnagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccancaatgacattacctccattgctagcaacggtggaagagtgcaatgcatgcaggtgtggccaccagttggcaagaagaagtttgagacnctttcctacctgccagaccttgatgatgcncaattggcaaag

SEQ ID NO: 308 - DNA, 290 bp, Glycine max
  unsure (1)...(290): unsure at all n locations
  Clone ID: 700553939H1
agtagttgagaactaagaaggagaagcaaatggcttcctcaatgatctcttccccagctgttaccactgtncaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaancngtttgagactctttcctacctgccagaccttgatgatgcacaattggcaaaggaagtagaata

SEQ ID NO: 309 - DNA, 292 bp, Glycine max
  unsure (1)...(292): unsure at all n locations
  Clone ID: 701001329H1
gcagaagaacaagtagttgagaactaagaaggagaagcaaatggcttcctcaatgatctcttccccagtgttaancactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttnagactctttcctacctgccagaccttgatgatgcacaattggcaaaggaa

SEQ ID NO: 310 - DNA, 277 bp, Glycine max
  Clone ID: 700684042H1
acaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccatcaatgacattacctccattgctagcaacggtggaagagtgcaatgcatgcaggtgtggccaccagttggcaagaagaagtttgagactctttcctacctgccagaccttgatgatgcacaattggc

SEQ ID NO: 311 - DNA, 285 bp, Glycine max
  unsure (1)...(285): unsure at all n locations
  Clone ID: 700555971H1
agaacaagtagttgagaactaagaaggagaagcaaatggcttcctcaatgatctcttccccagctgttaccactgtnaaccgtgccggtgccggcatggttgctccattcactggcctcaagtccatggctggcttccccaccaggagaccaacaatgacattacctccattgctagcaacggtggaagagtgcaatgcatgcaggtgtggccaccagttggcaagaanaagtttgagactctttcctacctgccagaccttgatgatgcacaattggcaaagga

SEQ ID NO: 312 - DNA, 278 bp, Glycine max
  Clone ID: 700654101H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggagaccaacaatgacattacctccattgctagcaacggtggaagagtgcaatgcatgcaggtgtggccaccagttggcaagaagaagtttgagactctttcctacctgccagaccttgatgatgcacaattggcaaa

SEQ ID NO: 313 - DNA, 289 bp, Glycine max
  unsure (1)...(289): unsure at all n locations
  Clone ID: 700560889H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccacaggaagaccaacaatgacattacctccattgctagcaacggtggaagagtgcaatgcatgcaggtgtggccaccagttggcaagaagaagtttgagactcnttcctacctgccagaccttgatgatgcacaattggcaaagg

SEQ ID NO: 314 - DNA, 281 bp, Glycine max
  Clone ID: 700963683H1
aattggcaaaggaagtagaataccttcttaggaagggatggattccttgcttggaattcgcgttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctac

SEQ ID NO: 315 - DNA, 271 bp, Glycine max
  Clone ID: 700788007H1
agaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagccc

SEQ ID NO: 316 - DNA, 282 bp, Glycine max
  unsure (1)...(282): unsure at all n locations
  Clone ID: 700556641H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagnagtttgagactctttcctacctgccagaccttgatgatgcacaattgg

SEQ ID NO: 317 - DNA, 272 bp, Glycine max
  Clone ID: 700561084H1
aagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaag

SEQ ID NO: 318 - DNA, 284 bp, Glycine max
  unsure (1)...(284): unsure at all n locations
  Clone ID: 700555936H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaaaccaacaatgacattacctccattgctagcnncggtggaagagtgcaatgcatgcaggtgtggccaccagttggcaanaagaagtttgagactctttcctacctgccagaccttgatgatgcacaattggcaaagg

SEQ ID NO: 319 - DNA, 285 bp, Glycine max
  Clone ID: 701059184H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaa

SEQ ID NO: 320 - DNA, 275 bp, Glycine max
  Clone ID: 700739631H1
aagtagttgagaactaagaaggagaagcaaatggcttcctcaatgatctcttccccagctgttaccactgtcaaccgtgccggtgccggcatggttgctccattcactggcctcaagtccatggctggcttccccaccagagagaccaacaatgacattacctccattgctagcaacggtggcagagtgcaatgcatgcaggtgtggccaccagttggcaagaagaagtatgagactctttcgtacctgccagaccttgatgatgtcaattggca

SEQ ID NO: 321 - DNA, 279 bp, Glycine max
  Clone ID: 700683729H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagtacgcaagaagaagtttgagactctttcctacctgccagaccttgatgatgcacaattggcaaaggaagt

SEQ ID NO: 322 - DNA, 287 bp, Glycine max
  Clone ID: 700555221H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacattgcaaaggaagtagat

SEQ ID NO: 323 - DNA, 284 bp, Glycine max
  Clone ID: 700680511H1
cagaagaacaagtagttgagaacttagaaggagaagcaaatggcttcctcaatgacatcttccacatctgttaccactgtcaaccgtgcaggtgccggcatggttgctccattcactggcctcaagtccatggctggcttccccaccaggaagaccctgaatgacattacctcattgctagcaacggtggaagagtgcaatgcatgcaggtgtggccaccagttggcaagaagtagtttgagactctttcctacctgccagaccttgatgatgcacaattggca

SEQ ID NO: 324 - DNA, 276 bp, Glycine max
  Clone ID: 700684247H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagatgtttgagactctttcctacctgccagaccttgatgatgca

SEQ ID NO: 325 - DNA, 274 bp, Glycine max
  unsure (1)...(274): unsure at all n locations
  Clone ID: 700993018H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaannagtttgagactctttcctacctgccagaccttgatgatgcacaa

SEQ ID NO: 326 - DNA, 294 bp, Glycine max
  unsure (1)...(294): unsure at all n locations
  Clone ID: 700560424H1
cgaataccttctaaggnaaggatggattccttgcttggaattcgagttggagcacggtttcgtgtaccgtgagcacaacaggtcacctggatactatgatggacgctactggaccatgtggaagctgcctatgtttggctgcactgatgcttctcaggtgttgaaggagcttcaagaggctaagactgcanaccccaatggcttcatccgtatcattggatttgacaacgttcgccaagtgcagtgcatcagcttcatcgcctacaagcccccaggcttctaagtcatgaaaaa

SEQ ID NO: 327 - DNA, 285 bp, Glycine max
  Clone ID: 700558552H1
agaagaacaagtagttgagaactaagaaggagaagcaaatggcttcctcaatgatctcttccccagctgttaccactgttcaaccgtgccggtgccggcatggttgctccattcactggcctcaagtccatggctggcttccccaccaggaagaccaacatgacattacctccattgctagcaacggtggaagagtgcaatgcatgcaggtgtggccaccagttggcaagaagaagtttgagactctttcctacctgccagaccttgatgatgcacaattggcaa

SEQ ID NO: 328 - DNA, 275 bp, Glycine max
  unsure (1)...(275): unsure at all n locations
  Clone ID: 700980925H1
acaagtagttgagaactaagaaggagaagcaaatggcttcctcaatgatctcttccccagctgttaccactgtcaaccgtgccggtgccggcatggttgctccattcactggcctcaagtccatggctggcttccccacaggaagaccaacaatgacattacctccattgctagcaacggtggaagagtgcaatgcatgcnggtgtggccaccagttggcaagaagaactttgagactctttcctacctgccagaccttgatgatgcacaattgg

SEQ ID NO: 329 - DNA, 280 bp, Glycine max
  Clone ID: 700554035H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccgaaagaccaacaatgacattacctccattgctagcaacggtggaagagtgcaatgcatgcaggtgtggccaccagttggcaagaagaagtttgagactctttcctacctgccagaccttgatgatgcacattgg

SEQ ID NO: 330 - DNA, 276 bp, Glycine max
  Clone ID: 700787457H2
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaatcggtggaagagtgcaatgcatgcaggtgtggccaccagttggcaagaagaagtttgagactctttcctacctgccagaccttgatgatgcac

SEQ ID NO: 331 - DNA, 273 bp, Glycine max
  Clone ID: 701066314H1
tggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttcccaggtgttgaaggagcttcaagaggctaagactgcataccccaacggctt

SEQ ID NO: 332 - DNA, 271 bp, Glycine max
  Clone ID: 700984792H1
aacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgcgactctttcctacctgccagaccttgatgatgcac

SEQ ID NO: 333 - DNA, 267 bp, Glycine max
  Clone ID: 700993845H1
cgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaatttgcaaagcatttgta

SEQ ID NO: 334 - DNA, 282 bp, Glycine max
  Clone ID: 700553638H1
gatggattccttgcttggaattcgagttggagcacggtttcgtgtaccgtgagcacaacaggtcacctggatactatgatggacgctactggaccatgtggaagctgcctatgtttggctgcactgatgcttctcaggtgttgaaggagcttcaagaggctaagactgcataccccaatggcttcatccgtatcattggatttgacaacgttcgccaagtgcagtgcatcagcttcatcgcctacaagcccccaggcttctaagtcatgaaaaatttgcaaa

SEQ ID NO: 335 - DNA, 263 bp, Glycine max
  Clone ID: 701108568H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcac

SEQ ID NO: 336 - DNA, 266 bp, Glycine max
  Clone ID: 700730203H1
gcagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcattgcctacaagcccccaggcttctaagtgtgaaaaatttgcaaagcatttgtagccg

SEQ ID NO: 337 - DNA, 259 bp, Glycine max
  Clone ID: 700686590H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagacctt

SEQ ID NO: 338 - DNA, 264 bp, Glycine max
  Clone ID: 700684291H1
aagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaaacgtgcaatgcatgcaggtgtggccaccagttggcaagaagaagtttgagactctttcctacctgccagaccttgatgat

SEQ ID NO: 339 - DNA, 273 bp, Glycine max
  Clone ID: 700686641H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatg

SEQ ID NO: 340 - DNA, 267 bp, Glycine max
  Clone ID: 700739501H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgc

SEQ ID NO: 341 - DNA, 272 bp, Glycine max
  Clone ID: 700686672H1
aagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaatt

SEQ ID NO: 342 - DNA, 283 bp, Glycine max
  Clone ID: 701105057H1
ggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattacaacgttcgccaagtgcagtgcatcagcttcatcgcctacaagccccc

SEQ ID NO: 343 - DNA, 286 bp, Glycine max
  Clone ID: 700560247H1
ttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttc

SEQ ID NO: 344 - DNA, 277 bp, Glycine max
  Clone ID: 700685202H1
cggctcgagaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagatgaagtttgagactctttcctacctgccagaccttgatgatgcac

SEQ ID NO: 345 - DNA, 259 bp, Glycine max
  Clone ID: 700741438H1
ggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagacgctaagactgcataccccaacggcttcatccgtatcatcggattcgacaacgttcgccaagtgcagtgcatcagc

SEQ ID NO: 346 - DNA, 268 bp, Glycine max
  unsure (1)...(268): unsure at all n locations
  Clone ID: 700987146H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtntgagactctttcctacctgccagaccttga

SEQ ID NO: 347 - DNA, 264 bp, Glycine max
  Clone ID: 700874210H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagacgaagtttgagactctttcctacctgccagaccttga

SEQ ID NO: 348 - DNA, 279 bp, Glycine max
  unsure (1)...(279): unsure at all n locations
  Clone ID: 700558668H1
gcagaagaacaagtagttgagaactangangganaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccanttggcaagaagaagtttnngactctttcctacctgccagaccttgatgatgcaca

SEQ ID NO: 349 - DNA, 274 bp, Glycine max
  Clone ID: 701066793H1
ctgagaactaacaaggagaagcaaatggcttcctcaatgatctcttccccagctgttaccactgtcaaccgtgccggtgccggcatggttgctccattcactggcctcaagtccatggctggcttccccaccaggaagaccaacaatacaattacctccattgctagcaacggtggaagagtgcaatgcatgcaggtgtggccaccagttggcccgaagaagtttgagactctttcctacctgccagaccttgatgatgcacaattggcaaagg

SEQ ID NO: 350 - DNA, 265 bp, Glycine max
  Clone ID: 700897572H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcatgaagagtttgagactctttcctacctgccagacttgatgatgcacattg

SEQ ID NO: 351 - DNA, 274 bp, Glycine max
  Clone ID: 700788520H1
gaacaagtagttgagaactaagaaggagaagcaaatggcttcctcactgatctcttccccagctgttacctctgtcaaccgtgccggtgccggcatggttgctccattcactggcctcaagtccatggctggcttccccaccagaaagaccatcaatgacattacctccattgctagcaactgtggaagagtgcaatgcatgcaggtgtggccaccagttggcaagacgaagtttgagactctttcctacctgccagaccttgatgatgcacaa

SEQ ID NO: 352 - DNA, 269 bp, Glycine max
  Clone ID: 700993424H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatg

SEQ ID NO: 353 - DNA, 267 bp, Glycine max
  unsure (1)...(267): unsure at all n locations
  Clone ID: 700990285H1
gagaagcaaatggcnncctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttganactctttcctacctgncagaccttgatgatgcacaattggcaaaggaagtagaa

SEQ ID NO: 354 - DNA, 281 bp, Glycine max
  unsure (1)...(281): unsure at all n locations
  Clone ID: 700559016H1
agaagaacaagtagttgagaactaagaaggagaagcaaatggcttcctcaatgatctcttccccagctgttaccactgtcaaccgtgccggtgccggcatggttgctccattcactggcctcaagtccatggctggncttccccaccagaaagaccaacaatgacattacctccattgctagcaacggtggaagagtgcaatgcatgcaggtgtggccaccagttggcaagaagaagtttgagactctttcctacctgccagaccttgatgtgcacantgg

SEQ ID NO: 355 - DNA, 276 bp, Glycine max
  Clone ID: 700684946H1
cgttatacatcaggtcaccaggatactacgatggacgctactggaccatgttcaagctgcctatgtttggttgcactgatgcttctcaggtgttgaaggagcttcaagaggctaagactgcatatcccaacggcttcatccgtatcatcggattcgacaacgttcgccaagtgcagtgctcagcttcatcgcctacaagcccccaggcttctaagtgtgaaaaatttgcaaagcatttgtagccgccatcccactttgtttgtttgtacttaaact

SEQ ID NO: 356 - DNA, 271 bp, Glycine max
  Clone ID: 700994454H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagccaacggtggaagagtgcaatgcatgcaggtgtggccaccagttggcaagaagaagtttgagactctttcctacctgccagaccttgatgatgc

SEQ ID NO: 357 - DNA, 278 bp, Glycine max
  Clone ID: 700684022H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtctgagactctttcctacctgccagaccttgatgatgcac

SEQ ID NO: 358 - DNA, 280 bp, Glycine max
  unsure (1)...(280): unsure at all n locations
  Clone ID: 700981572H1
gttgagaactaagaaggagaagcaaatggcttcctcaatgatctcttccccagctgttaccactgtcnaacgtgnccggtggccggcatggttgctccattcactggcctcaagtccatggctggcttccccaccagaaagaccaacaatgacattacctccattgctagcaacggtggaagagtgcaatgcatgcaggtgtggccaccagttggcaagcagaagtttgagactctttcctacctgccagaccttgatgatgcacaattggcaaaggaag

SEQ ID NO: 359 - DNA, 277 bp, Glycine max
  unsure (1)...(277): unsure at all n locations
  Clone ID: 700547916H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattanctccattgctagcaacggtggaagagtgcnatgcatgcaggtgtgggccaccagttggcaagaagaagtttgagactcnttcctacctgccagaccttgatgatgcacatt

SEQ ID NO: 360 - DNA, 291 bp, Glycine max
  Clone ID: 701210426H1
gtagttgagaactaagaaggagaagcaactggcttcctcaatgatctctcccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaacaagaagtttgagactctttcctacctgccagaccttgatgatgcacaattggcaaaggaagtagaatacct

SEQ ID NO: 361 - DNA, 308 bp, Glycine max
  Clone ID: 700680983H1
gaagaacaagtagttgagaactaagaaggagaagcatttggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggccagaagacgtttgagactctttcctacctgccagaccttgatgatgcacaattcgtcaatgaagtagaatacttcttaggaa

SEQ ID NO: 362 - DNA, 288 bp, Glycine max
  Clone ID: 700686304H1
cagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaa

SEQ ID NO: 363 - DNA, 267 bp, Glycine max
  unsure (1)...(267): unsure at all n locations
  Clone ID: 700656925H1
ctttcctacctgccagaccttgatgatgcacaattggcaaaggangtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggctttcatccgtatcatcgg

SEQ ID NO: 364 - DNA, 261 bp, Glycine max
  Clone ID: 700959008H1
aacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagacgaagtttgagactctttcctacctgccagacctt

SEQ ID NO: 365 - DNA, 262 bp, Glycine max
  Clone ID: 700990104H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagacgaagtttgagactctttcctacctgccagacctt

SEQ ID NO: 366 - DNA, 276 bp, Glycine max
  Clone ID: 700733702H1
ttcggctcgagagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagacct

SEQ ID NO: 367 - DNA, 272 bp, Glycine max
  Clone ID: 700679911H2
agaagaacaagtagttgagaactaagaaggagaagcaaatggcttcctcaatgatctcttctccagctgttaccactgtcaaccgtgccggtgccggcatggttgctccattcactggcctcagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatg

SEQ ID NO: 368 - DNA, 262 bp, Glycine max
  Clone ID: 700683580H1
caatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctg

SEQ ID NO: 369 - DNA, 266 bp, Glycine max
  unsure (1)...(266): unsure at all n locations
  Clone ID: 701000694H1
gttgagaactaagaaggagaagcaaatggcttcctcaatgatctcttccccagctgttaccactgtccaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagnagaantttgagactctttcctacctgccagaccttgatgatgcacaa

SEQ ID NO: 370 - DNA, 267 bp, Glycine max
  Clone ID: 700788434H1
gagggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacttaaactacattcccatttgtttttgctttttgagatttcatcatcctgtatttttggtttctgttttcggacttcaatggaaattaatgg

SEQ ID NO: 371 - DNA, 274 bp, Glycine max
  Clone ID: 700977489H1
gcagaagaacaagtagttgagaactaagaaggagaagcaaatggcttcctccaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatga

SEQ ID NO: 372 - DNA, 287 bp, Glycine max
  Clone ID: 700646244H1
ttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgactgcaggtgtggccaccaattggcaagaagaagttcgagactctttcctacttgccagacctcgatgatgcccaattggcaaaggaagtcgaataccttct

SEQ ID NO: 373 - DNA, 266 bp, Glycine max
  Clone ID: 700789239H2
cggctcgaggaacaagtagttgagaactaagaaggagaagcaaatggcttcctcaatgatctcttccccagctgttaccactgtcaaccgtgccggtgccggcatggttgctccattcactggcctcaagtccatgctggcttccccaccaggaagaccaacaatgacattacctccattgctagcaacggtggaagagtgcaatgcatgcaggtgtggccaccagttggcaagaagaagtttgagactctttcctacctgccaga

SEQ ID NO: 374 - DNA, 261 bp, Glycine max
  Clone ID: 700941416H1
aagtagttgagagctaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgat

SEQ ID NO: 375 - DNA, 259 bp, Glycine max
  Clone ID: 700741114H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagcgtttgagactctttcctactgcca

SEQ ID NO: 376 - DNA, 256 bp, Glycine max
  Clone ID: 700787710H2
tacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcct

SEQ ID NO: 377 - DNA, 261 bp, Glycine max
  Clone ID: 700738915H1
cgaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccacttggcaagaagaagtttgagactctttcctacctgccagacc

SEQ ID NO: 378 - DNA, 265 bp, Glycine max
  Clone ID: 700681172H2
ctttcctacctgccagaccttgatgatgcacaattggcaaaggaagtagaataccttcttaggaagggatggattccttgcttggaattcgagttggagcacggtttcgcgtaccgtgagcacaacaggtcaccaggatactacgatggacgctactggaccatgtggaagctgcctatgtgtggttacactgatgcttctcaggtgttgaaggagcttcacgaggctaagactgcataccccaacggcttcatccgtatcatcg

SEQ ID NO: 379 - DNA, 258 bp, Glycine max
  unsure (1)...(258): unsure at all n locations
  Clone ID: 700989627H1
cttgcttggaattcgagttggagcacggtttcgtgtaccgtgancacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgt

SEQ ID NO: 380 - DNA, 278 bp, Glycine max
  unsure (1)...(278): unsure at all n locations
  Clone ID: 700992304H1
caagtagttgagaactaagaaggagaagcaaatgggcttcctcaatgatctcttccccagctgttaccactgtcaaccgtgccggtgccggcatggttgctccattcactggcctcaagtccatgggctggcttccccaccaggaagaccaacaatgacattacctccattgctagcaacggtggaagantgcaatgnatncaggtgtggcnaccagttggcaagangaagtttgagactctttcctacctgccagacttgatgatgcacaattggca

SEQ ID NO: 381 - DNA, 269 bp, Glycine max
  Clone ID: 700660092H1
ggattccttgcttggaattcgagttggagcacggtttcgtgtaccgtgagcacagacaggtcaccaggatactacgatggacgctactggaccatgtggaagctgcctatgtttggttgcactgatgcttctcaggtgtgaaggagcttcaagaggctaagactgcataccccaacggcttcatccgtatcatcggattcgacaacgttcgccaagtgcagtgcatcagcttcatcgcctacaagcccccaggcttctaagtgtgaaaa

SEQ ID NO: 382 - DNA, 262 bp, Glycine max
  Clone ID: 700742022H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccacaggaagaccaacaatgacattacctccattgctagcaacggtggaagagtgcaatgcatgcaggtgtggccaccagttggctagaagaagtttgagactctttcctacctgccagacctt

SEQ ID NO: 383 - DNA, 258 bp, Glycine max
  Clone ID: 700787646H2
agaataccttcttaggaagggatggattccttgcttggaattcgagttggagcacggtttcgtgtaccgtgagcacaacaggtcaccaggatactacgatggacgctactgaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatc

SEQ ID NO: 384 - DNA, 260 bp, Glycine max
  Clone ID: 700686569H1
gtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttcgcaagaagaagtttgagactctttcctacctgccagaccttgatg

SEQ ID NO: 385 - DNA, 264 bp, Glycine max
  Clone ID: 701107113H1
agtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaataagaagtttgagactctttcctacctgccagaccttgatgatg

SEQ ID NO: 386 - DNA, 286 bp, Glycine max
  unsure (1)...(286): unsure at all n locations
  Clone ID: 700553876H1
cagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaatnggcaagaagaagttcgagactctttcctacttgccagacctcgatgatgcccaattggcaaagg

SEQ ID NO: 387 - DNA, 281 bp, Glycine max
  Clone ID: 701106749H1
caagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaactgtggccaccaattggcaagaagaagttcgagactctttcctacttgccagacctcgatgatgcccaattggcaaaggaag

SEQ ID NO: 388 - DNA, 271 bp, Glycine max
  unsure (1)...(271): unsure at all n locations
  Clone ID: 700660208H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagangtttgagactcttttctactgccagaccttgatgat

SEQ ID NO: 389 - DNA, 260 bp, Glycine max
  Clone ID: 700738445H1
gttccattcactggcctcaagtccatggctggcttccccaccagaaagcccaacaatgacattacctccattgctagcaacggtggaagagtgcaatgcatgcgcgtgtggccaccagttggcaagaagaagtttgagactctttcctacctgccagaccttgatgatgcacaattggcaaaggaagtagaataccttcttaggaagggatggattccttgcttggaattcgagttggagcgaggtttcgtgtaccgtga

SEQ ID NO: 390 - DNA, 253 bp, Glycine max
  Clone ID: 700873776H1
gcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttc

SEQ ID NO: 391 - DNA, 253 bp, Glycine max
  Clone ID: 700684414H1
gcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcgtctaagt

SEQ ID NO: 392 - DNA, 261 bp, Glycine max
  Clone ID: 700790868H1
gttgagaactaagaaggagaagcaaatggcttcctcaatgatctcttccccagctgttaccactgtcaaccgtgccggtgccggcatggttgctccactcactggcctcaagtccatggctggcttccccaccagaaagaccaacaatgacattacctccattgctagcaacggtggaagagtgcaatgcatgcaggtgtggccaccaattggcaagaagaagtttgagactctttcctacctgccagaccttgatgatgc

SEQ ID NO: 393 - DNA, 249 bp, Glycine max
  Clone ID: 700787726H2
cgtgacacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgcca

SEQ ID NO: 394 - DNA, 268 bp, Glycine max
  Clone ID: 700899186H1
aacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatg

SEQ ID NO: 395 - DNA, 257 bp, Glycine max
  Clone ID: 700726442H1
ggcaaaggaagtagaataccttcttaggaagggatggattccttgcttggaattcgagttggagcacggtttcgtgtaccgtgagcacaacaggtcaccaggatactacgatggacgctactggaccatgtggagctgcctatgtttggttgcactgatgcttctcaggtgttgaaggagcttcaagaggctaagactgcataccccaacggcttcatccgtatcatcggattcgacaacgttcgccaagtgcagtg

SEQ ID NO: 396 - DNA, 258 bp, Glycine max
  Clone ID: 700681422H2
ggaagagtgcaatgcatgcaggtgtggccaccagttggcaagaagaagtttgagactctatcctacctgccagaccttgatgatgcacaattggcaaaggaagtagaataccttcttaggaagggatggattccttcttggaattcgagttggagcacggtttcgtgtaccgtgagcacaacaggtcaccaggatactacgatggacgctactggaccatgtggaagctgcctatgtttggttgcactgatgcttctc

SEQ ID NO: 397 - DNA, 269 bp, Glycine max
  Clone ID: 700901301H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcagaagaagtttgagactctttcctacctgccagaccttgatgatgc

SEQ ID NO: 398 - DNA, 257 bp, Glycine max
  Clone ID: 701214546H1
aacaagtagttgagaactaagacggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccaga

SEQ ID NO: 399 - DNA, 259 bp, Glycine max
  Clone ID: 701211571H1
gttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgat

SEQ ID NO: 400 - DNA, 283 bp, Glycine max
  Clone ID: 701067621H1
aaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaacaagttcgagactctttcctacttgccagacctcgatgatgcccaattggcaaaggaa

SEQ ID NO: 401 - DNA, 259 bp, Glycine max
  Clone ID: 700656975H1
ggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcaggtttcgtgtaccgtgagcacaacaggtc

SEQ ID NO: 402 - DNA, 273 bp, Glycine max
  Clone ID: 700679981H2
gaggcagaagaacaagtagttgagcattaagaaggagaagcaaatggcttcctcaatgatctcttctccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttga

SEQ ID NO: 403 - DNA, 261 bp, Glycine max
  Clone ID: 700788456H1
gaagaacaagtagttgagcactaagaaggagaagcaaatggcttcctcaatgatctcttccccagctgctaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccaga

SEQ ID NO: 404 - DNA, 263 bp, Glycine max
  unsure (1)...(263): unsure at all n locations
  Clone ID: 700993650H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaganngaccaacaatgacattacctccattgctagcaacggtggaagagtgcaatgcatgcaggtgtggccaccagttggcaagacgaagtttgagactctttcctacctgccagacc

SEQ ID NO: 405 - DNA, 251 bp, Glycine max
  Clone ID: 700738760H1
tggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactg

SEQ ID NO: 406 - DNA, 269 bp, Glycine max
  Clone ID: 700738920H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggccagaagaagtttgagactctttcctacctgccaatatgtgc

SEQ ID NO: 407 - DNA, 280 bp, Glycine max
  unsure (1)...(280): unsure at all n locations
  Clone ID: 700992293H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttganactctttcctanctgccagacttgatgatgcaacatt

SEQ ID NO: 408 - DNA, 250 bp, Glycine max
  Clone ID: 700849079H1
gttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttacactgctgcttctcaggtgttgaaggagcttcaagagg

SEQ ID NO: 409 - DNA, 262 bp, Glycine max
  Clone ID: 700683157H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagttacagactctttcctacctgcca

SEQ ID NO: 410 - DNA, 249 bp, Glycine max
  Clone ID: 700874075H1
gcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaac

SEQ ID NO: 411 - DNA, 280 bp, Glycine max
  unsure (1)...(280): unsure at all n locations
  Clone ID: 700988186H1
gaacaagtagttgagaactaagaaggagaagcaaatggcttcctcaatgatctcttccccagctgttaccacngtcaaccgtgccggtgccggcatggttgctccattcactggcctcaagtccatgggctggcttccccaccagaaagaccaacaatgacattacctccattgctagcaacggtggaagagtgcaatgcatgcaggtgtgggccaccagttggcaagaagaagtttgagcactcttcctanctgccagaccttgatgatgcacaattgg

SEQ ID NO: 412 - DNA, 256 bp, Glycine max
  Clone ID: 700899275H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagacgtttgagactctttcctacctgccagac

SEQ ID NO: 413 - DNA, 263 bp, Glycine max
  Clone ID: 700943511H1
caagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaaggtgaagtttgagactctttcctacctgccagaccttgatg

SEQ ID NO: 414 - DNA, 289 bp, Glycine max
  Clone ID: 701062407H1
atccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagttggagcacggttcgtgtaccgtgagcacaacaggtcacctggatactatgatggacgctactggaccatgtgga

SEQ ID NO: 415 - DNA, 262 bp, Glycine max
  unsure (1)...(262): unsure at all n locations
  Clone ID: 700991032H1
gtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttgnccaagaagaagtttgagactctttcctacctgccagacnttgatga

SEQ ID NO: 416 - DNA, 253 bp, Glycine max
  Clone ID: 700740521H1
aggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacttaaactacattcccatttgtttttgctttttgagatttcatcatcctgtatttttggtttctgttttcggacttcaat

SEQ ID NO: 417 - DNA, 276 bp, Glycine max
  Clone ID: 700685255H1
gtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaagga

SEQ ID NO: 418 - DNA, 251 bp, Glycine max
  Clone ID: 700846540H1
gctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacttaaactacattcccatttgttttgctttttgagat

SEQ ID NO: 419 - DNA, 254 bp, Glycine max
  Clone ID: 700684186H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgc

SEQ ID NO: 420 - DNA, 266 bp, Glycine max
  unsure (1)...(266): unsure at all n locations
  Clone ID: 700565092H1
cagaagaacaagtagttgagaactaagaaggagaagcaaatggnttcctcaatgatctcttccccngctgttaccactgtnaaccgtgccggtgccggcatggttgctccattcactggcctcaagtccatggcttgcttccccnccaggaagaccaacaatgacattacctccattgctagcaacggtggaagagtgcaatncatgcaggtgtggccaccagttggcaagaagaagtttganactctttcctacctgccagacct

SEQ ID NO: 421 - DNA, 248 bp, Glycine max
  Clone ID: 700898668H1
ttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccaga

SEQ ID NO: 422 - DNA, 249 bp, Glycine max
  Clone ID: 700997221H1
cggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaa

SEQ ID NO: 423 - DNA, 249 bp, Glycine max
  Clone ID: 700737823H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttccta

SEQ ID NO: 424 - DNA, 255 bp, Glycine max
  Clone ID: 700740566H1
gaagaacaagtagttgagatctaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagttcgagactctttcctacct

SEQ ID NO: 425 - DNA, 258 bp, Glycine max
  Clone ID: 700726057H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagtagaagtttgagactctttcctacct

SEQ ID NO: 426 - DNA, 250 bp, Glycine max
  unsure (1)...(250): unsure at all n locations
  Clone ID: 700658843H1
cgagttggagcacggtttcgtgtaccgtgagcacaacaggtcaccaggatactacgatggacgctactggaccatgtggaagctgcctatgtttggntgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaa

SEQ ID NO: 427 - DNA, 273 bp, Glycine max
  Clone ID: 700737902H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgaaatgcatgcaggtgtggccaccagttggcaagaagaagtctgagactctctcctacctgccagaccttgatga

SEQ ID NO: 428 - DNA, 247 bp, Glycine max
  Clone ID: 700873809H1
ggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacttaaactac

SEQ ID NO: 429 - DNA, 263 bp, Glycine max
  Clone ID: 701210184H1
gttgagaactaagaaggagaagcaaatggcttcctcaatgatctcttccccagctgttaccactgtcaaccgtgccggtgccggcatggttgctccattcactggcctcaagtccatggctggcttccccaccaggatgaccaacaatgacattacctccattgctagcaacggtggaagagtgcaatgcatgcaggtgtggccaccagttggcaagaagaagtttgagactctttcctacctgccagaccttgatgatgcac

SEQ ID NO: 430 - DNA, 259 bp, Glycine max
  Clone ID: 700874925H1
ggacgctactggaccatgtggaagctgcctatgtttggttgcactgatgcttctcaggtgttgaaggagcttcaagaggctaagactgcataccccaacggcttcatccgtatcatcggattcgacaacgttcgcaagtgcagtgcatcagcttcatcgcctacaagcccccaggcttctaagtgtgaaaaatttgcaaagcatttgtagccgccaccccactttgtttgtttgtacttaaactacattcccatttgtt

SEQ ID NO: 431 - DNA, 257 bp, Glycine max
  Clone ID: 700686258H1
gaacaagtagttgagaactaagaaggagaagcaaatggcttcctcaatgatctcttccccagctgttaccactgtcaaccgtgccggtgccggcatggttgctccattcactggcctcaagtccatggctggttccccaccagaaagaccaacaatgacattacctccattgctagcaacggtggaagagtgcaatgcatgcaggtgtggccaccagttggcaagaagaagtttgagactctttcctacctgccaga

SEQ ID NO: 432 - DNA, 260 bp, Glycine max
  Clone ID: 700742042H1
caagtagttgagaactaagaaggagaagcaaatggcttcctcaatgatctcttccccagctgttaccactgtcaaccgtgccggtgccggcacagttgctccattcactggcctcaagtccatggctggcttcccatcagaaagaccaacaatgacattacctccattgctagcaacggtggaagagtgcaatgcatgcaggtgtggccaccagttggcaagaagaagtttgagactctttcctacctgccagaccttga

SEQ ID NO: 433 - DNA, 275 bp, Glycine max
  Clone ID: 700679995H2
agaagaacaagtagttgagaactaagaaggagaagcatatggcttcctccatgatctcttccccagctgctaacactgtcaaccgtgccggtgccggcatggttgctccattcactggcctcagtccatggctggcttccccaccaggaagaccaacaatgacattacctccattgctagcaacggtggaagagtgcaatgcatgcaggtgtggccaccagttggcaagaagaagtttgagactctttcctacctgccaggcttcgatgatgcac

SEQ ID NO: 434 - DNA, 268 bp, Glycine max
  Clone ID: 700682014H1
cagaagaacaagtagttgagaactaagaaggagaagcaaatggcttcctgaatgatctcttccccagctgttaccactgtcaaccgtgccggtgccggcatgcggtgctccattcactggcctcaagtccatggctggcttccccaccagaaagaccaacaatgacatcgcctccattgctagcaacggtggaagagtgcaatgcatgcaggtgtggccaccagttggcaagaagaagtttgagactctttcctacctgccagacctt

SEQ ID NO: 435 - DNA, 258 bp, Glycine max
  Clone ID: 700741910H1
tcgagcaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcacgaagaagtttgagactctttcctacctgcca

SEQ ID NO: 436 - DNA, 258 bp, Glycine max
  Clone ID: 701107208H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcacgaagaagtttgagactctttcctacctgccaga

SEQ ID NO: 437 - DNA, 258 bp, Glycine max
  Clone ID: 700896405H1
agtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcacgaagaagtttgagactctttcctacctgccagaccttg

SEQ ID NO: 438 - DNA, 268 bp, Glycine max
  Clone ID: 700961649H1
gttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttgggcaacaagaagtttgagactctttcctacctgccagaccttgatgatgcacaatt

SEQ ID NO: 439 - DNA, 281 bp, Glycine max
  unsure (1)...(281): unsure at all n locations
  Clone ID: 700555260H1
aagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaatttgagactcttcctacctggccagaccttgatgatgccantgggcaaaggaag

SEQ ID NO: 440 - DNA, 282 bp, Glycine max
  unsure (1)...(282): unsure at all n locations
  Clone ID: 700646292H1
agataaacaagtagttgagaactaagaagaaggaaatggcttcctcaatgatctcctccccagctgttaccaccgtcaaccgtgccggtgccggcatggttgctccattcaccggcctcaacaccatggctggcttccccacgaggaagaccaacaatgacattacctccattgctagcaacggtggaagagtacaatgcatgcaggtgtgngccagcaattggcaagaagaagttcgagaatctttcctacttgccagacctcgatgatgcccaattggca

SEQ ID NO: 441 - DNA, 258 bp, Glycine max
  Clone ID: 700896794H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccaga

SEQ ID NO: 442 - DNA, 259 bp, Glycine max
  Clone ID: 700900448H1
cgtgacacaacaggtcaccaggatactacgatggacgctactggaccatgtggaagctgcctatgtttggttgcactgatgcttctcaggtgttgaaggagcttcaggaggctaagactgcataccccaacggcttcatccgtatcatcggattcgacaacgttcgccaagtgcagtgcatcagcttcatcgcctacaagcccccaggcttctaagtgtgagaaatttgcaaagcatttgtagccgcgaccccactttg

SEQ ID NO: 443 - DNA, 267 bp, Glycine max
  unsure (1)...(267): unsure at all n locations
  Clone ID: 700978796H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagacnctttcctactgccagacttgat

SEQ ID NO: 444 - DNA, 248 bp, Glycine max
  Clone ID: 700874579H1
caagtagttgagaactaagaaggagaagcaaatggcttcctcaatgatctcttccccagctgttaccactgtcaaccgtgccggtgccggcatggttgctccattcactggcctcaagtccatggctgcttccccaccagaaagaccaacaatgacattacctccattgctagcaacggtggaagagtgcaatgcatgcaggtgtggccaccagttggcaagatgaagtttgagactctttcctacct

SEQ ID NO: 445 - DNA, 255 bp, Glycine max
  unsure (1)...(255): unsure at all n locations
  Clone ID: 700989693H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagnagtttgagactctttcctacct

SEQ ID NO: 446 - DNA, 257 bp, Glycine max
  Clone ID: 700872477H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagttactgactctttcctacctgc

SEQ ID NO: 447 - DNA, 246 bp, Glycine max
  Clone ID: 700873947H1
aagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctac

SEQ ID NO: 448 - DNA, 250 bp, Glycine max
  Clone ID: 700740463H1
ttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttgtcaagaagaagtttgagactctttcctacctgccagacc

SEQ ID NO: 449 - DNA, 247 bp, Glycine max
  Clone ID: 700846439H1
gctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacttaaactacattcccatttgtttttgcttttt

SEQ ID NO: 450 - DNA, 247 bp, Glycine max
  Clone ID: 701143505H2
ggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagagg

SEQ ID NO: 451 - DNA, 249 bp, Glycine max
  Clone ID: 700876930H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccatcaatgacattacctccattgctagcaacggtggaagagtgcaatgcatgcaggtgtggccagcagttggcaagaagaagtttgagactctttcctacctgccaga

SEQ ID NO: 452 - DNA, 264 bp, Glycine max
  Clone ID: 700787131H2
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccatgctagcatcggtggaagagtgcaatgcatgcaggtgtggccaccagttggcaagaagaagtttgagactctttcctacctgccagacctt

SEQ ID NO: 453 - DNA, 255 bp, Glycine max
  Clone ID: 701107174H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccaga

SEQ ID NO: 454 - DNA, 256 bp, Glycine max
  Clone ID: 700683318H1
gtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttgacaagaagaagtttgagactctttcctacctgccagacctt

SEQ ID NO: 455 - DNA, 253 bp, Glycine max
  Clone ID: 700738122H1
gttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagatggcaagaagaagtttgagactctttcctacctgccagacctt

SEQ ID NO: 456 - DNA, 260 bp, Glycine max
  Clone ID: 700683238H1
gttgagaactaagaaggagaagcaatagccttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatg

SEQ ID NO: 457 - DNA, 247 bp, Glycine max
  Clone ID: 700741164H1
ggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgca

SEQ ID NO: 458 - DNA, 255 bp, Glycine max
  Clone ID: 700896476H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgcc

SEQ ID NO: 459 - DNA, 278 bp, Glycine max
  unsure (1)...(278): unsure at all n locations
  Clone ID: 700993971H1
gaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccnattggcaagaagaagntcgagactctttcctacttgccagacctcgatgatgcccaattgg

SEQ ID NO: 460 - DNA, 264 bp, Glycine max
  Clone ID: 700895401H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccaga

SEQ ID NO: 461 - DNA, 255 bp, Glycine max
  Clone ID: 700790223H2
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagacggcaatgcatgcaggtgtggccaccagttggcaagaagaagtttgagactctttcctacct

SEQ ID NO: 462 - DNA, 240 bp, Glycine max
  Clone ID: 700945189H1
aattggcaaaggaagtagaataccttcttaggaagggatggattccttgcttggaattcgagttggagcacggtttcgtgtaccgtgagcacaacaggtcaccaggatactacgatggacgtactggaccatgtggaagctgcctatgtttggttgcactgatgcttctcaggtgttgaaggagcttcaagaggctaagactgcataccccaacggcttcatccgtatcatcggattcga

SEQ ID NO: 463 - DNA, 246 bp, Glycine max
  Clone ID: 700741390H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttc

SEQ ID NO: 464 - DNA, 254 bp, Glycine max
  Clone ID: 700737811H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaactttgagactctttcctac

SEQ ID NO: 465 - DNA, 254 bp, Glycine max
  Clone ID: 700785969H2
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctac

SEQ ID NO: 466 - DNA, 246 bp, Glycine max; identical to SEQ ID NO: 463
  Clone ID: 700740478H1

SEQ ID NO: 467 - DNA, 244 bp, Glycine max
  Clone ID: 700790742H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagagtttgagactcttt

SEQ ID NO: 468 - DNA, 248 bp, Glycine max
  Clone ID: 700740462H1
gtagttgagaactaagaaggagaagcaaatggcttcctcaatgatctcttccccagctgttaccactgtcaaccgtgccggtgccggcatggttgctccattcactggcctcaagtccatggctggcttccccacagaaagaccaacaatgacattacctccattgctagcaacggtggaagagtgcaatgcatgcaggtgtggccaccagttggcaatcagaagtttgagactctttcctacctgcc

SEQ ID NO: 469 - DNA, 248 bp, Glycine max
  unsure (1)...(248): unsure at all n locations
  Clone ID: 700657760H1
aagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagnagaagtttgagactctttcctacct

SEQ ID NO: 470 - DNA, 258 bp, Glycine max
  unsure (1)...(258): unsure at all n locations
  Clone ID: 700659336H1
cttccccaccaganagaccaacaatgacattacntccattgctagnaacggtggaagagtgcaatgcatgcaggtgtggccaccagttggnaagaagaagtttgagactctttcctancngccanaccttgatgatgcacaattggcaaaggaagtagaataccttcttaggaagggatggattccttgcttggaattcgagttggagcacggtttcgtgtaccgtgagcacaacaggtcaccnggatactacgatgg

SEQ ID NO: 471 - DNA, 257 bp, Glycine max
  Clone ID: 700790904H1
gaacaagtagttgagaactaagaaggagaagcaaatggcttcctcaatgatctattccccagctgttaccactgtcaaccgtgccggtgccggcatggttgctccattcactggcctcaagtccatggctggcttcccaccaggaagaccaacaatgacattacctccattgctagcaacggtggaagagtgcaatgcatgcaggtgtggccaccagttggcaagaagaagtttgagactctttcctacctgccaga

SEQ ID NO: 472 - DNA, 267 bp, Glycine max
  Clone ID: 700738911H1
gaacaagtagttgagaactaagaaggagaagcaaatggcttcctcaatgatctcttcaccagctgttaccactgtcaaccgtgccggtgccggcatggttgctccattcactggcctcaagtccatggctggcttccccaccagaaagaccaagaatgacattacctccattgctagcaacggtggaagagtgcaatgcatgcaggtgtggccaccagttggcaagaagaagtttgagactctttcctacctgccaatgatgatgca

SEQ ID NO: 473 - DNA, 251 bp, Glycine max
  Clone ID: 700872532H1
aagtagttgagaactaagaaggagaagcaaatggcttcctcaatgatctcttccccagctgttaccactgtcaaccgtgccggtgccggcatggttgctccatcactggcgtcaagtccatggctggcttccccaccaggaagaccaacaatgacattacctccattgctagcaacggtggaagagtgcaatgcatgcaggtgtggccaccagatggcaagaagaagtttgagactctttcctacctgcca

SEQ ID NO: 474 - DNA, 258 bp, Glycine max
  Clone ID: 700967765H1
gtagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagacgtttgagactctttcctacctgcc

SEQ ID NO: 475 - DNA, 250 bp, Glycine max
  Clone ID: 700876909H1
gttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagac

SEQ ID NO: 476 - DNA, 255 bp, Glycine max
  unsure (1)...(255): unsure at all n locations
  Clone ID: 700989032H1
gtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgaggtgtggccaccagttggcaanaagaagtttgagactctttcctacctgccagacctg

SEQ ID NO: 477 - DNA, 273 bp, Glycine max
  Clone ID: 700872401H1
cggctcgaggaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagacct

SEQ ID NO: 478 - DNA, 276 bp, Glycine max
  Clone ID: 701104761H1
aaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtgcccaccaattggcaagcagaagttcgagactctttcctacttgccagacctcgatgatgcccaattgg

SEQ ID NO: 479 - DNA, 280 bp, Glycine max
  Clone ID: 700787439H2
agaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcacgcaggtgtggccaacaattggcaagaagaagttcgagactctttcctacttgccagacctcgatgatgcccaattggc

SEQ ID NO: 480 - DNA, 274 bp, Glycine max
  Clone ID: 700682703H1
agaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgagtaagaccaacaatgacattacctccattgctagcaacggtggaagagtacaatgcatgcaggtgtggacaccaattggcaagaagaagttcgagactctttcctacttgccagagctcgatgatgccca

SEQ ID NO: 481 - DNA, 270 bp, Glycine max
  Clone ID: 700788179H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagttagagactctttcctacctgccagaccttgatgatg

SEQ ID NO: 482 - DNA, 273 bp, Glycine max
  Clone ID: 700724905H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaaaaagtttgagactctttcctacctgccagacttgatgatgc

SEQ ID NO: 483 - DNA, 247 bp, Glycine max
  unsure (1)...(247): unsure at all n locations
  Clone ID: 700660182H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagacnaacaatgacattacctccattgctagcaacggtggaagagtgcaatgcatgcaggtgtggccaccagttggcaagaagaagtttgagactctttc

SEQ ID NO: 484 - DNA, 249 bp, Glycine max
  Clone ID: 700876415H1
agaagaacaagtagttgagaactaagaaggagaagcaaatggcttcctcaatgatctcttccccagctgttaccactgtcaaccgtgccggtgccggcatggttgcccattcactggcctcaagtccatggctggcttccccaccaggaagaccaacaatgacattacctccattgctagcaacggtggaagagtgcaatgcatgcaggtgtggccaccagttggcaagaagaagtttgagactctttc

SEQ ID NO: 485 - DNA, 242 bp, Glycine max
  Clone ID: 700738544H1
gtacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagatgaagtttgagactc

SEQ ID NO: 486 - DNA, 243 bp, Glycine max
  Clone ID: 700894558H1
caagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagttgagactctttcc

SEQ ID NO: 487 - DNA, 270 bp, Glycine max
  Clone ID: 700740901H1
aacaagtagttgagaactaagaaggagaagcaaatggcttcctcaatgatctcttccccagctgttaccactgtcaaccgtgccggtgccggcatggttgctccattcactggcctcaagtccatggctggcttccccaccaggagaccaacaatgacattacctccattgctagcaacggtggaagagtgcaatgcatgcaggtgtggccaccagttggcaagacgaagtttgagactctttcctacctgccagaccttgatgatgcac

SEQ ID NO: 488 - DNA, 255 bp, Glycine max
  Clone ID: 700683039H1
gtggaagagtgcaatgcatgcaggtgtggccaccagttggcaagaagaagtttgagactctttcctacctgccagaccttgatgatgcacaattggcaaaggaagtagaataccttcttaggaagggatggttccttgcttggacttcgagttggagcacggtttcgtgtaccgtgagcacaacaggtcaccaggatactacgatggacgctactggaccatgtggaagctgcctatgtttggttgcactgatgc

SEQ ID NO: 489 - DNA, 270 bp, Glycine max
  unsure (1)...(270): unsure at all n locations
  Clone ID: 700980945H1
tacctccattgctagcaacggtggaagagtacaatgcatgcaggtgtggcnaccaattggcaagaagaagttcgagactctttcctacttgccagacctcgatgatgcccaattggcaaaggaagtcgaataccttcaaggaaaggatggattccttgcttggaattcgagttggagcacggtttcgtgtaccgtgagcacaacaggtcacctggatactatgatggacgctactggaccatgtggaagctgcctatgtttggctgcatg

SEQ ID NO: 490 - DNA, 285 bp, Glycine max
  unsure (1)...(285): unsure at all n locations
  Clone ID: 700557890H1
gaacaagtagttgagaactaagaaggagaagcaaatggcttcctcaatgatctcttccccagctgttaccactgtccaaccgtgccggtgccggcatggttgctccattcactggcctcaagtccatggctggcttccccaccagaaagaccaacaatgacattacctccattgctagcaacggtggaagagtgcaatgcatgcaggtgtggccancagttggcaagaagaagtttgagactctttccgcantgccagacttgtgatgcacattggcaagggant

SEQ ID NO: 491 - DNA, 267 bp, Glycine max
  Clone ID: 700863566H1
aaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatg

SEQ ID NO: 492 - DNA, 270 bp, Glycine max
  Clone ID: 701108362H1
agaaaaacaagtagtcgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccacttggcaagaagaagtccgagactctttcctacttgccagacctcgatgatg

SEQ ID NO: 493 - DNA, 265 bp, Glycine max
  unsure (1)...(265): unsure at all n locations
  Clone ID: 700658190H1
gtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcagntgtggccaccaattggcaagaagaagttcgagactctttcctacttgccagacctcgatgatgcccaa

SEQ ID NO: 494 - DNA, 268 bp, Glycine max
  unsure (1)...(268): unsure at all n locations
  Clone ID: 700994486H1
gtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggncaccaattggcaagaagnagttcgagactctttcctacttgccagacctcgatgatgcccaattg

SEQ ID NO: 495 - DNA, 276 bp, Glycine max
  unsure (1)...(276): unsure at all n locations
  Clone ID: 700553851H1
ttgagaactaagaagaaggaaatangcttcctcaatgatcncctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagt

SEQ ID NO: 496 - DNA, 262 bp, Glycine max
  Clone ID: 700683005H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagcttgacactctttcctacctgcca

SEQ ID NO: 497 - DNA, 240 bp, Glycine max
  Clone ID: 700789709H1
caagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactct

SEQ ID NO: 498 - DNA, 241 bp, Glycine max
  Clone ID: 700752960H1
gaacaagtagttgagaactaagaaggagaagcaaatggcttcctcaatgatctcttccccagctgttaccactgtcaaccgtgccggtgccggcatggttgctccattcacaggcctcaagtccatggctggcttccccaccaggaagaccaacaatgacattacctccattgctagcaacggtggaagagtgcaattcatgcaggtgtggccaccagttggcaagaagaagtttgagact

SEQ ID NO: 499 - DNA, 243 bp, Glycine max
  Clone ID: 700959845H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagattgagac

SEQ ID NO: 500 - DNA, 242 bp, Glycine max
  Clone ID: 700738866H1
aagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttc

SEQ ID NO: 501 - DNA, 262 bp, Glycine max
  Clone ID: 701064223H1
gttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaactgtggccaccagttggccagaataagtttgagactctttcctacctgccagaccttgatgatgca

SEQ ID NO: 502 - DNA, 270 bp, Glycine max
  unsure (1)...(270): unsure at all n locations
  Clone ID: 701002414H1
gaacaagtagttgagaactaagaaggagaagcaaatggcttcctcaatgatctcttccccagctgttaccactgtncaaccgtgccggtgccggcatggttgctccattcactggcctcaagtccatggctggcttccccaccaggaagaccaacaatgacattacctccattgctagcnacggtggaanagtgaatgcatgcaggngtggccaccagttggcaagaagaactttgagactctttcctacctggccagaccttgatgatg

SEQ ID NO: 503 - DNA, 275 bp, Glycine max
  Clone ID: 700992711H1
cagaagaacaagtagttgagaactaagaaggagaagcaaatggcttcctcaatgatctcttccccagctgttaccactgtacaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaaaagaagtttgcgactctttcctacctgccagacttgatgatgca

SEQ ID NO: 504 - DNA, 262 bp, Glycine max
  Clone ID: 700680079H2
gtcgagaactcagaaggagaagcaaatggcttcctcaatgatctcttccccagctgttaccactgtcaaccgtgccggtgccggcatggttgctccattcactggcctcaagtccatggctggcttccccaccagaaagaccaccaatgacattacctccattgctagcaacggtggaagagtgcaatgcatgcaggtgtggccaccagttggcaggaagaagtttgagactctttcctacctgccagaccttgatgatgca

SEQ ID NO: 505 - DNA, 271 bp, Glycine max
  unsure (1)...(271): unsure at all n locations
  Clone ID: 700992131H1
agaacaagtagttgagaactaagaaggagaagcaaatggcttcctcaatgatctcttccccagctgttaccactgtncaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagannaagtttgagacttttcctacctgccagacttgatgatgca

SEQ ID NO: 506 - DNA, 250 bp, Glycine max
  Clone ID: 700945939H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagccgtttgagactctttcctac

SEQ ID NO: 507 - DNA, 261 bp, Glycine max
  unsure (1)...(261): unsure at all n locations
  Clone ID: 700995283H1
gtagttgagaactcagaaggagaagcaaatggcttcctcaatgatctcttccccagctgttaccactgtncaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaacnagaagtttgagactctttcctacctgccagccttgatga

SEQ ID NO: 508 - DNA, 253 bp, Glycine max
  Clone ID: 700790720H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccacttggcaagaagaagtttgagactctttcctacctgccagacctt

SEQ ID NO: 509 - DNA, 287 bp, Glycine max
  unsure (1)...(287): unsure at all n locations
  Clone ID: 700557607H1
gtagttgagaactaagaagaaggaaatggcttcctcaatgatctcctccccagctgttaccaccgtccaaccgtgccggtgccggcatggttgctccattcaccggcctcaaatccatggctggcttccccacgaggaagaccaacaatgacattacctccattgctagcaacggtggaagagtacaatgcatgcangtgtggccaccaattggcaagaagaagttcgagactctttcctacttgccagacctcgatgatgcccattggcaaaggaagtcgaatacc

SEQ ID NO: 510 - DNA, 287 bp, Glycine max
  Clone ID: 701146551H1
gagaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccatcagttggcaagaagagttgagactctttcctacctgcca

SEQ ID NO: 511 - DNA, 267 bp, Glycine max
  unsure (1)...(267): unsure at all n locations
  Clone ID: 701002369H1
gaagaacaagtagttgagaactaagaaggagaagcaaatggcttcctcaatgatctctttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagacnctttctacctgccagacttgat

SEQ ID NO: 512 - DNA, 262 bp, Glycine max
  Clone ID: 700682563H2
atgcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggcacagttggcaagaagaagtttgagactctttcctacctgcca

SEQ ID NO: 513 - DNA, 279 bp, Glycine max
  Clone ID: 700555211H1
ggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattcctgcttggattcgagttggagcaggtttcgtgtaccgtgagcaccagtcaccaggata

SEQ ID NO: 514 - DNA, 266 bp, Glycine max
  unsure (1)...(266): unsure at all n locations
  Clone ID: 700656287H1
gtgaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgcnacccccatttgtttgttcgtccttaaatncatcccatttgttttnnctttatgagatnc

SEQ ID NO: 515 - DNA, 249 bp, Glycine max
  Clone ID: 700791902H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttgccaagaagaagtttgagactctt

SEQ ID NO: 516 - DNA, 256 bp, Glycine max
  Clone ID: 700876346H1
agaagaacaagtagttgagaactaagaaggagaagcaaatggagtcctcaatgatctcttccctagctgctaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtgtgagactctttcctacct

SEQ ID NO: 517 - DNA, 238 bp, Glycine max
  Clone ID: 700681759H1
gtttgagactctttcctacctgccagaccttgatgatgcacaatcggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggct

SEQ ID NO: 518 - DNA, 266 bp, Glycine max
  Clone ID: 701105254H1
cgttctagctcgcgatctagaactagtcgaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgag

SEQ ID NO: 519 - DNA, 248 bp, Glycine max
  Clone ID: 700873322H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaaactgaagtttgagactcttt

SEQ ID NO: 520 - DNA, 264 bp, Glycine max
  Clone ID: 700741118H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagacttgat

SEQ ID NO: 521 - DNA, 238 bp, Glycine max
  Clone ID: 700681782H1
caacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctg

SEQ ID NO: 522 - DNA, 241 bp, Glycine max
  Clone ID: 700746782H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagac

SEQ ID NO: 523 - DNA, 270 bp, Glycine max
  unsure (1)...(270): unsure at all n locations
  Clone ID: 700656875H1
gaacaagtagttgagaactaagaaggagaagcaaatggcttcctcaatgatctcttccccagctgttaccactntcaaccgtgccggtgccggcatggttgctccattcactggcctcaagtccatggctggcttccccnccaggaagacnccccaatgacattacctccattgctagcaacggtggaagagtgcaatgcatgcangtgtggccaccagttggcaagaagaagtttgagactcttcctacctgccagacctgatgatgca

SEQ ID NO: 524 - DNA, 247 bp, Glycine max
  unsure (1)...(247): unsure at all n locations
  Clone ID: 700993783H1
tgcaatgcatgcaggtgtggccaccagttggcaagaagaagtttgagactctttcctacctgccagaccttgatgatgcacaatnncgcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatg

SEQ ID NO: 525 - DNA, 245 bp, Glycine max
  Clone ID: 700738524H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcacgaagaagtttgagactctt

SEQ ID NO: 526 - DNA, 239 bp, Glycine max
  Clone ID: 701214655H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcacgaagaagtttgagactctttcct

SEQ ID NO: 527 - DNA, 246 bp, Glycine max
  Clone ID: 700740449H1
atggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgactgcaggtgtggccaccagttggcaagaagaagtttgagactctttcctacctgccagaccttgatgatgcacaattggca

SEQ ID NO: 528 - DNA, 279 bp, Glycine max
  Clone ID: 700556379H1
cagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctgatgatgcccattggc

SEQ ID NO: 529 - DNA, 267 bp, Glycine max
  unsure (1)...(267): unsure at all n locations
  Clone ID: 700660523H1
caagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgaccgtgtggccaccaatnggcaagangaagttcgagactctttcctacttgccagacctcgatgatgccca

SEQ ID NO: 530 - DNA, 244 bp, Glycine max
  Clone ID: 700791055H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagac

SEQ ID NO: 531 - DNA, 261 bp, Glycine max
  unsure (1)...(261): unsure at all n locations
  Clone ID: 700656671H1
ctaagaaggagaagcaaanngnttccncaatgatctcttccccanctgttaccactgtnaaccgtnccggtgccggcatggttgctccantcantggnctcaagtccatggctggnttccccaccaganagaccaacaatgacattacctccantgctagcaacggtggaagagtgcaatgcatgcagntgtggctaccagttggnaagaagaagtttgagactctttcctacctgcnagaccttgatgatgcacaattgg

SEQ ID NO: 532 - DNA, 258 bp, Glycine max
  Clone ID: 700740963H1
gatctcttccccagctgttaccactgtcaaccgtgccggtgccggcatggttgctccattcactggcctcaagtccatggctggcttccccaccagaaagaccaacaatgacattacctccattgctagcaacggtggcgagtgcaatgcatgcaggtgtggccaccagttggcaagaagaagtttgagactctttcctacctgccagaccttgatgatgcacaattggcaaaggaagtagaataccttcttaggaag

SEQ ID NO: 533 - DNA, 257 bp, Glycine max
  Clone ID: 701107017H1
gcacaagtagttgagaactacgacggagtagcaaatggcttcctcaatgatctcttccccagctgttaccactgtcaatcgtgccggtgccggcatggttgctccattcactggcctcaagtccatggctggttccccaccagaaagaccaacaatgacattacctccattgctagcaacggtggaagagtgcaatgcatgcaggtgtggccaccagttggcaagaagaagtttgagactctttcctacctgccaga

SEQ ID NO: 534 - DNA, 260 bp, Glycine max
  Clone ID: 701139539H1
cttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagactgcaatgcatgcaggtgtggccaccagttggcaagaagaactttgatatcgtttcctacctgccagaccttgatgatgcacaattggcaaaggaagtagaatacctt

SEQ ID NO: 535 - DNA, 253 bp, Glycine max
  Clone ID: 700946365H1
tgcataagaacatgtagttgagaactaagaaggagaagcaaatggcttcctcaatgatctcttccccagctgttaccactgtcaaccgtgccggtgccggcatggttgctccattcactggcctcaagtccatgctggcttccccaccagaaagaccaacaatgacattacctccattgctagcaacggtggaagagtgcaatgcatgcaggtgtggccaccagttggcaagaagaagtttgagactctttcc

SEQ ID NO: 536 - DNA, 258 bp, Glycine max
  Clone ID: 700682509H2
cagaagaacaagtagttgagaactaagaaggagaagcaaatggcttcctcaatgatctcttccccagctgttaccactgttaaccgtgccggtgccggcatggttgctccattcactggcctcaagtccatggctggcttccccaccagaaagaccaacaatgacattacctccattgctagcaacggtggaagagtgcaatgcatgcaggtgtggccaccatggcaagagaagagtgagactctttcctacctgcca

SEQ ID NO: 537 - DNA, 250 bp, Glycine max
  unsure (1)...(250): unsure at all n locations
  Clone ID: 700994024H1
aagaacaagtagttgagaactaagaaggagaagcaaatggcttcctcaatgatctcttccccagctgttaccactgtccaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagttcnagactctttcc

SEQ ID NO: 538 - DNA, 254 bp, Glycine max
  unsure (1)...(254): unsure at all n locations
  Clone ID: 700659886H1
aagtagttngagaactaagaaggagaagcnaatggcttcctcaatgatctcttccccagntgttaccantgtcaaccgtgccggtgccggcatggttgctccattcactggcctcaagtccatggctggcttccccaccaggaagaccancaatgacattacctccattgctagcaacggtggagagtgcaatgcatgcaggtgtggccaccagttggcaagaagaagtttgagactctttcctacctgccaga

SEQ ID NO: 539 - DNA, 241 bp, Glycine max
  Clone ID: 700755378H1
gagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctg

SEQ ID NO: 540 - DNA, 246 bp, Glycine max
  Clone ID: 700847182H1
aagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtcgccaccagttggcaagaagaagtttgagactctttcctacctgccagaccttgat

SEQ ID NO: 541 - DNA, 266 bp, Glycine max
  Clone ID: 700789017H2
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttcgcacgaagaatttgagactctttcctactgccagaccttgt

SEQ ID NO: 542 - DNA, 241 bp, Glycine max
  Clone ID: 700657694H1
cctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacttaaactacattcccattgtttttgctttt

SEQ ID NO: 543 - DNA, 249 bp, Glycine max
  Clone ID: 700894533H1
caagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagatctttcctacctg

SEQ ID NO: 544 - DNA, 248 bp, Glycine max
  unsure (1)...(248): unsure at all n locations
  Clone ID: 700989594H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcnggtgtggccaccagttggcaagaagnagtttgagatctttcctacgc

SEQ ID NO: 545 - DNA, 307 bp, Glycine max
  unsure (1)...(307): unsure at all n locations
  Clone ID: 700560570H1
gcagaagaacaantagttgagnactaagaaggngangcaaatgggcttcctcaatgatctcttccccagctgttaccactgtcaancgtgccggtgccggcatggttgcnccattcactggcctcaagtccatggctggcttccccaccaggaagaccaacaatgacattacctccattgctagcaacggtggaagagtgcaatgcatgcaggtgtggccaccagttggcaagaagaagttnagactctttcctactgccagaccttgatgatgcacaattggnaaaggtagagatacttcttaggg

SEQ ID NO: 546 - DNA, 253 bp, Glycine max
  unsure (1)...(253): unsure at all n locations
  Clone ID: 700656095H1
gcacggtttcgtgtaccgtgagcacaacaggtcaccaggatactacgatggacgctactggaccatgtggaagctgcctatgtttggttgcactgatgcttctcaggtgttgaaggagcttcaagaggctagncatgcataccccaacggcttcatccgtatcatcggattcgacaacgttcgccaagtgcagtgcatcagttcaatcgcttacaagcccccaggttctaagtgtgaaaaatttncaaagcct

SEQ ID NO: 547 - DNA, 237 bp, Glycine max
  Clone ID: 700656137H1
ctctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagctcaagaggctaagactgc

SEQ ID NO: 548 - DNA, 284 bp, Glycine max
  Clone ID: 700900212H1
ttcggctcgagccgaaagtttggagcatggtacgtgtggtaatcttctggcttcctcaatggtctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcac

SEQ ID NO: 549 - DNA, 230 bp, Glycine max
  Clone ID: 700871945H1
ggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgttt

SEQ ID NO: 550 - DNA, 263 bp, Glycine max
  Clone ID: 701144650H1
agacgacagaagggggggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttga

SEQ ID NO: 551 - DNA, 241 bp, Glycine max
  Clone ID: 700740357H1
aacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagacgtttgagactc

SEQ ID NO: 552 - DNA, 239 bp, Glycine max
  Clone ID: 700790635H2
gaagaacaagtagttgagaactaagaaggagaagcaaatggcttcctcaatgatctcttccccagctgttaccactgtcaaccgtgccggtgccggcatggttgctccattcactggcctcaagtcatggctggcttccccaccagaaagaccaacaatgacattacctccattgctagcaacggtggaagagtgcaatgcatgcaggtgtggccaccagttggcaagaagatgtttga

SEQ ID NO: 553 - DNA, 251 bp, Glycine max
  Clone ID: 700843795H1
gcaaatggcttcctcaatgatctcttccccagctgttaccactgtcaaccgtgccggtgccggcatggttgctccaataacctggcctcaagtccatggctggcttccccaccagaaagaccaacaatgacattacctccattgctagcaacggtggaagagtgcaatgcatgcaggtgtagccaccagttggcaagaagaagtttgagactctttcctacctgccagaccttgatgatgcacaattggca

SEQ ID NO: 554 - DNA, 256 bp, Glycine max
  Clone ID: 700790207H2
gaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtgtccaccaattggcaataagaagttcgagactctttcctacttgcca

SEQ ID NO: 555 - DNA, 257 bp, Glycine max
  Clone ID: 700725303H1
caagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcacgtgtggccaccaattggcaagaagaagttcgagactctttcctacttgccagacctcg

SEQ ID NO: 556 - DNA, 252 bp, Glycine max
  Clone ID: 700739809H1
aacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtggtcgcaccaattggcaaccagaagttcgagactctttcctacttgcca

SEQ ID NO: 557 - DNA, 259 bp, Glycine max
  unsure (1)...(259): unsure at all n locations
  Clone ID: 700659535H1
aagtagttgagaactaagaagaaggaaatggcttcctcaatgatctcctccccagctgttaccaccgtcaaccgtgccggtgccggcatggttgctccattcaccggcctcanatccatggctggcttccccacgaggaagaccaacaatgacattacctccattgctagcaacggtggaanagtacaatgcatgcaggnctggccaccaattggnnagaagaagttcgagactctttcctacttgccagacctcgatg

SEQ ID NO: 558 - DNA, 258 bp, Glycine max
  Clone ID: 700740653H1
cagaaaaacaagtagttgagaactaagaagaaggaaatggcttcctcaatgatctcctccccagctgttaccaccgtcaaccgtgccggtccggcatggttgctccattcaccggcctcaaatccatggctggcttccccacgaggaagaccaacaatgacattacctccattgctagcaacggtggaagagtacaatgcatgcaggtgtggccaccatttggcaagaagaagttcgagactctttcctacttgccag

SEQ ID NO: 559 - DNA, 254 bp, Glycine max
  unsure (1)...(254): unsure at all n locations
  Clone ID: 700993558H1
agtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtcgccaccaattggcaagcngaagttcgagactctttcctacttgccagacctc

SEQ ID NO: 560 - DNA, 239 bp, Glycine max
  Clone ID: 701153296H1
gatatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcctgcagtgtggccaccagttggc

SEQ ID NO: 561 - DNA, 270 bp, Glycine max
  unsure (1)...(270): unsure at all n locations
  Clone ID: 700992113H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccanttggcaagancctttnganacttttcctacctgccagncttgatgatgc

SEQ ID NO: 562 - DNA, 284 bp, Glycine max
  unsure (1)...(284): unsure at all n locations
  Clone ID: 700555503H1
gaagaacaagtagttgagaactaagaaggagaagcaaatggcttcctcaatgatctcttccccagctgttaccactgtccaaccttgccggtgccggcatggttgctccattcactggntcaagtccatggctggnttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaa

SEQ ID NO: 563 - DNA, 271 bp, Glycine max
  Clone ID: 700792226H1
cacaaatcacactattatatatagtaagtttgagcagaagcttggatatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtg

SEQ ID NO: 564 - DNA, 289 bp, Glycine max
  Clone ID: 701105302H1
ggctcgaggaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaacaagaagtttgagactctttcctacctgccagaccttgatgatgcacaattggcaa

SEQ ID NO: 565 - DNA, 252 bp, Glycine max
  Clone ID: 700871129H1
gaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagctggagcacggtttcgtgtaccgtgagcacaacaggtcacctggatactatgatggacgctactg

SEQ ID NO: 566 - DNA, 256 bp, Glycine max
  unsure (1)...(256): unsure at all n locations
  Clone ID: 700654859H1
agaagaacaagtagttgagaactaagaaggagaagcaaatggcttcctacaatnatctcttccccagctgttaccactgtcaaccgtgccggtgccggcatggttgctccattcactggcctcaagtccatggtggcttccccaccaggaagaccaacaatgacattacctccattgctagcaacggtggaagagtgcaatgcatgcangtgtggccaccagttggcaagaagaagttgagactctttcctacctg

SEQ ID NO: 567 - DNA, 249 bp, Glycine max
  unsure (1)...(249): unsure at all n locations
  Clone ID: 700656039H1
gtagttgagaactaagaaggagaagcaaatggcttcctcaatgatctcttccccagctgttaccactgtacaaccncgcaggtgccggcatggttgctccattcactggcctcaagtccatggctggcttccccaccaggaagaccaacaatgacattacctccattgctagcaacggtggaagagtgcaatgcatgcnaggtgtggccaccagttggcaagaagaagtttgagactctttcctacctg

SEQ ID NO: 568 - DNA, 253 bp, Glycine max
  Clone ID: 700739061H1
tccccagctgttaccactgtcaaccgtgccggtgccggcatggttgctccattcactggcctcaagtccatggctggcttccccaccagaaagaccaacaatgacattacctccattgctagcaacggtggaaggtgcaatgcatgcaggtgtggccaccagttggcaagaagaagtttgagactctttcctacctgccagaccttgatgatgcacatttggcaaaggaagtagaataccttttaggaaggga

SEQ ID NO: 569 - DNA, 262 bp, Glycine max
  unsure (1)...(262): unsure at all n locations
  Clone ID: 700655048H1
gcagaagancaagtagttnagaactaagaangagaagcaaattgnttcctcaatgatctcttccccagctgttaccactgtccaaccgtgccggtgccngcatggttgctccattcactggcctcaagtccatggctggcttccccaccaggaagaccaataatgacattacctccattgctagcaacggtggaagagtgcaatgcatgcaggtgtggccancattggcaagaagaagtatgagactctttcctacctgcca

SEQ ID NO: 570 - DNA, 328 bp, Glycine max
  unsure (1)...(328): unsure at all n locations
  Clone ID: 700680540H1
aagtagttgagaactaagaaggagcagcaaatggcttcctcaatgatctcttccccagctgttaccactgtcaaccgtgccggtgccggcatggttgctccattcactggcctcaagtccatggctggcttccccaccagaaagaccattaatcatattacctccattgctagaacggtggaagagtgcaatgcatgcaggtgtggcgaccagttggcaagaagaagtttgagactctttcctacctgccagaccttgatgatgcacaattggcanaggaagtagaataccttcttaggcagggatggattcttgcttggaatcgagt

SEQ ID NO: 571 - DNA, 249 bp, Glycine max
  Clone ID: 700730791H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttccta

SEQ ID NO: 572 - DNA, 257 bp, Glycine max
  unsure (1)...(257): unsure at all n locations
  Clone ID: 700991246H1
gaagaacaagtagttgagaactaagaaggagaagcaaatggcttcctcaatgatctcttccnncagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccatttggcaagaagannttgccgactctttcttantgc

SEQ ID NO: 573 - DNA, 245 bp, Glycine max
  Clone ID: 700876824H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagattgagact

SEQ ID NO: 574 - DNA, 245 bp, Glycine max
  Clone ID: 700791594H1
aagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcagatgtggccaccaattggcaagaagaagttcgagactctttcctactt

SEQ ID NO: 575 - DNA, 233 bp, Glycine max
  Clone ID: 700739144H1
caagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaagg

SEQ ID NO: 576 - DNA, 231 bp, Glycine max
  Clone ID: 700872171H1
gaagaacaagtagttgagaactaagaaggagaagcaaatggcttcctcaatgatctcttccccagctgttaccactgtcaaccgtgccggtgccggcatggttgctccattcactggcctcaagtccatgctggcttccccaccagaaagaccaccaatgacattacctccattgctagcaacggtggaagagtgcaatgcatgcaggtgtggccaccagttggcaagaag

SEQ ID NO: 577 - DNA, 245 bp, Glycine max
  Clone ID: 700871089H1
gaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagctggagcacggtttcgtgtaccgtgagcacaacaggtcacctggatactatgatggac

SEQ ID NO: 578 - DNA, 252 bp, Glycine max
  Clone ID: 700787735H2
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggcaacagttggctagaagaagtttgagactctttcctacctg

SEQ ID NO: 579 - DNA, 238 bp, Glycine max
  Clone ID: 700791676H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagcagaagtttgag

SEQ ID NO: 580 - DNA, 253 bp, Glycine max
  Clone ID: 700737752H1
gttgagaactacgaaggagccgcatctggcttcctcaatgatctcttccccagctgttaccactgtcaaccgtgccggtgccggcatggttgctccattcactggcctcaagtccatggctggcttccccaccagagagaccaacaatgacattacctccattgctagcaacggtggaagagtgcaatgcatgcaggtgtggccaccagttggcatgacgaagtttgagactctttcctacctgccagacctt

SEQ ID NO: 581 - DNA, 262 bp, Glycine max
  Clone ID: 700681539H1
cagaagaacaagtagttgagaactaagaaggagaagcaaatggattcctcaatgatctcttccccagctgttaccactgtcaaccgtgccggtgccggcatagttgctccattcactggcctcaagtccatggctggcttcccaccaggaagaccaacaatgacattacctccattgctagcaacggtggaagagtgcaatgcatgcaggtgtggccaccagttggcaagaagaagtttgagactctttcctacctgccaga

SEQ ID NO: 582 - DNA, 250 bp, Glycine max
  unsure (1)...(250): unsure at all n locations
  Clone ID: 700994222H1
gtagttgagaactaagaaggagaagcaaatngcttcctcaatgatctcttccccagctgttaccactgttcaaccgtgcccggtgccggcatggttgctccattcactggcctcaagtcatggctggcttccccaccaggaagaccaacaatgacattacctccattgctagcaacggtggaagagtgcaatgcntgcaggtgtggccaccagttggcaagaagaagtttgagactctttcctacctgcc

SEQ ID NO: 583 - DNA, 280 bp, Glycine max
  unsure (1)...(280): unsure at all n locations
  Clone ID: 701000001H1
aagtagttgagaactaagaaggagaagcaaatggcttcctcaatgatctcttccccagctgttaccactgtccaaccgtgccggtgccggaatggttgctccattcactggcctcaagtccatggctggcttccccaccagaaagaccaacaatgacattacctccattgctagcaacggtggaagagtgcaatgcatgcaggtgtggccaccagttggcaagaccnatttgagactctttcctactgccagacttgatgatnnacaattggnaaggaac

SEQ ID NO: 584 - DNA, 233 bp, Glycine max
  Clone ID: 700874142H1
aagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcatgaagaagtttga

SEQ ID NO: 585 - DNA, 246 bp, Glycine max
  Clone ID: 701106980H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttcgcaagaagaagtttgagactctttcctacctgcc

SEQ ID NO: 586 - DNA, 259 bp, Glycine max
  Clone ID: 700684527H1
tctcgagccgattcggctcgaggttgagaactaagaaggagaagcacaatggcttcctcaatgcatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctt

SEQ ID NO: 587 - DNA, 260 bp, Glycine max
  Clone ID: 700738477H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccaattggcaagagacgtttgagactctttcctacctgccaga

SEQ ID NO: 588 - DNA, 266 bp, Glycine max
  Clone ID: 701155411H1
tacggctgcgagaaacgacagaaggggggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacagtggaagagtgcaatgcatgcaggtgtggccaccagttggcaagaag

SEQ ID NO: 589 - DNA, 280 bp, Glycine max
  unsure (1)...(280): unsure at all n locations
  Clone ID: 700994428H1
agaagaacaagtagttgagaactaagaaggagaagcaaatggcttcctgcaatgatctcttccccagctgttaccactgtcaaccgtgccggtgccggcatggttgctccattcactggcctcaagtccatggctgggcttccccaccaggaagaccaacaatgacattacctccattgctagcaacgggtggaagagtggcaatgcatgcaggtgtggccaccagttggcaagaagaagtttgancactctttcctacctgccagaccttgatgatgcc

SEQ ID NO: 590 - DNA, 258 bp, Glycine max
  Clone ID: 700738079H1
gaagaacaagtagttgagaactaagaaggagaagcaaatggcttcctcaatgatctcttccccagctgttaccactgtcaaccgttccggtgccggcatggttgctccattcactggcctcaagtccatggctggcttccccaccagaaagcccaacaatgacattacctccattgctagcaacggtggaagagtgcatgcatgcaggtgtggcaccagttggcaagaagaatttgagactcttcctactgcagacct

SEQ ID NO: 591 - DNA, 249 bp, Glycine max
  unsure (1)...(249): unsure at all n locations
  Clone ID: 700658259H1
aagtttgagactctttcctacctgccagaccttgatgatgcacaattggcaaaggaagtagaataccttcttaggaagggatggattccttgcttggaattcagttggagcacggtttcgtgtaccgtgagcacaanaggtcaccaggatactacgatgnnccgctactggaccatgtggaagctgcctatgtttggttgcactgatgcttctcagtgaaggagcttcaagaggctaagacngcatacc

SEQ ID NO: 592 - DNA, 248 bp, Glycine max
  Clone ID: 701062095H1
atccatggctggcttccccacgaggaagaccaacaatgacattacctccattgctagcaacggtggaagagtacaatgcatgcaggtgtggccaccaattggcaagaagaagttcgagactctttcctcttgccagacctcgatgatgcccaattggcaaaggaagtcgaataccttctaaggaaaggatggattccttgcttggaattcgagttggagcacggtttcgtgtaccgtgagcacaacag

SEQ ID NO: 593 - DNA, 253 bp, Glycine max
  unsure (1)...(253): unsure at all n locations
  Clone ID: 700730588H1
caagtagttgagaactaagaaggagaagcaaatggcttcctcaatgatctcttccccagctgttatccactgtcaaccgtgccggtgccggcatggttgctccattcactagcctcaagtccatggctagnctccccaccagaaagaccaacaatgacattacctccattgctagcaacggtggaagagtccaatgcatgcaggtgtggccaccacttggcaagaagaagtttgagactctttcctacctgcc

SEQ ID NO: 594 - DNA, 264 bp, Glycine max
  Clone ID: 700900426H1
caagtagttgagaactaagaaggagcagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggccccccccaccagttcggcaaccagaagtttgagactctttcctcacctgccagaccttga

SEQ ID NO: 595 - DNA, 279 bp, Glycine max
  unsure (1)...(279): unsure at all n locations
  Clone ID: 700994405H1
aagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaaatgaccattacctccattggnaagccaacggtggaagagtgccaatgcatgccaggtgtggccaccagttggcaagaagnagtttgagactctttcctaacctgccagaccttgatgatgcacaatt

SEQ ID NO: 596 - DNA, 236 bp, Glycine max
  Clone ID: 700743222H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccacaggaagaccaacaatgacattacctccattgctagcaacggtggaagagtgcaatgcatgcaggtgtggccaccagttggcaagatgaag

SEQ ID NO: 597 - DNA, 270 bp, Glycine max
  Clone ID: 701108454H1
caagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgcggccaccaattggcaacaagaagttcgagactctttcctacttgccagacctcgatgatgcccaatt

SEQ ID NO: 598 - DNA, 274 bp, Glycine max
  Clone ID: 701061556H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtccgagactctttcctacctgccagaccttgatgatg

SEQ ID NO: 599 - DNA, 229 bp, Glycine max
  Clone ID: 700871533H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtgggcaccagttggcaag

SEQ ID NO: 600 - DNA, 286 bp, Glycine max
  unsure (1)...(286): unsure at all n locations
  Clone ID: 700558546H1
gnagaacaagtagttgagaactaagaaggagaaacaaatggcttcctcaatgatctcttcccccagctgttaccactgttcaaccgtgccggtgccggcatggttgctccattcactggcctcaagtccatggctggcttccccaccaggaagaccaacnatncntacctccattgctagcaacggtggaagagtgcaatgcatgcaggtgtggccaccagttgggcaagaagaagnttgaggatctttcctacctgccagacctgatggtgcccaattggnnagg

SEQ ID NO: 601 - DNA, 265 bp, Glycine max
  Clone ID: 700741006H1
aagtagttgagaactaagaaggagaagcaaatggcttcctcaatgatctcttccccagctgttaccactgtcaaccgtgccggtgccggcatggttgctccattcactggcctcaagtccatggctggcttccccaccagaaagccaacaatgacattacctccattgctagcaacggtggaagagtgcaatgcatgcaggtgtggccaccagttggcaagaagaagtttgagactctttcctacctgccagaccttgatgatgc

SEQ ID NO: 602 - DNA, 246 bp, Glycine max
  Clone ID: 700994239H1
gtagttgagaactaagaagaaggaaatggcttcctcaatgatctcctccccagctgttaccaccgtcaaccgtgccggtgccggcatggttgctccattcaccggcctcaaatcctggctggcttccccacgaggaagaccaacaatgacattacctccattgctagcaacggtggaagagtacaatgcatgcaggtgtggccaccaattggcaagaagaagttcgagactctttcctacttgcca

SEQ ID NO: 603 - DNA, 235 bp, Glycine max
  Clone ID: 700685501H1
cggctcgagaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcaatgcaggtgtggccaccagttggcaagaag

SEQ ID NO: 604 - DNA, 228 bp, Glycine max
  Clone ID: 700741993H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaa

SEQ ID NO: 605 - DNA, 230 bp, Glycine max
  Clone ID: 700741994H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaaga

SEQ ID NO: 606 - DNA, 220 bp, Glycine max
  Clone ID: 700741275H1
gttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccacagttggcaagaaga

SEQ ID NO: 607 - DNA, 240 bp, Glycine max
  Clone ID: 700741979H1
gtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttccta

SEQ ID NO: 608 - DNA, 240 bp, Glycine max
  Clone ID: 700873834H1
gaagctgcctatgttttgttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccatcccactttgtttgtctgtacttaaactacattcccatttgtt

SEQ ID NO: 609 - DNA, 234 bp, Glycine max
  Clone ID: 700872831H1
aagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccagcaatgacattacctccattgctagcaacggtggaagagtgcaatgcatgcaggtgtggccaccagtcggcaagaagaagtttgag

SEQ ID NO: 610 - DNA, 247 bp, Glycine max
  Clone ID: 700684862H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagacgaagtttgagactcttcct

SEQ ID NO: 611 - DNA, 279 bp, Glycine max
  unsure (1)...(279): unsure at all n locations
  Clone ID: 700991906H1
agttgagaactaagaaggagaagcaaatggcttcctcaatgatctcttccccagctgttaccactgtccaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaatttganactctttctnaccngccagnctngatgntncnnattggcaaanggaatt

SEQ ID NO: 612 - DNA, 246 bp, Glycine max
  unsure (1)...(246): unsure at all n locations
  Clone ID: 700655544H1
caagtagttgagaactaagaaggagaagcaaatggcttcctcaatgatctcttccnccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagagaatttnaanacntttcccnt

SEQ ID NO: 613 - DNA, 223 bp, Glycine max
  Clone ID: 700740768H1
gaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttga

SEQ ID NO: 614 - DNA, 257 bp, Glycine max
  unsure (1)...(257): unsure at all n locations
  Clone ID: 700992972H1
tgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgnaggtgtggccaccanttgncaagaanaattggannctnttccctacnnnnaancncttgaggcna

SEQ ID NO: 615 - DNA, 227 bp, Glycine max
  Clone ID: 700740745H1
cagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagacccacaatgacattacctccattgctagcaacggtggaagagtgcaatgcatgcaggtgtggccaccagttgg

SEQ ID NO: 616 - DNA, 276 bp, Glycine max
  Clone ID: 700728041H1
agaacaagtagttgagaactaagaaggagaagcaaatggcttcctcaatgacctcttctccagctgctaccactgtcaaccgtgccggtgccggcatggctgctccattcactggcctcaagtccatggctggcttccccaccagaaagaccaacaatgacattacctccattgctagcaacggtggaaagtgcaatgcatgcaggtgtggccaccagttggcaagacagaagttcgagactctttcctacctgccagaccttgatgatgcacaat

SEQ ID NO: 617 - DNA, 233 bp, Glycine max
  Clone ID: 700729690H1
agagtaccttcttaggaacggatggattccttgcatggaattcgagttagagcacggtttcgtgtaccgtgagcactacaggtcaccaggatactacgatggacgctactggaccatgtggaagctgcctatgcatggttgcactgatgcttctcaggtgttgacggagcttcaagaggctaagactgcatacgccaacggcttcatccgtatcatcggattcgacaacgttc

SEQ ID NO: 618 - DNA, 289 bp, Glycine max
  Clone ID: 700743048H1
cacgcgtacgcggacttcggattcggctcgacgtagttgagatctaagaaggagaagcaaatggcttcctcaatgatctcttccccagctgttaccactgtcaaccgtgccggtgccggcatggttgctccattcactggcctcaagtccatggctggctccccaccaggaagaccaacaatgacattacctccattgctagcaacggggaagagtgcaatgcatgcaggtgtggccaccagttggcaagaagaagtttgagactctttcctacctgccagaccttgat

SEQ ID NO: 619 - DNA, 239 bp, Glycine max
  Clone ID: 700790361H2
ctggcttccccacgaggaagaccaacaatgacattacctccattgctagcaacggtggaagagtacaatgcatgcaggtgtggccaccaattggcaagaagaagttcgagactatttcctacttgccagacctcgatgatgcccaattggcaaaggaagtcgaataccttctaaggaaaggatggattccttgcttggaattcgagttggagcacggtttcgtgtaccgtgagcacaac

SEQ ID NO: 620 - DNA, 222 bp, Glycine max
  Clone ID: 700896585H1
cccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggc

SEQ ID NO: 621 - DNA, 220 bp, Glycine max
  Clone ID: 701104185H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggc

SEQ ID NO: 622 - DNA, 228 bp, Glycine max
  Clone ID: 700741286H1
agaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaaga

SEQ ID NO: 623 - DNA, 264 bp, Glycine max
  Clone ID: 700737954H1
gcagaagaacaagtagttgagaactaagaaggagtagcaaatggcttcctcaatgatctcttccccagctgttaccactgtcaaccgtgccggtgccggcatggatgctccattcactggcctcaagtccatggctggcttccccaccagagagaccagcaatgacattacctccattgctagcaacggtggcagagtgcaatgcttgcaggtgtggccaccagttggcaagaacgagtgggagactctttcctacctgcaaga

SEQ ID NO: 624 - DNA, 239 bp, Glycine max
  Clone ID: 700738883H1
ctaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggctgagtacaatgcatgcaggtgtggccaccaattggcaagaagaagttcgagactctttcctacttgccagac

SEQ ID NO: 625 - DNA, 257 bp, Glycine max
  Clone ID: 700872433H1
cggctcgaggaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggcccacagttggcaagaagaagttctagactcttc

SEQ ID NO: 626 - DNA, 275 bp, Glycine max
  Clone ID: 701059827H1
caagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagatcgcaatgcatgcacgtgtggccaccagttaccaagaagaagtttgagactctttcctacctgccagaccttgatgatgcacaattgg

SEQ ID NO: 627 - DNA, 254 bp, Glycine max
  Clone ID: 701117550H2
aagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcatgtgtggcccacagttggcaagaagaagtttgagactctttcctacctgccagaccttgatgatgcacaattggcaaa

SEQ ID NO: 628 - DNA, 231 bp, Glycine max
  Clone ID: 700743227H1
ggaaaggatggattccttgcttggaattcgagttggagcacggtttcgtgtaccgtgagcacaacaggtcacctggatactatgatggacgctactggaccatgtggaagctgcctatgtttggctgcactgatgcttctcggtgttgaaggagcttcaagaggctaagactgcataccccaatggcttcatccgtatcattggatttgacaacgttcgccaagtgcagtg

SEQ ID NO: 629 - DNA, 248 bp, Glycine max
  unsure (1)...(248): unsure at all n locations
  Clone ID: 700990060H1
gaagaacangtagttgagaactaagaaggagaagcaaatggcttcctcaatgatctcttccctagctgttaccactntcaaccgtnccggtgccggcatggttgctccattcactggcctcaagtccatggctggcttccccncccaggaagactatgaaatgacattacctcnattgctagcaacggtggaagagtgcaatgcatgcaggtgtggccaccagttggcaanaagaagtttgagactct

SEQ ID NO: 630 - DNA, 229 bp, Glycine max
  Clone ID: 700789891H2
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaaggtggaagagtgcaatgcatgcaggtgtggccaccagttggcaagaaga

SEQ ID NO: 631 - DNA, 231 bp, Glycine max
  Clone ID: 700739160H1
gttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatacatgcaggtgtggccagcaattggcaagaagaagttcgagactct

SEQ ID NO: 632 - DNA, 266 bp, Glycine max
  Clone ID: 700900244H1
aagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccatgatgttcagttcctccattgctagcatcggtggaagagtgtaaggcatgcaggtgtggccaccagttggcaagaagaagtttgagactctttcctacttgccatacttggaggcgtc

SEQ ID NO: 633 - DNA, 238 bp, Glycine max
  Clone ID: 700680230H2
caagtagttgagaactaagaaggagaagcaaatggcttcctcaatgatctcttccccagctgttaccactgtcaaccgtgccggtgccggcatggttgatccattcactggcctcaagtccatggctggcttccccaccagaaagaccaacaatgacattacctccattgctagcaacggtggaagatgcgatgcatgcaggtgtggccaccagttggccagaagaagtttgagactc

SEQ ID NO: 634 - DNA, 252 bp, Glycine max
  unsure (1)...(252): unsure at all n locations
  Clone ID: 700991489H1
gaagaacaagtagttgagaactaagaaggagaagcaaatggnttcctcaatgatctcttctccagctgttaccactgtncaaccgtgtcggtgccggcatggttgctccattcactgggcctcaagtccatggctgggcttcccnaccaggaagaccaacaatgacattacctccattgctagcaacggtgnaagagtgcaatgcatgcaggtntngccaccagttggcaagaagacgttcgagncnctttc

SEQ ID NO: 635 - DNA, 238 bp, Glycine max
  Clone ID: 700744694H1
gcctatgtttggttgcactgatgcttctcaggtgttgaaggagcttcaagaggctaagactgcataccccaacggcttcatccgtatcatcggattcgacaacgttcgccaagtgcagtgatcagcttcatcgcctacaagcccccaggcttctaagtgtgaaaaatttgcaaagcatttgtagccgccaccccactttgtttgtttgtacttaaactacattcccatttgtttttgc

SEQ ID NO: 636 - DNA, 265 bp, Glycine max
  unsure (1)...(265): unsure at all n locations
  Clone ID: 700659755H1
agaagaacncagtagttgagaactaagaangagaagcaaatggcttcctcaatgatctcttccccagcnntnaccactntcaaccgtgccggtgccggcatggttgctccattcactggcctcaagtccatggctggcttccccacnaggaagnacnacaatnncattnacctccatngcnancaacggtggaaaagtgcnntgcatggcaggtgtggccaccagttggnaagaagaagttngagactntttcctacctgccaga

SEQ ID NO: 637 - DNA, 267 bp, Glycine max
  Clone ID: 700741013H1
tgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcattttagccgccaccccactttgtttgtttgtacttaaactacattcccatttgtttttgctttttgagattcatcatcctgtattttgggttctgtttcggattcaatggaattaatggatgag

SEQ ID NO: 638 - DNA, 253 bp, Glycine max
  unsure (1)...(253): unsure at all n locations
  Clone ID: 700990946H1
agaagaacaagtagttgagaactaagaaggagaagcaaatggcttcctcactgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgnggncncccanntnggcnngagattnnngatcnntngccgg

SEQ ID NO: 639 - DNA, 208 bp, Glycine max
  Clone ID: 700791542H1
gtagttgagaactaagaaggagaagcaaatggcttcctcaatgatctcttccccagctgttaccactgtcaaccgtgccggtgccggcatcgttgctccattcactggcctcaagtccatggctggcttccccaccaggaagaccaacaatgacattacctccattgctagcaacggtggaagagtgcaatgcatgcaggtgtggcca

SEQ ID NO: 640 - DNA, 213 bp, Glycine max
  Clone ID: 700682942H1
caagtagttgagaactaagaaggagaagcaaatggcttcctcaatgatctcttccccagctgttaccactgtcaaccgtgccggtgccggcatggttgctccattcactggcctcaagtccatggctggcttccccacagaaagaccaacaatgacattacctccattgctagcaacggtggaagagtgcaatgcatgcaggtgtggccacca

SEQ ID NO: 641 - DNA, 264 bp, Glycine max
  unsure (1)...(264): unsure at all n locations
  Clone ID: 700994722H1
gaagnacaagtagttgagaactaagaaggagaagcaantggcttcctcaatgatctcttcccccagctgtnaccactgtccaaccgtgacggtnccggcatggttgnnccattcactggcctcaagtccatggctggcttccccaccagnnagaccaacnatgacattacctccattgctagcaacggnggaagagtgcaatgcatgcaggtgtggccaccagttggcaagaagaagnttgagcactctttctacctgccagac

SEQ ID NO: 642 - DNA, 237 bp, Glycine max
  Clone ID: 700788601H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagacgaagtt

SEQ ID NO: 643 - DNA, 213 bp, Glycine max
  Clone ID: 700872290H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgt

SEQ ID NO: 644 - DNA, 227 bp, Glycine max
  Clone ID: 700741012H1
gttgagaactaagaaggagaagcaaatggcttcctcaatgatctcttccccagctgttaccactgtcaaccgtgccggtgccggcatggttgctccattcactggcctcaagtccatggctggcttccccaccagaaagaccaactgacattacctccattgctagcaacggtggaagagtgcaatgcatgcaggtgtggccacagttagcagaagaagttgagact

SEQ ID NO: 645 - DNA, 261 bp, Glycine max
  unsure (1)...(261): unsure at all n locations
  Clone ID: 700990993H1
gcagaagaacaagtagttgagaactaagaaggagaagcaaatggcttcctcaatgatctcttccccagctgttaccantgtncaaccgtgccggtgccggcatggttgctccattcantggcctcaagtccatggctggcttccccaccaggaagaccaacaatgacattacctccattgntagcaanggtggaagagtgcnangcatgcaggtggggccaccagttggcaagtaagatcnttgantcttttnnnanttnt

SEQ ID NO: 646 - DNA, 233 bp, Glycine max
  Clone ID: 700870628H1
gaccaacaatgacattacctccattgctagcaacggtggaagagtacaatgcatgcaggtgtgtccaccaattggcaagaagaagttcgagactctttcctacttgccagacctcgatgatgcccaattggcaaaggaagtcgaataccttctaaggaaaggatggattccttgcttggaattcgagctggagcacggtttcgtgtaccgtgagcacaacaggtcacctggat

SEQ ID NO: 647 - DNA, 245 bp, Glycine max
  Clone ID: 700740220H1
gtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgccggtgtggccaccaaccggcaagaagaagttcgagactctttcctacttgc

SEQ ID NO: 648 - DNA, 225 bp, Glycine max
  Clone ID: 700683853H1
gcagaacaagtagttgagaactaagaaggagaagcaaatggcttcctcaatgatctcttccccagctgttaccactgtcaaccgtgccggtgccggcttggttgctccattcactggcctcaagtccatggctggcttccccaccagaaagaccaacaatgacattacctccattgctagcaacggtggaagagtgcaatgcatgcaggtgtggccaccagttgg

SEQ ID NO: 649 - DNA, 250 bp, Glycine max
  unsure (1)...(250): unsure at all n locations
  Clone ID: 700657177H1
gcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatgattccttgcttgaaatcgagttgagcaggttcgnctacgcnagcacaacag

SEQ ID NO: 650 - DNA, 260 bp, Glycine max
  Clone ID: 700740956H1
aaaacaagtagttgagaactaagaagaaggaaatggcttcctcaatgatctcctccccagctgttaccaccgtcaaccgtgccggtgccggcatggttgctccattcaccggcctcaaatccatggctggcttccccagaggaagaccaacaatgacattacctccattgctagcaacggtggaagagtacaatgcatgcaggtgtggccaccaattggcaagaagaagttcgagactctttcctacttgccagacctcg

SEQ ID NO: 651 - DNA, 229 bp, Glycine max
  Clone ID: 700683812H1
cagaagaacaagtagttgagaactaagaaggagaagcaaatggcttcctcaatgatctcttccccaagtgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggca

SEQ ID NO: 652 - DNA, 217 bp, Glycine max
  Clone ID: 701058565H1
cgtagttgagaactaagaaggagaagcaaatggcttcctcaatgatctcttccccagctgttaccactgtcaaccgtgccggtgccggcatggttgctccattcactggcctcaagtcgatggctggcttccccaccagaaagaccaacaatgacattacctccattgctagcaacggtggaagagtgcaatgcatgcaggtgtggccacagttggc

SEQ ID NO: 653 - DNA, 236 bp, Glycine max
  Clone ID: 700789725H1
ctcgagcgattcggctcagcggctcgagagaacaagtagttgcgaactaagaaggagaacgcaaatggcttcctcaatgatctcttccacagctgttaccactgtcaaccgtgccggtgccggcatggttgctccattcactggcctcaagtccatggctggcttccccaccaggaagaccaacaatgacattacctccattgctagcaacggtggaagagtgcaatgcatgcagg

SEQ ID NO: 654 - DNA, 262 bp, Glycine max
  Clone ID: 700787907H1
gcagaagaacaagtagttgagaactaagaaggagaagcacatggcttcctcaatgatctcttccccagctgttaccactgtcaaccgagccggtgccggcatggttgctccattcactggcctcaagtccatggctggcttccccaccagaaagaccaacaatgacattatctccattgctagcaacggttggaagagtgcaatgcatgcaggtgtggtcaccagttggcaagaagaagtctgagactctttcctacctgcc

SEQ ID NO: 655 - DNA, 252 bp, Glycine max
  Clone ID: 700870534H1
aatggcttcatccgtatcattggatttgacaacgttcgccaagtgcagtgcatcagcttgcatcgcctacaagcccccaggcttctaagtcattgaaaaatttgcaaagcatctgtagccaccccactttgtttgttgtcttaaactacattcccatttgtttttgctttatgagatttcatcatcctgtatttttggtttctgttttcggacttcaatggaaattaatggatgagaactaatgaataagct

SEQ ID NO: 656 - DNA, 261 bp, Glycine max
  Clone ID: 700743023H1
agactgcataccccaacggcttcatccgtatcatcggattcgacaacgttcgccaagtgcagtgcatcagcttcatcgcctacaagcccccaggcttctaagtgtgaaaaatttgcaaagcatttgtagcgccaccccactttgtttgtttgtacttaaactacattcccatttgttttgctttttgagatttcatcatcctgtatttttggtttctgttttcggacttcaatggaaattaatggatgagaactaatgaat

SEQ ID NO: 657 - DNA, 281 bp, Glycine max
  unsure (1)...(281): unsure at all n locations
  Clone ID: 700557205H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacatgacattacctccattgctagcaacggtggaagagtgcatgcatgcaggtgtggccaccagttggcagaagaagtttgagatctttctactgccagacttgatgatgcacattggcaangagtaga

SEQ ID NO: 658 - DNA, 221 bp, Glycine max
  Clone ID: 700646080H1
aagtagttgagaactaagaagggaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggctaccagttggcaag

SEQ ID NO: 659 - DNA, 265 bp, Glycine max
  unsure (1)...(265): unsure at all n locations
  Clone ID: 700998541H1
gttgagaactaagaaggagaagcaaatggcttcctcaatgatctcttccccagctgttaccactgtncaaccgtgccggtgccggcatggttgctccattcactggcctcaagtccatggctggcttccccaccaggaagaccaacaatgacattacctccattgctagcaacggtggaagantgcaatgcatgcaggtgtggccaccatngnnnncaagattcngagtcttnncctnccanacattttngccnannnnnaaaag

SEQ ID NO: 660 - DNA, 183 bp, Glycine max
  Clone ID: 700684330H1
caagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctataaggtgtga

SEQ ID NO: 661 - DNA, 272 bp, Glycine max
  Clone ID: 700739656H1
cagaagaacaagtagttgagaactacgcaggagcagcaaatggcttcctcaatgatctcttccccagctgttaccactgtcaaccgtgccggtgccggcatggttgctccattcactggcctcaagtccatggctggcttcctcagcaggaagaccaacaatgacattacctccattgctagcaacggtggaagagtgcaatgcatgcaggtgtggccaccagttggcaagaagaagtttcagactctgtcctacctgccagaccttgatga

SEQ ID NO: 662 - DNA, 249 bp, Glycine max
  Clone ID: 700739768H1
gtacttgataactaagaaggtggcacaatggcttcctcaatgatctcttccccagctgttaccactgtcaaccgtgccggtgccggcatggctgctccattcactggcctcaagtccatggctgccttccccaccagtcagaccaacaatgacattacctccattgctatcaacggtggtagagtgcaacgcatgcaggtgtggccaccagttggcaagtcgaagtttgagactctttcctacctgcca

SEQ ID NO: 663 - DNA, 216 bp, Glycine max
  Clone ID: 700683980H1
caatgacattacctccattgctagcaacggtggaagagtgcgatgcatgcaggtgtggccaccagttggcaagaagaagtttgagactctttcctacctgccagaccttgatgatgcacaattggcgaaggaagagaataccttcttaggaagggatggtttccttgcttggaattcgagttggagcacggtttcgtgtaccgtgagcacaacagg

SEQ ID NO: 664 - DNA, 195 bp, Glycine max
  Clone ID: 700743962H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagag

SEQ ID NO: 665 - DNA, 192 bp, Glycine max
  Clone ID: 700742888H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagt

SEQ ID NO: 666 - DNA, 192 bp, Glycine max
  Clone ID: 700744006H1
gcagaagaacaagtagttgagaactaagaaggagaagcaaatggcttcctcaatgatctcttccccagctgttaccactgttaaccgtgccggtgccggcatggttgctccattcactggcctcaagtccatggctggcttccccaccaggaagaccaacaatgacattacctccattgctagcaacggtgg

SEQ ID NO: 667 - DNA, 234 bp, Glycine max
  Clone ID: 700871648H1
gagagacaagtagttgagagctaagaataacgaaatggcttcctcaatgatctcctccccagctgttaccaccgtcaaccgtgccggtgccggcatggttgctccattcaccggcctcagatccatggctggcttccccacgaggaagaccaacaatgacattacctccattgctagcaacggtggaagagtacaatgcatgcaggagtggccaccaattggcaagaagaagtt

SEQ ID NO: 668 - DNA, 271 bp, Glycine max
  unsure (1)...(271): unsure at all n locations
  Clone ID: 700656924H1
cggagaagcaaatggcttcctcaatgatctcntncccagctgttaccactgtcaaccgtgccggtngccggcatggntgctccattcactggcctcaagtccatggctggcttccccaccaggaagacncaacaatgacattanctnncattgctagcancggtggaagagtncaatgcatgcaggagtggccaccagttggcaagaagaagtttgagatctntcctacctnnacagacanaaagntcaaaaaaatggcaaaggaatagaa

SEQ ID NO: 669 - DNA, 192 bp, Glycine max
  Clone ID: 700743814H1
agaagaacaagtagttgagaactaagaaggagaagcaaatggcttcctcagtgatctcttccccagctgttaccactgtcaaccgtgccggtgccggcatggttgctccattcactggcctcaagtccatggctggcttccccaccagaaagaccaacaatgacattacctccattgctagcaacggtggaa

SEQ ID NO: 670 - DNA, 192 bp, Glycine max
  unsure (1)...(192): unsure at all n locations
  Clone ID: 700995036H1
agaacaagtagttgagaactaagaaggagaagcaaatggcttcctcaatgatctcttccccagctgttaccantgtcaaccgtgccggtgccggcatggttgctccattcactggcctcaagtccatggctggcttccccaccagaaagaccancaatgacatnacctccattgctagcaacggtggaagag

SEQ ID NO: 671 - DNA, 258 bp, Glycine max
  unsure (1)...(258): unsure at all n locations
  Clone ID: 700991405H1
gaacaagtagttgagaactaagaaggagaagcaaatggcttcctcaatgatctcttccccagctgttaccactgttcaaccgtgccggtgccggcatggttgctccattcactggcctcaagtccatggctggcttccccaccaganagaccaacaatgacattncctccattgcctagcaacggtggaanagtccaatgcntgcaggtttgcccnccantnggnaaagaagaaatntncngacnnntgccccnccgg

SEQ ID NO: 672 - DNA, 259 bp, Glycine max
  Clone ID: 700741463H1
aagtagttgcgtactaagaaggagaagcacgtggcttcctcaatgatctcttccccagctgttaccactgtcaaccgtgccggtgccggcatggttgctcctccattgcctcaagtccatggctggcttccccaccagagagaccaacgatgacattacctccattgctatcaacggtggaagagtgcaatgcatgcaggtgtggccaccagttggcaagacgaagtttgagactctgtcctacctgccagaccttgat

SEQ ID NO: 673 - DNA, 259 bp, Glycine max
  Clone ID: 700870507H1
gaacaagtagttgagaactaagaaggagtagcaaatggcttcctcaatgatctgcttcctcagctgttaccactgtcaaccgtgccggtgccggcatggtggctccattcactggcctcaagtccatggctggcttccccccagaaagaccaacaatgacattacctccattgctagcaacggtggaagagtgcaatgcatgcaggtgtggccacctgttggcaagtagaagtttgagactctttcctacctgccagac

SEQ ID NO: 674 - DNA, 264 bp, Glycine max
  Clone ID: 701123032H1
tggcttcctcaatgatctcttccccagctgttaccactgtcaaccgtgccggtgccggcatggttgctccattcgctggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagagtaccttc

SEQ ID NO: 675 - DNA, 247 bp, Glycine max
  Clone ID: 700946185H1
gcagaagaacaagtagttgagaacaaagaaggagaagcaaatggcatcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttgggcaagaagaagtttgagac

SEQ ID NO: 676 - DNA, 244 bp, Glycine max
  unsure (1)...(244): unsure at all n locations
  Clone ID: 700994265H1
aacaagtagttgagnnctaagaaggagaagcaaatggcttcctcaatgatctcttccccagctgttaccactgtacaaccgtgccggtgccggcatggttgctccattcactgnctcaagtccatggctggcttccccaccaggaagaccaacaatgacattacctccattgctagcaacggtggaagagtgcaatgcatgcaggtgtggccaccagttggcaagaagaagtttgagatctttc

SEQ ID NO: 677 - DNA, 193 bp, Glycine max
  Clone ID: 700742553H1
gttgagaactaagaaggagaagcaaatggcttcctcaatgattgcctccccatctgttaccactgtcaaccgtgccggtgccggcatggttgctccattcactggcctcaagtccatggctggcttccccaccagaaagaccaacaatgacattacctccattgctagcaacggtggaagagtgcaatgcatg

SEQ ID NO: 678 - DNA, 262 bp, Glycine max
  unsure (1)...(262): unsure at all n locations
  Clone ID: 700655130H1
agcaaatggcttcctcantgatctcttccccanctgttaccactntcaaccgtgccggtgccngcatgnttgctccattcactgncctcaagtccatggctgtcttccccnccagananaccannaatganattacctccattgctagcaaccgttggaagantgcaatgcaggcnntgtggcnaccagtnggcaagaagaattttgagantctttccgacctnnnagannttgntgatgcncnntgggcagantaagtngt

SEQ ID NO: 679 - DNA, 259 bp, Glycine max
  unsure (1)...(259): unsure at all n locations
  Clone ID: 700656978H1
ggcctcaagtccatggcnggcttccccaccaggaagaccaacaatgacattacctccattgctagcaacggtggaagagtgcantgcatgcaggtgtggccaccagttggcaagaagaagtttgagactctttcctacctgccagaccttgatgatgcacaattggccaaaggaagtagaataccttcttaggaagggatggattccttgcttggantcgagttggagcaggtnannnaaaancgtgagcacaacagtc

SEQ ID NO: 680 - DNA, 189 bp, Glycine max
  Clone ID: 700743939H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaag

SEQ ID NO: 681 - DNA, 191 bp, Glycine max
  Clone ID: 700742580H1
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagag

SEQ ID NO: 682 - DNA, 218 bp, Glycine max
  unsure (1)...(218): unsure at all n locations
  Clone ID: 700872884H1
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagatagaccccaaatganattacntcnattgctagnaactgtggaagagtgcaatgcatgnaggtgtggcca

SEQ ID NO: 683 - DNA, 276 bp, Glycine max
  Clone ID: 701157394H1
acggctgcgagaagacgacagaaggggggcagcagaagaacaagtagttgagaactaagaaggagaagcgaatgggctcctcaatgatctctttcccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgaga

SEQ ID NO: 684 - DNA, 172 bp, Glycine max
  unsure (1)...(172): unsure at all n locations
  Clone ID: 700992046H1
gcagaagaacaagtagttgagaactaagaaggagaagcaaatggcttcctcaatgatctcttccccagctgttaccactgtcaaccgtgccggtgccggcatggttgctccattcactggcctcaagtccatggcnggcttccccaccaggaagaccaacaatgacattacc

SEQ ID NO: 685 - DNA, 245 bp, Glycine max
  Clone ID: 700808471H1
ctacattcccatttgtttttgctttttgagatttcatcatcctgtatttttggtttctgttttcggacttcaatggaaattaatggatgagaactaatgaataagctattgtgttgtgttgctttgtttcaaaataacttcaataacccatcgtccttgcatttctctctaaaaaaaaaaaaaaaaaaaaaaaaaaaaaaaaaaaaaaaaaaagaaaaaaagagagaaaagaagagaaaagaaac

SEQ ID NO: 686 - DNA, 166 bp, Glycine max
  Clone ID: 700992056H1
tagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattg

SEQ ID NO: 687 - DNA, 230 bp, Glycine max
  unsure (1)...(230): unsure at all n locations
  Clone ID: 700975486H1
gaagtngttgagaactaagaaggagaagcaaatggcttcctcaatgatctcttccccagctgttaccactgtcaaccgtgccggtgccggcatggntgcnccattcactggccncaagtccatggntggcttccccaccanaaagaccantantgacattacctccantggctagcaacgntggaagagtgnaatgcggcccacgtgtggccaccagttggcnnnngccg

SEQ ID NO: 688 - DNA, 170 bp, Glycine max
  Clone ID: 700894434H1
aagcaaatggcttcctcaatgatctcttccccagctgttaccactgtcaaccgtgccggtgccggcatggttgctccattcactggcctcaagtccatggctggcttccccaccagaaagagcatcaatgacattacctccattgctagcaacggtggaagattgcaatg

SEQ ID NO: 689 - DNA, 165 bp, Glycine max
  Clone ID: 700992089H1
ccagggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcat

SEQ ID NO: 690 - DNA, 192 bp, Glycine max
  Clone ID: 700744590H1
gcttcatcgcctacaagcccccaggcttctaagtcattgaaaaatttgcaaagcatctgtagccaccccactttgtttgttgtacttaaactacattcccatttgtttttgctttatgagatttcatcatcctgtatttttggtttctgttttcggacttcaatggaaattaatggatgagaactaatgaat

SEQ ID NO: 691 - DNA, 169 bp, Glycine max
  Clone ID: 700787253H2
gtcaaccgtgccggtgccggcatggttgctccattcaccggcctcaaatccatggctggcttccccacgaggaagaccaacaatgagcttacctccattgctagcaacggtggaagagtacaatgcatgcaggtgtggccaccaattggcaagaagaagttcgagactc

SEQ ID NO: 692 - DNA, 172 bp, Glycine max
  Clone ID: 700726279H1
ggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtg

SEQ ID NO: 693 - DNA, 257 bp, Glycine max
  unsure (1)...(257): unsure at all n locations
  Clone ID: 700995242H1
gaacaagtagttgagactaagaagganaagcaaatggcttcctcaatgatctcttccccagctgttaccactgttcaaccgtgccggtgccggcatggttgctccattcactggctcaagtccatggctggcttccccaccaggaagaccaacaatgacattacctccattgctagcaacggtggaagagtgcaatgcatgnggtgtggccaccagttgncaagaaagaagtttgagatccttccnantgcagacct

SEQ ID NO: 694 - DNA, 160 bp, Glycine max
  Clone ID: 700659992H1
attcgagttggagcacggtttcgtgtaccgtgagcacaacaggtcacctggatactatgatggacgctactggaccatgtggaagctgcctatgtttggctgcactgatgcttctcaggtgttgaaggagcttcaagaggctaagactgcataccccaat

SEQ ID NO: 695 - DNA, 160 bp, Glycine max
  unsure (1)...(160): unsure at all n locations
  Clone ID: 700994961H1
caagtagttgagaactaagaaggagaagcaaatggcttcctcaatgatctcttccccagctgttancantgtcaaccgtgccggtgccggcatggttgctccattcactggcctcaagtccatggctggcttccccaccaganagacnaanaatgacatt

SEQ ID NO: 696 - DNA, 189 bp, Glycine max
  Clone ID: 700742875H1
gttgagaactaacaaggagccgcctctggcttcctcaatgatctcttccccagctgttaccactgtcaaccgtgccgttgccggcatggttgctccattcactggcctcaagtccatggctggcttccccaccaggaagaccaacaatgacattacctccattgctagcaacggtggaagagtgcaatg

SEQ ID NO: 697 - DNA, 169 bp, Glycine max
  unsure (1)...(169): unsure at all n locations
  Clone ID: 700995941H1
agaagaacaagtagttganaacnaagaaggagaagcaaatggcttcctcaatgatctcttccccagctgttaccactgtacaaccgtgccggtgccggcatggttgctccattcactggcctcaagtccatggctggcttccccaccagaaagaccaacaatgacatta

SEQ ID NO: 698 - DNA, 184 bp, Glycine max
  Clone ID: 700743887H1
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagc

SEQ ID NO: 699 - DNA, 179 bp, Glycine max
  unsure (1)...(179): unsure at all n locations
  Clone ID: 700656790H1
gcttcatcgcctacaancccccaggcttctaagtcattgaaaaatttgcaaagcatctgtagccaccccactttgtttgttgtacttaaactacattcccatttgtttttgctttatgagatttcatcatcctgtatttttggtntctgttttcggacttcaatggaaattaatggntg

SEQ ID NO: 700 - DNA, 142 bp, Glycine max
  Clone ID: 700902134H1
cggctcgagtgagaactaagaaggagaagcaaatggcttcctcaatgatctcttccccagctgttaccactgtcaaccgtgccggtgccggcatggttgctccattcactggcctcaagtccatggctggcttccccaccag

SEQ ID NO: 701 - DNA, 143 bp, Glycine max
  Clone ID: 700996857H1
gaagaacaagtagttgagaactaagaaggagaagcaaatggcttcctcaatgatctcttccccagctgttaccactgtcaaccgtgccggtgccggcatggttgctccattcactggcctcaagtccatggctggcttcccca

SEQ ID NO: 702 - DNA, 158 bp, Glycine max
  Clone ID: 700685138H1
gaacaagtagttgagaactaagcaggagaagcaaatggcttcctcaatgatctcttccccagctgttaccactgtcaaccgtgccggtgccggcatggtagctccattcactggcctcaagtccatggctggcttccccaccagaaagacgcaacaat

SEQ ID NO: 703 - DNA, 142 bp, Glycine max
  Clone ID: 700738218H1
gacgaacaagtagttgagaactaagaaggagaagcaaatggcttcctcaatgatctcttccccagctgttaccactgtcaaccgtgccggtgccggcatggttgctccattcactggcctcaagtccatggctggcttcccc

SEQ ID NO: 704 - DNA, 134 bp, Glycine max
  Clone ID: 700740869H1
gaactaagaaggagaagcaaatggcttcctcaatgatctcttccccagctgttaccactgtcaaccgtgccggtgccggcatggttgctccattcactggcctcaagtccatggctggcttccccaccaggaag

SEQ ID NO: 705 - DNA, 229 bp, Glycine max
  unsure (1)...(229): unsure at all n locations
  Clone ID: 701002564H1
gaacaagtagttgagaactaagaaggagaagcaaatggcttcctcaatgatctcttccccagctgttaccactgtcaaccgtgccggtgccggcatggttgctccattcactggcctcaagtccatggctggnttccccnaccnaannncccnaacagcaancccccccntntccnnacnnggggcacncnaacacncnggggggnccncccncgcacaaannnttnnc

SEQ ID NO: 706 - DNA, 150 bp, Glycine max
  Clone ID: 700900791H1
gaacaagtagttgagaactaagcaggagaagcaaatggcttcctcaatgatctcttgcccagctgttaccactgtcaaccgtgccggtgccggcatggttgctccattcactggcctcaagtccatggctggcttccccaccaggaagac

SEQ ID NO: 707 - DNA, 282 bp, Glycine max
  Clone ID: 701109964H1
cagctcgagatgagcgtggttggactagcattgaggtaatgagagttgcattctcactgatcgtatacccagctggtacaatgtcaaccgtgccggtgacgcgatgggtgctccattcactggcctcaagtccatggctggcttccccaccaggaagaccaacaatgacattacctccattgctagcaacggtggaagagtgcaatgcatgcaggtgtggccaccagttggcaagaagaaacttgagactctttcctacctgccagaccttgatgatgcaca

SEQ ID NO: 708 - DNA, 219 bp, Glycine max
  unsure (1)...(219): unsure at all n locations
  Clone ID: 700991810H1
agttgagaactaagaaggagaagcaaatggcttcctcaatgatctcttccccagctgttaccactgtcaaccgtggccggtgccggcatggttgctccattcactggcctnaagtccanggctggnttccccacnagggngnccaanngtgatttgccccnnttttnnnancgggngggnattnttnagtgtggggggnggngcctnnttnccgaanna

SEQ ID NO: 709 - DNA, 210 bp, Glycine max
  Clone ID: 700786845H2
tgataagcttctcttggagcttaaaagtattggaatttccccaggcttctaagtgtgaaaaatttgcaaagcatttgtagccgcaaccccactttgtttgtttgtacttaactacattcccatttgtttttgctttttgagatttcatcatcctgtatttttggtttctgttttcggacttcaatggaaattaatggatgagaactaatg

SEQ ID NO: 710 - DNA, 187 bp, Glycine max
  unsure (1)...(187): unsure at all n locations
  Clone ID: 700655630H1
gtgcagtgcatcannttcatcgcctacaagcccccagggcttgctaagtgtgaaaaatttgcaaagcatttgtagccgccaccccactttgtttgtttgtacttaaactacattcccatttgtttttgctttttgagattcatcatcctgtatttttggtttctgttttcggacttcaatggaaatt

SEQ ID NO: 711 - DNA, 120 bp, Glycine max
  Clone ID: 700739315H1
agaagaacaagtagttgagaactaagaaggagaagcaaatggcttcctcaatgatctcttccccagctgttaccactgtcaaccgtgccggtgccggcatggttgctccattcactggcc

SEQ ID NO: 712 - DNA, 254 bp, Glycine max
  Clone ID: 700788023H1
cttgatgatgcacaattggcaaaggaagtagaataccttcttaggaagggatggattccttgcttggaattcgagttggagcacggtttcgtgtaccgtgagcacaacaggtcaccagcttccacatggaccagtagcgtccatcgtagtatcctggtcgacctgtggtgctcatggtacacgctaaggtgctccaggaggttcacagggtactacggtggacgccatggctacgtcggagctgccggtttctg

SEQ ID NO: 713 - DNA, 162 bp, Glycine max
  Clone ID: 700743017H1
agactgcataccccaacggcttcatccgtatcatcggattcgacaacgttcgccaagtgcagtgcatcagcttcatcgcctacaagcccccaggcttctaagtgtgaaaaatttgcaaagcgtttgtagccgcaccccactttgtttgtttgtacttaaact

SEQ ID NO: 714 - DNA, 115 bp, Glycine max
  Clone ID: 700739471H1
caagtagttgagaactaagaaggagaagcaaatggcttcctcaatgatctcttccccagctgttaccactgtcaaccgtgccggtgccggcatggttgctccattcactggcctc

SEQ ID NO: 715 - DNA, 132 bp, Glycine max
  Clone ID: 700740508H1
gaagaacaagtagttgagaactaagaaggagaagcaaatggcttcctcaatgatctcttccccagctgttaccactgtcaaccgtgacggtgccggcatggttgctccattcactggcctcaagtccatggc

SEQ ID NO: 716 - DNA, 157 bp, Glycine max
  Clone ID: 700790942H1
gaacaagtagttgagaactaagaaggagaagcaaatggcttcctcaatgatctcttccccagctgttaccactgtcaaccgtgccggtgccggcatggttgctccattcactggcctcaagtccatggctggctccccaccagaaagaccaacaatg

SEQ ID NO: 717 - DNA, 132 bp, Glycine max
  Clone ID: 700902452H1
agaagaacaagtagttgagaactaagaaggagaagcaaatggcttcctcaatgatctcttccccagctgttaccactgtcaaccgtgccggtgccggcatggttgctccattcactggcctcaagtccatgg

SEQ ID NO: 718 - DNA, 268 bp, Glycine max
  Clone ID: 700658005H1
gtcaggaagaacactggacaaacaggccgtaacagaagcaaacttaaagaaggctggctaccacacatgggaaaaatttctccaccccatatccatgttttttgtagtatggaatattagagagtacggtgccatctatactgaacacaaatgagaacaagtagttgagaactaagaaggagaagcaaatggcttcctcaatgatctcttccccagctgttaccactgtcaaccgtgccggtgccggcatggttgctccattcactgg

SEQ ID NO: 719 - DNA, 112 bp, Glycine max
  Clone ID: 700739396H1
cagaagaacaagtagttgagaactaagaaggagaagcaaatggcttcctcaatgatctcttccccagctgttaccactgtcaaccgtgccggtgccggcatggttgctccat

SEQ ID NO: 720 - DNA, 182 bp, Glycine max
  Clone ID: 700863675H1
ctcgagccgctcgaaccgttgagaactaagaagaaggatatggcttcctcaatgatctcctacccagctgttaccaccgtcaaccgtgccggtgccggcatggttgctccattcaccggcctcaaatccatggctggcttctccacgaggaagaccaacaatgacattacctccattgctag

SEQ ID NO: 721 - DNA, 171 bp, Glycine max
  unsure (1)...(171): unsure at all n locations
  Clone ID: 700657081H1
antngaganctaagaaggagangcaantggcttcctcaatgatctcttccccagctgttaccactgtnaaccgtgncggtgccggcatggttgctccattcagntggcctcaagtccatggctggnttncncncnaganaggncacgnaatgacatnnnctccantgctag

SEQ ID NO: 722 - DNA, 117 bp, Glycine max
  Clone ID: 700743310H1
cgtagttgagaactaagaaggagaagcaaatggcttcctcaatgatctcttccccagctgttaccactgtcaaccgtgccggtgccggcatggttgctccattcactggcctcaagt

SEQ ID NO: 723 - DNA, 110 bp, Glycine max
  Clone ID: 700739139H1
gaacaagtagttgagaactaagaaggagaagcaaatggcttcctcaatgatctcttccccagctgttaccactgtcaaccgtgccggtgccggcatggttgctccattca

SEQ ID NO: 724 - DNA, 114 bp, Glycine max
  Clone ID: 700742781H1
aagtagttgagaactaagaaggagaagcaaatggcttcctcaatgatctcttccccagctgttaccactgtcaaccgtgccggtgccggcatggttgctccattcactggcctc

SEQ ID NO: 725 - DNA, 112 bp, Glycine max
  Clone ID: 700742729H1
tagaagaacaagtagttgagaactaagaaggagaagcaaatggcttcctcaatgatctcttccccagctgttaccactgtcaaccgtgccggtgccggcatggttgctccat

SEQ ID NO: 726 - DNA, 115 bp, Glycine max
  Clone ID: 700740842H1
agaacaagtagttgagaactaagaaggagaagcaaatggcttcctcaatgatctcttccccagctgttaccactgtcaaccgtgccggtgccggcatggttgctccattcactgg

SEQ ID NO: 727 - DNA, 175 bp, Glycine max
  Clone ID: 700730732H1
actcgctccgaactaagaaggagaagcaaatggcttcctcaatgatctcttccccagctgttaccactgtcaatcgtgccggtgccggcatggttgctccattcactggcactaagtccatggctggcttccccaccagaaagaccaacaatgcacatttacactccgattgcta

SEQ ID NO: 728 - DNA, 106 bp, Glycine max
  Clone ID: 700742728H1
tttgttgtacttaaactacattcccatttgtttttgctttatgagatttcatcatcctgtatttttggtttctgttttcggacttcaatggaaattaatggatgag

SEQ ID NO: 729 - DNA, 98 bp, Glycine max
  Clone ID: 700845311H1
caagtagttgagaactaagaaggagaagcaaatggcttcctcaatgatctcttccccagctgttaccactgctcaacgtgccggtgccggcatagttg

SEQ ID NO: 730 - DNA, 173 bp, Glycine max
  Clone ID: 700874150H1
attcggctcgagcgcgacggccgccctttttttttttgtacttaaactacattcccatttgttttacgctttatgagatttcatcatcctgtatttttggtttctgttttcggacttcaatggaaattaatggatgagaactaatgaataaaaaaaaaaaaaaggggggcccc

SEQ ID NO: 731 - DNA, 94 bp, Glycine max
  Clone ID: 700958782H1
ccatttgtttttgctttttgagatttcatcatcctgtatttttggtttctgttttcggacttcaatggaaattaatggatgagaactaatgaat

SEQ ID NO: 732 - DNA, 90 bp, Glycine max
  Clone ID: 700729671H1
gaacaagtagttgagaactaagaaggagaagcaaatggcttcctcaatgatctcttccccagctgttaccactgtcaaccgtgccggtgc

SEQ ID NO: 733 - DNA, 96 bp, Glycine max
  unsure (1)...(96): unsure at all n locations
  Clone ID: 700989477H1
aaatggcttcctcaangatctcttccccagctgttaccactgtcaaccgtgccggtgccggcatggttgctcccattcactggcntcaagtccatg

SEQ ID NO: 734 - DNA, 102 bp, Glycine max
  Clone ID: 700790532H2
gttgagaactaagaaggagaagcaaatggcttcctcaatgatctcttccccagctgttaccactgtcaaccgtgccggtgccggcatggttgctccattcac

SEQ ID NO: 735 - DNA, 91 bp, Glycine max
  Clone ID: 700895830H1
ctcgagccgggcaaaggaagtagaataccttcttaggaagggatggattccttgcttggaattcgagttggagcacggtttcgtgtaccgt

SEQ ID NO: 736 - DNA, 107 bp, Glycine max
  Clone ID: 700560643H1
cttaaactacattccccatttgtttttgctttttgagatttcatcatccctgtatttttggtttctgttttcggacttcaatggaaattaatggatgagaactaatg

SEQ ID NO: 737 - DNA, 118 bp, Glycine max
  unsure (1)...(118): unsure at all n locations
  Clone ID: 700559990H1
cagaagaacaagtagttgagaactangaaggagaagcaaatggcttcctncaatgatctacttccccanctgttaccactgtgcaaccgtntccggtgccggcatggttntccccatt

SEQ ID NO: 738 - DNA, 79 bp, Glycine max
  Clone ID: 700895956H1
cgagatttcatcatcctgtatttttggtttctgttttcggacttcaatggcaattaatggatgagaactaatgaataag

SEQ ID NO: 739 - DNA, 117 bp, Glycine max
  Clone ID: 700680886H1
ggctcgaggcagaagaacaagtagttgagaactaagaaggtcaagcccactggctcctcaatgatctcttccccagctgttaccactgtcaaccgtgccggtgccggcatggttgct

SEQ ID NO: 740 - DNA, 77 bp, Glycine max
  Clone ID: 700738267H1
gttgagaactaagaaggagaagcaaatggcttcctcaatgatctcttccccagctgttaccactgtcaaccgtgccg

SEQ ID NO: 741 - DNA, 95 bp, Glycine max
  Clone ID: 700741928H1
caccagttggcaagaagaagtttgagactctttcctacctgccagaccttgatgatgcacaattggcaaaggaagtagaataccttcttaggaag

SEQ ID NO: 742 - DNA, 100 bp, Glycine max
  Clone ID: 700657321H1
gaagaccaacaatgacattacctgccattgctcagcaacggtggaagagtgcaatgcatgcaggtgtggccaccagttgggcaagaagaagtttgagact

SEQ ID NO: 743 - DNA, 134 bp, Glycine max
  Clone ID: 700742542H1
gaagaacaagtagttgagaactaagaaggagaagctaatggcttcctcaatgatctcttccccagctgttaccactgtcaaccgtgccggtgccggcatggttgctccattcactggcctcaagtccatggctg

SEQ ID NO: 744 - DNA, 82 bp, Glycine max
  Clone ID: 700789463H2
cagaagaacaagtagttgagaactaagaaggtgaagcaaatggcttcctcaatgatctcttccccagctgttaccactgtca

SEQ ID NO: 745 - DNA, 257 bp, Glycine max
  unsure (1)...(257): unsure at all n locations
  Clone ID: 700998406H1
ccaattganattttaaaaatgactgggnataaacttaaganttcaattattgaaattgaataagtaaacnatttaattggattngtcgaatggtatcaaaaaaatggagtactaactcccatttcttatttatattgaattaaccgatcaacttgctttgtcatcgaacatttctttttgatttcaaaaattttccggaaaanattntgaatctatttttatatgcgaatcaatcctactacttctggccctgaggt

SEQ ID NO: 746 - DNA, 248 bp, Glycine max
  Clone ID: 700733345H1
attttatccaattgaaattttaaaaatgactgggataaacttaagaattcaattattgaaattgaataagtaaacaatttaattggattggtcgaatggtatcaaaaaaatggagtactaactcccatttcttatttattattgaattaaccgatcaacttgctttgttatcgaacatttctttttgatttcaaaaattttccggaaaaaatttgaatctatttttatatgcgaatcaatcctactac

SEQ ID NO: 747 - DNA, 257 bp, Glycine max
  Clone ID: 700681456H2
aattgaaattttaaaaatgactgggataaacttaaaaattcaattattgaaattgaataagtaaacaatttaattggattggtcgaatggtatcaaaaaaatggagtactaactcccatttcttatttattttgaattaaccgatcaacttgctttgttatcgaacatttctttttgatttcaaaaattttccggaaaaaatttgaatctatttttatatgcgaatcaatcctactacttctggtcctgaggtttct

SEQ ID NO: 748 - DNA, 143 bp, Glycine max
  unsure (1)...(143): unsure at all n locations
  Clone ID: 700992806H1
ttananatgactggganaaacttaaganttnaattattgaaattgaanaagtaaacaatttaattggattggtcgaatggtanccnaaaaatggagtntaactcccantncttatttattatngaattacccgntcacttgnt

SEQ ID NO: 749 - DNA, 293 bp, Glycine max
  Clone ID: LIB3055-001-Q1-B1-G3
tggtaactgcctacgtttggctgcactgaagcttctcaagtgttgaaggagcttcaagaagctaaagacgcataccccaacggcttcaaccgtatcatcgggttcgacaacgttcgccaaatgcagtgcaacagcttcatcgcctacaaggccccatgcttctaagtgtgaaaaatttgcaaagcatttgtagccgccaccccactttgcttgtttggacctaaactacattcccacttgtttttgcgttttgagatttcatcatcctgtatttttggtttctgttttccgac

SEQ ID NO: 750 - DNA, 276 bp, Glycine max
  Clone ID: LIB3055-001-Q1-B1-H4
cgctcagcaatgctcccaagatctctcccagcgttacaacgtcaacgtcccgtgccggcattgttgctccattcacttggcccaagtccatggctggcttccccatcaggaagaccaacaatgacattacctccattgctagcaacggtggaagagtgcaatgcatgcatgtgtggccaccagttggcaagaagaagtttgagactctttcctacctgccagaccttgatgatgcacaattggcaaatgaagtagaataccttcttaggaagggat

SEQ ID NO: 751 - DNA, 464 bp, Glycine max
  unsure (1)...(464): unsure at all n locations
  Clone ID: LIB3055-012-Q1-N1-H2
gtagttgagaactaagaaggagaaccaaatgggtttcttcaatggactgtttcccagctggntacccactggtcaaaccgtgcccggtgcccggcattgggtgcttccattcactggccctcaaagttccatggcttgggctttcccacccaggaaagacccaaccatgacattaccttcattgntagcaaccgtggnagagtgcaatgcatgcangtgtgggcaccagtttggcaagaagaaatttgagactcttttcctaacctggcagacctttgatgatgcnccaattggcaaaagaaggtngaataccctttcttaaggaaaggggatggattncttgcnttggnaantcgagttggagcaccggttcgtgtacccgtgagcacaacaggtcanccaaggatacttcgatggacgctnctgggancatgttggaanctggcctatggttggggtgcccc

SEQ ID NO: 752 - DNA, 219 bp, Glycine max
  Clone ID: LIB3050-005-Q1-K1-D5
acccactcgtccggctgcgagaatacgactagaagggttcttctgcgataagactacagaatgtgatgcacgattttcaaaggaagttgagtaccttcttaagaaaggatggattccttgcttggaattctattttgatcacggtttcatgtaccgtgtacacaacaagtcacctatatactactattgactctactggaccatgtgtaatctgcctat

SEQ ID NO: 753 - DNA, 230 bp, Glycine max
  Clone ID: LIB3073-001-Q1-K1-F7
ggagaatgggatctggcagcagaaaaacaagtagtttagaactaataagaaggaaatggctttcctcaatgattctcctccccagctgttaccaccgtcaaccgtgccggtgccgcatggttgttccattaaccggcctcaaatccatggctggcttccccacgaggaagaccaacattgactttacctcaatggttagcaccggtgaaagagtacaatgcatgcaggtg

SEQ ID NO: 754 - DNA, 240 bp, Glycine max
  Clone ID: LIB3073-001-Q1-K1-H6
gaatgtcatcacttattcaatccaacggttgtaactggtcagcaaccaatcccctccatttcacaccatcggattagtactacacaaatcacactattatatatagtaagcttgagcagaagcttggatatctggcagcagaagaacaagtagttgagaactaagtacgagaaacatatggcttcctcaatgatctcttacccagctgataccactgtcaacccgtgcggtgccagcatg

SEQ ID NO: 755 - DNA, 293 bp, Glycine max
  unsure (1)...(293): unsure at all n locations
  Clone ID: LIB3073-023-Q1-K1-A11
ctatgccgtgtcttcctttgnaatgnnatnacatnatctgacgctcccgaatttaactggcggattcatccatccgtcttaccgatgacgaaaactacagttttggatttttacctgcataaaaacaattcagttataggtcaaaacaaagaaattgctttctcaatgatcttctacccaacttttaccaccttaaaccgtgccctttcccgcattgtttctccattcacctgtcttaaattcatcgcttgctttcccaccaggaagacccacaattacattacctccatttc

SEQ ID NO: 756 - DNA, 403 bp, Glycine max
  Clone ID: LIB3055-005-Q1-N1-D8
aagtagttgagaactaagaaggagaagcaaatggcttcctgagtgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacgggttcgtgtaccgtgagcacaacaggtcaccaggatactacgatggacgctactggaccatgt

SEQ ID NO: 757 - DNA, 397 bp, Glycine max
  Clone ID: LIB3073-023-Q1-K1-C6
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatac

SEQ ID NO: 758 - DNA, 423 bp, Glycine max
  Clone ID: LIB3073-013-Q1-K1-A5
gggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaag

SEQ ID NO: 759 - DNA, 415 bp, Glycine max
  Clone ID: LIB3055-007-Q1-N1-E4
ttgagaactattaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttg

SEQ ID NO: 760 - DNA, 387 bp, Glycine max
  Clone ID: LIB3055-009-Q1-N1-A9
tgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaagatactacgatggacgctact

SEQ ID NO: 761 - DNA, 411 bp, Glycine max
  Clone ID: LIB3055-008-Q1-N1-C9
caagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagct

SEQ ID NO: 762 - DNA, 443 bp, Glycine max
  Clone ID: LIB3030-009-Q1-B1-G2
gcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaatgaagtagaataccttcttaggaaagggatgattccttgcttggaattcgagttggagcacggtttcgtgtaccgtgagcacaacatgtcaccaggatactacgatggacgctactggaccatgtggaagctgcctatgtttggttgcactgatg

SEQ ID NO: 763 - DNA, 454 bp, Glycine max
  Clone ID: LIB3040-002-Q1-E1-A4
tacggctgagagaagacgacagaagggggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaagaagggatggattccttgcttggaaatcgagttggagcacggtttcgtgtaccgtgagcacaacaggtcaccaggatactacgatggacgctactggaccatgtggaagctgcc

SEQ ID NO: 764 - DNA, 408 bp, Glycine max
  Clone ID: LIB3073-023-Q1-K1-E8
gggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccgccagttggcaagaagaagtttgagactctttcctacctgccagaccttgatgatgcacaattggcaaaggaagtagaataccttcttaggaagggatggattccttgcttggaattcgagttggagcacgggttcgtgtaccgtgagcacaacaggtcaccaggatactacgatgggcgctac

SEQ ID NO: 765 - DNA, 426 bp, Glycine max
  Clone ID: LIB3073-006-Q1-K1-E8
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaa

SEQ ID NO: 766 - DNA, 406 bp, Glycine max
  Clone ID: LIB3053-010-Q1-N1-E7
aacaagtagttgagaactaagaaggagaagcaaatggcgtcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgt

SEQ ID NO: 767 - DNA, 422 bp, Glycine max
  Clone ID: LIB3073-024-Q1-K1-H4
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgt

SEQ ID NO: 768 - DNA, 416 bp, Glycine max
  Clone ID: LIB3055-008-Q1-N1-A7
aagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggattcgtgtaccgtgagcacaacaggtcaccaggatactacgatggacgctactggaccatgtggaagctggctat

SEQ ID NO: 769 - DNA, 422 bp, Glycine max
  Clone ID: LIB3073-001-Q1-K1-B10
gatctggcagcagaagaacaagtagttgagaactgagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgt

SEQ ID NO: 770 - DNA, 371 bp, Glycine max
  Clone ID: LIB3055-013-Q1-N1-B2
agaagaacatgtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaac

SEQ ID NO: 771 - DNA, 375 bp, Glycine max
  Clone ID: LIB3073-002-Q1-K1-C1
ggcagcagaagaacaagtagttgagaactaagagggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaagaagtagaataccttcttaggaagggatggattccttgcttggaattcgagttggagcacggtttcgtgtaccgtgagcaca

SEQ ID NO: 772 - DNA, 423 bp, Glycine max
  Clone ID: LIB3073-013-Q1-K1-F11
gatctggcagcagaagaacaagtaggggagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaagaagggatggattccttgcttggaattcgagttggagcacggtttcgtgtaccgtgagcacaacaggtcaccaggatactacgatggacgctactggaccatgtg

SEQ ID NO: 773 - DNA, 406 bp, Glycine max
  Clone ID: LIB3073-022-Q1-K1-A11
gagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctact

SEQ ID NO: 774 - DNA, 418 bp, Glycine max
  Clone ID: LIB3073-026-Q1-K1-G9
gatctggcagcagaagaacaagtagttgagaactgggaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggacc

SEQ ID NO: 775 - DNA, 414 bp, Glycine max
  Clone ID: LIB3073-026-Q1-K1-F9
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactg

SEQ ID NO: 776 - DNA, 410 bp, Glycine max
  Clone ID: LIB3073-024-Q1-K1-A10
gtggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgcggccaccagttggcaagaagaagtttgagactctttcctacctgccagaccttgatgatgcacaattggcaaaagaagtagaataccttcttaggaagggatggattccttgcttggaattcgagttggagcacggtttcgtgtaccgtgagcacaacaggtcaccaggatactacgatggacgctact

SEQ ID NO: 777 - DNA, 440 bp, Glycine max
  Clone ID: LIB3073-012-Q1-K1-D7
cgagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaaaggatggattccttgcttggaattcgagttggagcacggtttcgtgtaccgtgagcacaacaggtcaccaggatactacgatggacgctactggacccatgtg

SEQ ID NO: 778 - DNA, 449 bp, Glycine max
  Clone ID: LIB3049-013-Q1-E1-B3
cgtccatacggatgcgagaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaagaagggatggattccttgcttgggattcgagttggagcacggtttcgtgtaccgtgagcacaacaggttcaccagatactacgatggacgctactgga

SEQ ID NO: 779 - DNA, 364 bp, Glycine max
  Clone ID: LIB3053-014-Q1-N1-F9
gaacaagtagttgagaactaagaaggagaagcaaatgggttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaagaagtagaataccttcttaggaagggatggattcctttgcttggaattcgagttggagcacggtttcgtgtaccgtgagca

SEQ ID NO: 780 - DNA, 396 bp, Glycine max
  Clone ID: LIB3054-003-Q1-N1-G12
taagaaggagaagcaaatggcttcctcaatgatctgttccgcagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagct

SEQ ID NO: 781 - DNA, 408 bp, Glycine max
  Clone ID: LIB3053-001-Q1-B1-B3
agaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctttaacccct

SEQ ID NO: 782 - DNA, 384 bp, Glycine max
  Clone ID: LIB3027-005-Q1-B1-F12
ctaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactgga

SEQ ID NO: 783 - DNA, 388 bp, Glycine max
  Clone ID: LIB3054-001-Q1-B1-E6
ttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcactgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctact

SEQ ID NO: 784 - DNA, 401 bp, Glycine max
  Clone ID: LIB3055-007-Q1-N1-G11
gaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactgga

SEQ ID NO: 785 - DNA, 403 bp, Glycine max
  Clone ID: LIB3073-026-Q1-K1-D12
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggccggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaagtcaccaagatactacgat

SEQ ID NO: 786 - DNA, 372 bp, Glycine max
  Clone ID: LIB3053-009-Q1-N1-C6
gatctcttccccagctgttaccactgtcaaccgtgccggtgccggcatggttgctccattcactggcctcaagtccatggctggcttccccaccaggaagaccaacaatgacattacctccattgttagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctat

SEQ ID NO: 787 - DNA, 403 bp, Glycine max
  Clone ID: LIB3073-013-Q1-K1-C1
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgat

SEQ ID NO: 788 - DNA, 425 bp, Glycine max
  Clone ID: LIB3073-006-Q1-K1-F6
gatctggcagcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctgaggaaaggatggattccttgcttggaattcgagctggagcacggtttcgtgtaccgtgagcacaacaggtcacctggatactatgatggacgctactggaccatgtggaagc

SEQ ID NO: 789 - DNA, 284 bp, Glycine max
  Clone ID: LIB3073-011-Q1-K1-A12
gatttggcagcagaagaacaagtagttgagaacgaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaagtgtggccaccagttggcaagaagaagtttgagactctttcctacctgccagaccttgatgatg

SEQ ID NO: 790 - DNA, 404 bp, Glycine max
  Clone ID: LIB3073-007-Q1-K1-B9
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaagtcaccaaggatactacgat

SEQ ID NO: 791 - DNA, 458 bp, Glycine max
  unsure (1)...(458): unsure at all n locations
  Clone ID: LIB3055-005-Q1-N1-G4
tcgagcggattcgcttgtcttggatatttcgagtatggagccacggttgtcgtggtgaccgtgagtcacaacgaggtcaccagtgatacctacgatggacgcttactggaccatgtcggaagctgcactatgttatggttgcacctgatgcattctcaaggtgttgaagagagccttcaaagaggcttaagactggcatactcccaacgtgcttcattccgtatcatcnggattcgacaacggttcgccaagtgcagtgcatcagcttcatcgtctacaagcccccaggcttctaagtgtgaaaaatttgcaaagcattagtagccgncaccccactttgtttgtttgtacttaaactacattcccatttgtatttgctttctgagatttcatcatcctgtatttttggattctggaatcggactttaatggacattaatggatgagaactaatgaat

SEQ ID NO: 792 - DNA, 395 bp, Glycine max
  Clone ID: LIB3073-006-Q1-K1-F5
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggat

SEQ ID NO: 793 - DNA, 423 bp, Glycine max
  Clone ID: LIB3073-022-Q1-K1-B9
gatatctggcagcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagttggagcacggtttcgtgtaccgtgagcacaacaggtcacctggatactatgatggacgctactggaccatgtgg

SEQ ID NO: 794 - DNA, 419 bp, Glycine max
  unsure (1)...(419): unsure at all n locations
  Clone ID: LIB3073-024-Q1-K1-F3
gatctggcagcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccagttggcaagaagaagttcgagactctntcctacttgccagacctcgatgatgcccatttggcaaaggaagtcgaataccttctaaggaaaggatggattccttgcttggaattcgagttggagcacggtttcgtgtaccgtgagcacaacaggtcacctggatactatgatggacgctactggaccatgt

SEQ ID NO: 795 - DNA, 505 bp, Glycine max
  unsure (1)...(505): unsure at all n locations
  Clone ID: LIB3073-026-Q1-K1-E6
tcgtacgagcttgcgagaaggacgatcagaaggggggatcttggcagcaggaagaacagagtgagttgagaggcgtaagaagggntngaagcaaatgggcttcctttcaatgagtnnntcttccccagcttggttaccacttggtcaaccgttgccggttgccgtgcatggttggcttccattcaactggcnnctcaagtccaaatggctgnngcttccccaaccannggaagactcanacatatggaccattnaacctccatttgctaagcaacccgggggaaagaagtgcannnatgcattgcaaggtgtgggccactcaaagtttggcaagaaagaaaagtttgaagaactcttttccttaacctggccagaaaccttgatgaaatgcacaannttggcaaaggannagtagaataccccttcttaggaaggggatnnggattccttgctttggaaaattcgagttggagcacggggttnncgtgtacccgttgagcacaac

SEQ ID NO: 796 - DNA, 413 bp, Glycine max
  unsure (1)...(413): unsure at all n locations
  Clone ID: LIB3073-025-Q1-K1-F3
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctncattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctact

SEQ ID NO: 797 - DNA, 409 bp, Glycine max
  unsure (1)...(409): unsure at all n locations
  Clone ID: LIB3073-024-Q1-K1-B5
gatctggcagcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctntcctacttgccagacctcgatgatgcccaattggcaaaggaagtcgaataccttctaaggaaaggatggattccttgctcggaattcgagttggagcacggtttcgtgtaccgtgagcacaacatgtcacctggatactatgatggacgctac

SEQ ID NO: 798 - DNA, 392 bp, Glycine max
  Clone ID: LIB3053-010-Q1-N1-A2
agaagtttgagactctttcctacctgccagaccttgatgatgcgcaattggcaaaagaagtagaataccttcttaagaagggatggattccttgcttggaattcgagttggagcacggtttcgtgtaccgtgagcacaacaggtcaccaggatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttttaagtgtgaaaaaattgcaaagcatttgtaagccgcaccccaatttggttg

SEQ ID NO: 799 - DNA, 399 bp, Glycine max
  Clone ID: LIB3073-007-Q1-K1-F1
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaagtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatacta

SEQ ID NO: 800 - DNA, 391 bp, Glycine max
  Clone ID: LIB3055-008-Q1-N1-E12
gaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtccaataccttctaaggaaaggatggattccttgcttggaattcgagttggagcacggtttcgtgtaccgtgagcacaacaggtcacctggatactatgatgga

SEQ ID NO: 801 - DNA, 350 bp, Glycine max
  Clone ID: LIB3073-001-Q1-K1-B7
gatctggcagcagaagaacaagtggttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagt

SEQ ID NO: 802 - DNA, 414 bp, Glycine max
  Clone ID: LIB3039-004-Q1-E1-F7
tacggctgcgagaagacgacagaaggggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaagtcaacaag

SEQ ID NO: 803 - DNA, 398 bp, Glycine max
  Clone ID: LIB3053-006-Q1-N1-D9
agaagaacaagtagttgagaactaagaaggagaagcaaagggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgc

SEQ ID NO: 804 - DNA, 421 bp, Glycine max
  Clone ID: LIB3039-021-Q1-E1-A3
gatgcgacaatacgacagaaagggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcctgggaatccaatttggagcacggtttcgtgtaccgtgagcacaacaggtcaccaggatac

SEQ ID NO: 805 - DNA, 380 bp, Glycine max
  Clone ID: LIB3053-001-Q1-B1-D4
agaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagttggagcacggtttcgtgtaccgtgagcacaacaggtcacctggatactatgatggacgctactggaccatg

SEQ ID NO: 806 - DNA, 416 bp, Glycine max
  Clone ID: LIB3039-046-Q1-E1-E5
acgtacggctgcgagaagacgacagaaggggggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaagaagggatggattccttgcttggaattccaagttggagcacggtttcgtgtaccgtgagcacaacaggtcac

SEQ ID NO: 807 - DNA, 291 bp, Glycine max
  Clone ID: LIB3073-007-Q1-K1-B2
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaatt

SEQ ID NO: 808 - DNA, 348 bp, Glycine max
  Clone ID: LIB3073-023-Q1-K1-C3
gatctggcagcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtccgataccttctaaggaaaggatggattccttgcttggaattcgagtt

SEQ ID NO: 809 - DNA, 437 bp, Glycine max
  unsure (1)...(437): unsure at all n locations
  Clone ID: LIB3055-002-Q1-B1-E1
gcagaaaaacaagtagttgagaactaagaagaaggaaatggcttcctcaatgatctcctctccagctgttaccaacgtcaaccgtgccggtgccgggatggttgctccattcagcggactcaaatccatggctggcttccccacgaggaagaccaacaatgacattagctccattgctagcaacggtggaagagtacaatgcatgcacgtgtggccaccaattggcaagaagaagttcgagactctttcctacttgccagacctcgatgatgctcaattggcaaatgaagtcgaataccttctaaggaaaggatggattccttgcttggaattcgagttggagcacggtttcgtgtnacgtgagcacaacaggtcacctggatactatgatggacgctactggaccatgttgaagctgctatgtttggctgcactga

SEQ ID NO: 810 - DNA, 408 bp, Glycine max
  Clone ID: LIB3073-025-Q1-K1-H8
ggcagcagaagaacaagtagttgagaactaagaaggagaagcaaatggctccctcaatgatctcttccccagctgttaccactgtcaaccgtgccggtgccggcatggttgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctact

SEQ ID NO: 811 - DNA, 407 bp, Glycine max
  Clone ID: LIB3039-030-Q1-E1-H9
tacggctgcgagaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttggagcacggtttcgtgtaccgtgagcaca

SEQ ID NO: 812 - DNA, 397 bp, Glycine max
  Clone ID: LIB3055-008-Q1-N1-H4
gaagaacaagttgttgagaactaagaaggagaagcaaatggcttgctcaatgatctctttcccagctgttaccactgtcaaccgtgccggtgccggcatggttgctccattcactggcctcaagtccatggctggcttacccaccagaaagaccaacaatgacattacctgcattgctagcaactggggaagagtgcaatgcatgcaagtgtggccaccagttggcaagaagaagtttgagactctttactacctggcagaccttgatgatgcacaatcggcataggaagtagaataccttcttaggaagggatggattccttgcttggaattcgagttggaacacggtttcgtgtaccgtgagcacaacaagtcaccaggatactacgatggacgc

SEQ ID NO: 813 - DNA, 354 bp, Glycine max
  Clone ID: LIB3054-011-Q1-N1-A1
aaggaagtcgaataccttctaaggaaaggatggattccttgcttggaattcgagttggagcacggtttcgtgtaccgtgagcacaacaggtcacctggatactatgatggacgctactggaccatgtggaagctgcctatgtttggctgcactgatgcttctcaggtgttgaaggagcttcaagaggctaagactgcataccccaatggcttcatccgtatcattggatttgacaacgttcgccaagtgcagtgcatcagcttcatcgcctacaagcccccaggcttctaagtcattgaaaaatttgcaaagcatctgtagccaccccactttgtttgttgtacttaaactaca

SEQ ID NO: 814 - DNA, 388 bp, Glycine max
  Clone ID: LIB3073-025-Q1-K1-D2
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttactcaccagaaagaccaacaatgacattacctccattgctagcaacggtggaagagtgcaatgcatgcaggtgtggccaccagttggcaagaagaagtttgggactctgtcctacctgccagaccttgatgatgcacaattggcaaaggaagtagaataccttcttaggaagggatggattccttgcttgaaattcgagttggagcacggtttcgtgtaccgtgagcacaacaggtca

SEQ ID NO: 815 - DNA, 356 bp, Glycine max
  Clone ID: LIB3073-025-Q1-K1-G3
catgatactacgatggacgctactggaccatgtggaagctgcctatgtttggttgcactgatgcttctcaggtgttgaaggagcttcaagaggctaagactgcataccccaacggcttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgcacttaaactacattcccatttgtttttgctttttgagatttcatcatcctgtatttttggtttctgttttcggacttcaatggaaattaatggatgagaactaatg

SEQ ID NO: 816 - DNA, 350 bp, Glycine max
  Clone ID: LIB3053-002-Q1-B1-H2
aagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccacgagttggcaagaagaagtttgagactctttcctacctggcagaccttgatgatgcacaattggcaaaggaagtagaataccttcttaggaagggatggattccttgcttggaattcgagttggagcacggtttcgtgta

SEQ ID NO: 817 - DNA, 349 bp, Glycine max
  Clone ID: LIB3073-013-Q1-K1-F6
gggcagcagaagaacaagtagttgagaactaagaaggagaagcaaatggcttcctcaatgatctcttccccagctgttaccactgtcaaccgtgccggtgccggcatggttgctccattcactggcctcaagtccatggccggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttgg

SEQ ID NO: 818 - DNA, 400 bp, Glycine max
  Clone ID: LIB3073-025-Q1-K1-B10
gatctggcagcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgccagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagttggagcgcggtttcgtgtaccgtgagcacaacaggtcacctggatactatgat

SEQ ID NO: 819 - DNA, 353 bp, Glycine max
  Clone ID: LIB3073-023-Q1-K1-D3
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttgg

SEQ ID NO: 820 - DNA, 335 bp, Glycine max
  Clone ID: LIB3054-011-Q1-N1-G1
aagtagttgtagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttgg

SEQ ID NO: 821 - DNA, 404 bp, Glycine max
  Clone ID: LIB3073-024-Q1-K1-H12
tacggctgcgagaagacgacagaagggtaccggtgcggggagaccaccaaatgggggccgcagaagaaccagtagttgagaactaagaaggagaagcaaatggcttcctcaatgatctcttccccagctgttaccactgtcaaccgtgccggtgccggcatggatgctccattcactggcctcaagtccatggctggcttccccaccaggaagaccaacaatgacattacctccattgctagcaacggtggaagagtgcaatgcatgcaggtgtggccaccagttggcaagaagaagtttgagactctgtcctacctgccagaccttgatgatgcacaattggcaaaggaagtagaataccttcttaggaaaggatggattccttgcttggaattcgagttgga

SEQ ID NO: 822 - DNA, 319 bp, Glycine max
  Clone ID: LIB3039-002-Q1-E1-E5
tacggctgcgagaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattg

SEQ ID NO: 823 - DNA, 382 bp, Glycine max
  Clone ID: LIB3073-026-Q1-K1-E3
gatatggggcagcagaagaacaagtagttgagaactaataaggagaagcatatggctttctcaatgatctcttccccagctgttaccactgtcaaccgtgccggtgccggcatggttgctacattcactggcctcaagtccatggctggcttccgcaccaagaagaccaacaatgacattacctccattgctagcaacggtggaagagtgcaatgcatgcaggtgtggccaccatttggcatgaagaagtttgagactctttcctacctgccagaccttgatgatgcacaattggcaaaggaagtagaataccttcttaggaagggatggattccttgcttggaattcgagttggagcactgtttcgagtaccgtgagcaca

SEQ ID NO: 824 - DNA, 387 bp, Glycine max
  Clone ID: LIB3054-006-Q1-N1-F11
gcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagttggagcacggtttcgtgtaccgtgagcacaacaggtcacctggatacta

SEQ ID NO: 825 - DNA, 292 bp, Glycine max
  unsure (1)...(292): unsure at all n locations
  Clone ID: LIB3028-009-Q1-B1-D4
nngtattgagaactaagaaggacaagcaaatggcttcctcaatgatctcttccccacctgttaccactgtcaaccgtgccggtgccggcatggttgctccattcactggcctcaagtccatggctggcttccccaccaggaagaccatcaatgacattacctccattgctagcaacggtggaagagtgcaatgcatgcaggtgtggccaccagttggcaagaagaagtttgagactctttcctacctgccagaccttgatgatgcacaattggcacaggaagtanaatacct

SEQ ID NO: 826 - DNA, 405 bp, Glycine max
  Clone ID: LIB3073-026-Q1-K1-A12
tacggctgcgagaagacgacagaaggatacggctgcgaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttaggaagggatggattccttgcttggaattcgagttgg

SEQ ID NO: 827 - DNA, 428 bp, Glycine max
  Clone ID: LIB3073-011-Q1-K1-C7
tgtggggttttggcagcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagttggagccacggttcgtgtaccgtgagcacaacatgtcacctggatactatgatggacgctactggaccatgtgga

SEQ ID NO: 828 - DNA, 382 bp, Glycine max
  unsure (1)...(382): unsure at all n locations
  Clone ID: LIB3054-001-Q1-B1-A6
caagttgagaactaagaaggagaagcaaatggcttcctcaatgatctcctccccaactgttaccactgtcaaccgtgccggtgccggcatggttgctccaatcactggcctcaagtccatggctggcttccccaacaagaagaccaacaatgacattacctccattgctaacaacggtggaagagtgcaatgcatgcaggtgtggccaccagttggcaagaagaagtttgagactctttcctacctgccagaccttgatgatgcacaattggcaaaggaagtagaataccttcttaggaanggatggattccttgcttggaattcgagttggagcacggtttcgtgtaccgtgagcacaacaggtcaccaggatactacgat

SEQ ID NO: 829 - DNA, 284 bp, Glycine max
  Clone ID: LIB3073-002-Q1-K1-A8
gatctggcagcagaagaacaagtagttgagaacgaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaaccgtggaagagtgcaatgcatgcaggtgtggccaccagttggcaagaagaagtttgagactctttcctacctgccagaccttgatgatg

SEQ ID NO: 830 - DNA, 294 bp, Glycine max
  Clone ID: LIB3073-002-Q1-K1-E11
gatctggcagcagaagaacaagtagttgagaactaagaaggagaagcaaatggcttcctcaatgatctcttccccagctgttaccactgtcaaccgtgccggtgccggcatggctgctccattcactggcctcaagtccatggctggcttccccaccaggaagaccaacaatgacattacctccattgctagcaacggtggaagagtgcaatgcatgcaggtgtggccaccagttggcaagaagaagtttgagactctttcctacctgccagaacttgatgatgcacaattggc

SEQ ID NO: 831 - DNA, 363 bp, Glycine max
  Clone ID: LIB3040-056-Q1-E1-E11
agtacggctgcgagaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaaggaagtagaataccttcttacgaagggatggattcct

SEQ ID NO: 832 - DNA, 416 bp, Glycine max
  Clone ID: LIB3073-025-Q1-K1-G10
gatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcaaagggaagtagaataccttcttaggaaggggatggattcctttgcttggaattcgaagtggagcacggtttcgtgtaccgtgagcacaacaggtcaccaggatactacgatggacgctact

SEQ ID NO: 833 - DNA, 346 bp, Glycine max
  Clone ID: LIB3054-003-Q1-N1-G2
caagtagttgagaactaagaaggagaagctaatggctttggcaatgatctcttccccagctgttaccactgtcaaccgtgccggtgccggcatggttgctccattcactggccttaagtccatggctggcttccccaccaggaagaccaacaatgacattacctgcattgctagcaacggtggaagagtgcaatgcatgcacgtgtggccaccatttggcaagaagaagtttgagactctttcctacctgccagaccttgatgatgcacaattggcataggaagtagaataccttcttacgaagggatggattccttgcttggaattccagttggagcacggttta

SEQ ID NO: 834 - DNA, 317 bp, Glycine max
  Clone ID: LIB3073-011-Q1-K1-D5
tgtgatttggcagcagaagaacaagtagttgagaactaagaaggagaagcaaatggcttcctcaatgatctcttccccagctgttaccaccgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcacaattggcataggaagtagaataccttc

SEQ ID NO: 835 - DNA, 341 bp, Glycine max
  Clone ID: LIB3054-011-Q1-N1-C4
gcagaaaaacaagtagttgagaactaagaagaaggaaatggcttcctcaatgatctcctccccagctgttaccaccgtcaaccgtgccggtgccggcatggttgctccattcaccggcctcaaatccatggctggcttccccacgaggaagaccaacaatgacattacctccattgctagcaacggtggaagagtacaatgcatgcaggtgtggccaccaattggcaagaagaagttcgagactctttcctacttgccagacctcgatgatgcccaattggcaaaggaagtcgaataccttctaaggaaaggatggattccttgcttggaattcgagtttg

SEQ ID NO: 836 - DNA, 421 bp, Glycine max
  Clone ID: LIB3049-038-Q1-E1-G6
agcccacgcgtccgtacggctgcgagaagacgacagaacgggatctggcagcagaaaaacaagtagttgagaactaagaagaaggaaatggcttcctcaatgatctcctccccagctgttaccaccgtcaaccgtgccggtgccggcatggatgctccattcaccggcctcaaatccatggctggcttccccacgaggaagaccaggactgatattacctccattgctagcaacggtggaagagtacaatgcatgcaggtgtggccatcaattggcaagaagaagttcgagactcgttcctacttgccagacctcgatgatgcccaattggcaaaggaagtcgaataccttcaaatgaaacgatggattccttgcttggaattcgacttggagcacggtttcgtgtaccgtgagcacaaca

SEQ ID NO: 837 - DNA, 305 bp, Glycine max
  Clone ID: LIB3039-033-Q1-E1-H12
agaagacgacagaaggggatctggcagcagaagaacaagtagttgagaactaagaaggagaagcaaatggcttcctcaatgatctcttccccagctgttaccactgtcaagcgtgccggtgccggcatggttgctccattcactggcctcaagtccatggctggcttccccaccagatagaccagcaatgacattacctccattgctagcaacggtggaagagtgcaatgcatgcatgtgtggccaccagttggcaagaagaagtttgagactcgttcctacctgccagaccttgatgatgcaca

SEQ ID NO: 838 - DNA, 345 bp, Glycine max
  Clone ID: LIB3039-031-Q1-E1-D2
acgcgtcagtacggctgcgagaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaggtccatggctggcttccccaccagaaagaccaacaatgacattacctccattgctagcaacggtgtgaagagtgcaatgcatgcaggtgtggccaccagttggcaagaagatgtttgagactctttcctacctgccagaccttgatgatgcacaattggcaaaggaagtagaat

SEQ ID NO: 839 - DNA, 316 bp, Glycine max
  Clone ID: LIB3030-004-Q1-B1-A8
ggagcttcaagaggctaagactgcataccccaacgggttcatccgtatcatcggattcgacaacgttcgccaagtgcagtgcatcagcttcatcgcctacaagcccccaggcttctaagtgtgaaaaatttgcaaagcatttgtagccgccaccccactttgtttgtttgtacgtaaactacattcccatttgtttttgctttttgagatttcatcatcctgtatttttggtttctgttttcggacttcactggaaattaatggatgagaactaatgaataagctactgtgttgtgttaaaaaagtgtaggaacaa

SEQ ID NO: 840 - DNA, 261 bp, Glycine max
  unsure (1)...(261): unsure at all n locations
  Clone ID: LIB3055-004-Q1-N1-F1
ctagcaacggtggaagagtgcaatgcatgcacgtgtggccaccaagtgcaagaagaagtttgagactctntcctacctgccagaccttgatgatgcacaattggcaaaggaagtagaataccttcttaggaagggatggattccttgcttggaattcgagttggagcacggtttcgtgtaccgtgagcacaacaggtcaccaggatactacgatggacgctactggaccatgtggaagctgcctatgtttggttgcactga

SEQ ID NO: 841 - DNA, 284 bp, Glycine max
  Clone ID: LIB3053-001-Q1-B1-H1
caggcaaaagaacaagtaatttgagaactaagaaaggagaaacaaatggcttccccaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgcaggtgtggccaccagttggcaagaagaagtttgagactctttcctacctgccagaccttgatgatgcaca

SEQ ID NO: 842 - DNA, 295 bp, Glycine max
  Clone ID: LIB3054-001-Q1-B1-C9
aagcagaaaaaacaagtatttgaaaactaagaatgagaagcaaatggcttcctcaatgatctcttccccagctgttaccactgtcaaccgtgccggtgccagcatggttgctccattcactggactcaagtccatggctgggttccccaccagaaagaccaacaatgacattacctccattgctagcaacggtggaagagtgcaatgcatgcaggtgtggccatcagttggcaagaagagatttgagactctttccgacctgccaggccttgatgatgcacaactggcagaagaa

SEQ ID NO: 843 - DNA, 275 bp, Glycine max
  Clone ID: LIB3073-002-Q1-K1-F5
gatctggcagcagaagaacaagtagttgagaactgggaaggagaagcaaatggctttctcaatgatctcttccccagctgttaccactgtcaaccgtgccggtgccggcatggttgctccattcactggcctcaagttcatggctggctttgccaccagaaagaccaactttgactttacctgcattgctagcaacggtggaagagtgcaatgcacgcatgtgcggccaccagttgccaagaagtagtttgcgactctttcctacctgtcagacc

SEQ ID NO: 844 - DNA, 250 bp, Glycine max
  Clone ID: LIB3073-026-Q1-K1-B9
ggggcagcagaagaacaactagttgataactaggaaggagaagcaaatggcttcctcaatgatctcttacccagctgttaccactgtcaaccgtgccggtgccggcatgggttctccattcactggcctaaagtccatggctggctgttccaccatgaagaccaacaatgacattacctacattgctagcaacggttgaagagtgcaatgcatgcaggtatggccaccagttggcaagaagaagtttgag

SEQ ID NO: 845 - DNA, 252 bp, Glycine max
  Clone ID: LIB3039-005-Q1-E1-E4
gcgtccatacggatgcgagaagacgacagaaggggatctggcagcagaagaacaagtagttgagaactaagaaggagaagcaaatggcttcctcaatgatctcttccccagctgttaccactgtcaaccgtgccggtgccggcatggttgctccattcactggcctcaagtccatggctggcttccccaccagaaagaccaacaatgacattacctccattgctagcaacggtggaagagtgcaatgcatgc

SEQ ID NO: 846 - DNA, 298 bp, Glycine max
  Clone ID: LIB3054-006-Q1-N1-E5
atttattagttctcatccattaatttccattgaagtccgagtacagaaaccaaaaatacaggatgatgaaatctcaaaaagcaaaaacaaatgggaatgtagtttaagtacaaacaaacaaagtggtgtggcggctacaaatgctttgcaaaatatttacacttataatcttgtttgtttttatgcttttaatctatattatttatattttttttatttttttttttttttttatttatattattttttttttattttattttttaattttttattattttttatttttattttattt

SEQ ID NO: 847 - DNA, 124 bp, Glycine max
  Clone ID: LIB3055-007-Q1-N1-G1
gtttgtttgtacttaaactacattcccatttgtttttgctttttgagatttcatcatcctgtatttttggtttctgttttcggacttcaatggaaattaatggatgagaactaatgaataagct

SEQ ID NO: 848 - DNA, 169 bp, Zea mays
  Clone ID: 700073531H1
gtctccggatccgtcgccgtctggtctccgtgtgctctcgtcggcgtcggcgtcggcggcgtctgactgaacccctcggcttccgcggcgtcgggtctctggtgctgctgctactgctgctgcgtgcaaggctgttatggccaccaagaagaaccttggcaacctcggc

SEQ ID NO: 849 - DNA, 323 bp, Zea mays
  unsure (1)...(323): unsure at all n locations
  Clone ID: 700215712H1
tgacgctcaaggggaagagcgtctccgtgcgcgccgacctcaacgcgccgcttgacgcgcaccagaacagcaccgaagacatccacgccatccagtacctcttcagcaagggcgccaaggtgcaaagagccgatgatgtgattgagcctgaagttgagaagctggtggttacgttgcccaacagatgtttgacgaattgcttcaaccncgtaganagttgtntcagctgggatnnagtgtcanatcggnaannttggtctncanntacanagtttctgatattgggagatgtgttccagacaggtttacaccttggaaatcac

SEQ ID NO: 850 - DNA, 201 bp, Zea mays
  Clone ID: 700220093H1
ggatgggtcttgatgttggccctgatgccacgaaaaccttcaacgaagcattggacaccaccaagactgttatttggaacactcccatggggccgttccaaataacagtcttggtggtgtccaatgggagtgtttgagttcgagaagttaacagctggaactgaggcgattgccaagaagctagctgagcttacaaccacg

SEQ ID NO: 851 - DNA, 297 bp, Zea mays
  Clone ID: 700336084H1
gattggcacatctctgtatgatgaatacggagccaatattgtcaaagatctcatggccaaagctgagaaaaatggtgttaagattaccttgcctgttgactttgtcactgctgacaaatttgatgagaatgcagagactggccaagctactgtggcctctggtatacctgctggctggatgggcttggactgtggtactgagagcagtaagaagtatgctgaggctgtgtctcgagctaagcagattgtttggaacggtcctgttgtggtatttgaatgggaagcctttgccagggg

SEQ ID NO: 852 - DNA, 258 bp, Zea mays
  Clone ID: 700442802H1
cgccatggccaccatggcgaagaagagcgtaggggaactcacggaggccgacctcgaggggaagcgcgtctacgtgcgcgccgacctcaacgtgccgctcgacgagaaccagaacatcaccgacgacacccgcatccgggccgccatccccaccatccagtacatcctccgcaaggccgccaaggtcatccactcaagccacttgggtcgccctaagggttttacacccaagtttagcttagctccccttgtaggacg

SEQ ID NO: 853 - DNA, 276 bp, Zea mays
  Clone ID: 700611444H1
tctggaacgggcacatgggtgtttttgaatatgacaagttcgctataggaactgaggctgtggcaaagaagttggcagaacttagccgcaagggtgtgacaactatcatcggaggtggagactctgtcgccgccgttgagaaggtcggagttgctgacgttatgagccacatttccaccggaggtggtgccagcttggaattgttggaaggaaaggagcttccaggagttactgcattggatgaagcagccactgtgactgtatgaagcaagtttt

SEQ ID NO: 854 - DNA, 164 bp, Zea mays
  Clone ID: 700623464H1
gttgctggcttcctcatgcagaaggtacttgactaccttgttggaactgttgccaacccgaacaagcgatttgccgctgttgttagtggatccatggtgtcaagtaagattggtggcattgagtcgttgctggcgaaggtggatatcctcatccttggtggtgt

SEQ ID NO: 855 - DNA, 193 bp, Zea mays
  Clone ID: 700805505H1
caaggtctcaagtaagattggtgtcattggatccaccaacaatagcggcaaatggcttctttgggttggtggatccaaggtctcaagtaagattggtgtcattgagtccttgctggcgaaggtcgatatcctcatccttggtggtggtatgatctacacattttacaaggcacaaggatattctgttggaaaa

SEQ ID NO: 856 - DNA, 315 bp, Zea mays
  Clone ID: 700101571H1
ccaagacggtcatctggaacgggcccatgggcgttttcgaatttgacaagttcgccgtaggaaccgaggctgtggcaaagaagctggcagaactcagcggcaagggcgtcacaactatcatcggaggcggagactccgtcgccgccgtcgagaaggtgggagttgctgacgttatgagccacatttccacgggaggtggcgctaccctggaattgttggaaggaaaggagcttccgggagttgttgcgttgaatgaagtcgccactgtgactgtatgaagcatgctttcattttgtttcgtcttcgtcttcacgt

SEQ ID NO: 857 - DNA, 287 bp, Zea mays
  unsure (1)...(287): unsure at all n locations
  Clone ID: 700218404H1
ctggaacgggcccatgggcgttttcgaatttgacaagttcgccgtaggaaccgaggctgtggcaaagaagctggcagaactcagcggcaagggcgtcncaactatcntcggaggcggagactccgtcgccgccgtcgagaaggtgggagttgctgacgttatgagccacattccacgggaggtggcgctagctgganttgttggaaggaaaggagcttccgggagttgttgcgttgaatgaagccgccactgtgactgtatgaagcatgctttcattttgtttcgtc

SEQ ID NO: 858 - DNA, 301 bp, Zea mays
  Clone ID: 700093042H1
cggacgcgtgctagttctagatcgcgagcggccgccctttttttttttttttgttcaaacgatttccattagctctataaaacaatggtctcttacatttcgagcgagcggctgaggaggtgcaagcgagaatgtagcaagtatacaacggcacgtgaagacgaagacgaaacaagatgaaagcatgcttcatacagtcacagtggcggcttcattcaacgcaacaactcccggaagctcctttccttccaacaattccaggctagcgccacctcccgtggaaatgtggctcataacgtca

SEQ ID NO: 859 - DNA, 244 bp, Zea mays
  unsure (1)...(244): unsure at all n locations
  Clone ID: 700093371H1
caaacgatttccattanctctataaaacattggtctcttacatttcgagcgancggctgaggaggtgcaagtgcaagcnagaatgtagcaagtatacaacggcacgtgaagacgaagacgaaacaaaatgaaagcatgcttcatacagtcacagtggcggcttcattcaacgcaacaactcccggaagctcctttccttccaacaattccaggctagcgccacctcccgtggaaatgtggcnca

SEQ ID NO: 860 - DNA, 319 bp, Zea mays
  Clone ID: 700098158H1
gaagaatgacccagagtttgcgcagaagcttgcctccgtagcagatctttacgttaatgacgcgtttggaacagcccacagggcacatgcatcgactgagggagttacaaagttcttgaagccttctgttgcagggttccttttgcagaaggagcttgactaccttgtcggagctgtttcaagccctacacgcccatttgctgccatcgtgggtggttcaaaggtgtcatccaagatcggggttattgaatccttgttggagaagtgtgatatccttctcttgggtggtggtatgatcttcacattttacaaggcacaa

SEQ ID NO: 861 - DNA, 324 bp, Zea mays
  Clone ID: 700210258H1
tgccgctcgacgagaaccagaacatcaccgacgacacccgcatccgggccgccatccccaccatccagtacatcctcagcaagggcgccaaggtcatcctctcaagccacttgggtcgccctaagggttttacacccaagtttagcttagctccccttgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcac

SEQ ID NO: 862 - DNA, 316 bp, Zea mays
  Clone ID: 700099304H1
cttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcgacgtctctccttgcaaaggctaaggaaaagggcgtctcccttatgctgccaactgatgttgtcattgctgacaagtttgcccctgatgctaacagccagattgttccag

SEQ ID NO: 863 - DNA, 307 bp, Zea mays
  Clone ID: 700100457H1
gattctacaaggaagaggagaagaatgacccagagtttgcacagaagcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggatcaaaggtgtcatccgagatcggggttattgagtccctgttggagaagtgtgatatccttctcttgggtgg

SEQ ID NO: 864 - DNA, 317 bp, Zea mays
  Clone ID: 700097084H1
aagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcattgggtggtggtatgatcttcacgttttacaaggcacaaggtctccctgttggtgcttcattggtcgaggaagacaaactcgagcttgcgacgtctctccttgcaaaggctaaggaaaagggcgtctcccttatgctgccaactg

SEQ ID NO: 865 - DNA, 315 bp, Zea mays
  Clone ID: 700097420H1
cccacgcgtccgcaaaggtgtcatccaagatcggggttattgagtccctgttggagaagtgtgatatccttctcttgggtggtggtatgatcttcacgttttacaaggcacaaggtctccctgttggtgcttcattggtcgaggaagactaactcgagcttgcgacgtctctccttgcaaaggctaaggaaaagggcgtctcccttatgctgccaactgatgttgtcattgctgacaagtttgcccctgatgctaacagccagattgttccagcatctgcaattcctgattgttggatagggctggatattggcc

SEQ ID NO: 866 - DNA, 276 bp, Zea mays
  Clone ID: 700216186H1
gggttccttttgcagaaggagcttgactaccttgtcggagctgtttcaagccctacacgcccatttgctgccatcgtgggtggttcaaaggtgtcatccaagatcggggttattgaatccttgttggagaagtgtgatatccttctcttgggtggtggtatgatcttcacattttacaaggcacaaggtctttctgtcggtgcttcgttggttgaggaagacaaactcgatcttgcaacatctctacttgcaaaggctaaggaaaagggtgtctcc

SEQ ID NO: 867 - DNA, 316 bp, Zea mays
  Clone ID: 700098880H1
ggcaagggcgccaaagtcatcctctcaagccacttgggtcgccctaagggttttacacccaagtttagcttagccccccttgttgcacggttgtctgagcttcttggcattcaggtgcaaaaagccgacgatgttattggccctgaagttgagaagctggtggccgccttgcccaatggtggggttttgctccttgagaacgtaagattctacaaggaagaggagaagaatgacccagagtttgcgcagaagcttgcctccgtagcagatctttacgttaatgacgcgtttggaacagcccacagggcacatgcat

SEQ ID NO: 868 - DNA, 316 bp, Zea mays; identical to SEQ ID NO: 867
  Clone ID: 700098821H1

SEQ ID NO: 869 - DNA, 272 bp, Zea mays
  Clone ID: 700041819H1
aaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcgacgtctctccttgcaaaggctaaggaaaagggcgtctcccttatgctgcc

SEQ ID NO: 870 - DNA, 285 bp, Zea mays
  Clone ID: 700210748H1
cctaagggttttacacccaagtttagcttagctccccttgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcgcatgcatcgacggaggga

SEQ ID NO: 871 - DNA, 327 bp, Zea mays
  Clone ID: 700097556H1
cggacgcgtgggctcaaccaacgaagcaccgacagaaagacaaactcgatcttgcaacatctctacttgcaaaggctaaggaaaagggtgtctcccttatgttgccaaccgatgttgtcatcgctgataagtttgctcctgatgctaacagccagattgttccagcatctgcaattcctgatggttggatggggctggatattggcccagattccattgctgcattcaacgcagccctggaaacaacccagactgtcatctggaacgggcccatgggtgtttttgaatatgacaagttcgctataggaactgaggctgtggcaaaga

SEQ ID NO: 872 - DNA, 276 bp, Zea mays
  Clone ID: 700578230H1
tttggaacagcccacaggggcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttacaaggcacaaggttccctgttggtgcttcatt

SEQ ID NO: 873 - DNA, 277 bp, Zea mays
  Clone ID: 700580556H1
cgtgggtggttcaaaggtgtcatccaagatcggggttattgagtccctgttggagaagtgtgatatccttctcttgggtggtggtatgatcttcacgttttacaaggcacaaggtctccctgtttgtgcttcattggtacaggaagacaaactcgagcttgcgacgtctctccttgcaaaggctaaggaaaagggcgtctcccttatgctgccaactgatgttgtcattgctgacaagtttgcccctgatgctaacagccagattgttccagcatct

SEQ ID NO: 874 - DNA, 264 bp, Zea mays
  Clone ID: 700044785H1
gctgcttgagaacgtaagattctacaaggaagaggagaagaatgacccagagtttgcacagaagcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtc

SEQ ID NO: 875 - DNA, 261 bp, Zea mays
  Clone ID: 700041775H1
tgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtgg

SEQ ID NO: 876 - DNA, 264 bp, Zea mays
  Clone ID: 700045331H1
cggctcgagggaagcgcgtcttcgtgcgtgccgacctcaacgtgccgctcgacgagaaccagaacatcaccgacgacacccgcatccgggccgccatccccaccatccagtacctcctcggcaagggcgccaaagtcatcctctcaagccacttgggtcgccctaagggttttacacccaagtttagcttagccccccttgttgcacggttgtctgagcttcttggcattcaggtgcaaaaagccgacgatgttattggccctg

SEQ ID NO: 877 - DNA, 278 bp, Zea mays
  Clone ID: 700046021H1
ccctaagggttttacacccaagtttagcttagctccccttgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcgcatgcatcga

SEQ ID NO: 878 - DNA, 276 bp, Zea mays
  Clone ID: 700344283H1
gaagttcttgaagccttctgttgcagggttccttttgcagaaggagcttgactaccttgtcggagctgtttcaagccctacacgcccatttgctgccatcgtgggtggttcaaaggtgtcatccaagatcggggttattgaatccttgttggagaagtgtgatatccttctcttgggtggtggtatgatcttcacattttacaaggcacaaggtctttctgtcggtgcttcgttggttgaggaagacaaactcgatcttgcaacatctctactgca

SEQ ID NO: 879 - DNA, 258 bp, Zea mays
  Clone ID: 700242032H1
atccaagatcggggttattgagtccctgttggagaagtgtgatatccttctcttgggtggtggtatgatcttcacgttttacaaggcacaaggtctccctgttggtgcttcattggtcgaggaagacaaactcgagcttgcgacgtctctccttgcaaaggctaaggaaaagggcgtctcccttatgctgccaactgatgttgtcattgctgacaagtttgcccctgatgctaacagccagattgttccagcatctgc

SEQ ID NO: 880 - DNA, 244 bp, Zea mays
  Clone ID: 700044688H1
gtgtgatatccttctcttgggtggtggtatgatcttcacattttacaaggcacaaggtctttctgtcggtgcttcgttggttgaggaagacaaactcgatcttgcaacatctctacttgcaaaggctaaggaaaagggtgtctcccttatgttgccaaccgatgttgtcatcgctgataagtttgctcctgatgctaacagccagattgttccagcatctgcaattcctgatggttggatgggg

SEQ ID NO: 881 - DNA, 270 bp, Zea mays
  Clone ID: 700053496H1
cccaagtttagcttagctccccttgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcgcatgcatcgaccgaggga

SEQ ID NO: 882 - DNA, 262 bp, Zea mays
  Clone ID: 700043267H1
aagggcgccaaggtcatcctctcaagccacttgggtcgccctaagggttttacacccaagtttagcttagctccccttgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctag

SEQ ID NO: 883 - DNA, 260 bp, Zea mays
  Clone ID: 700577778H1
ctccttgcaaaggctaaggaaaagggcgtctcccttatgctgccaactgatgttgtcattgctgacaagtttgcccctgatgctaacagccagattgttccagcatctgcaattcctgatggttggatggggctggatattggcccagattctgtcgcttcattcaacgcagccctggatacaaccaagacggtcatctggaacgggcccatgggcgttttcgaatttgacaagttcgccgtaggaaccgaggctgtgga

SEQ ID NO: 884 - DNA, 246 bp, Zea mays
  Clone ID: 700045845H1
ggaaaagggtgtctcccttatgctgccaaccgatgttgtcattgctgacaagtttgcccctgatgctaacagccagattgttccagcatctgcaattcctgatggttggatgggcctggatattggcccagattctgtcgcttcattcaacgcagccctggatacaaccaagacggtcatctggaacgggcccatgggtgtcttcgaatttgacaagttcgctgtaggaaccgaggctgtggcaaa

SEQ ID NO: 885 - DNA, 221 bp, Zea mays
  Clone ID: 700439945H1
ggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcg

SEQ ID NO: 886 - DNA, 215 bp, Zea mays
  Clone ID: 700240633H1
aaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcgcatgcatcgaccgagggattacca

SEQ ID NO: 887 - DNA, 182 bp, Zea mays
  Clone ID: 700424659H1
gtgatcttcacgttttacaaggcacaaggtctccctgttggtgcttcattggtcgaggaagacaaactcgagcttgcgacgtctctccttgcaaaggctaaggaaaagggcgtctcccttatgctgccaactgatgttgtcattgctgacaagtttgcccctgatgctaacagccagattgt

SEQ ID NO: 888 - DNA, 102 bp, Zea mays
  Clone ID: 700042421H1
gttcaaaggtgtcatccaagatcggggttattgagtccctgttggagaagtgtgatatccttctcttgggtggtggtatgatcttcacgttttacaaggcac

SEQ ID NO: 889 - DNA, 322 bp, Zea mays
  Clone ID: 700100967H1
atcccgtcgcatcccatcccactaccacccatctcgtcgtccgccgattcgatccggttcttccaacccagggtgagtctccggatccgtcgccgtctggtatccgtgtgctctcgtcgccgtcgccgtcgccgccgtctgactgcccccctcgcctcccgcggcgtcgggtctctggtgctgctgctgctgctgctgctgctgcgtgcagggcagtgatggcgacgaagaggagcgtgggcaccctcggcgaggcggatctgaaggggaagaaggtgttcgtgcgcgccgacctcaacgtcccgctcgacgatgcccagaa

SEQ ID NO: 890 - DNA, 351 bp, Zea mays
  Clone ID: 700209994H1
ctgagtttgctaagaagctagcatctgttgctgacctttatgtcaatgatgcttttggcacggcacacagagctcatgcttcaaccgaagagttaccaagtatttgaacgcctgctgttgccggcttcctcatgcagaaggaacttgactaccttgttggagctgttgccaacccaaagaagccatttgccgctattgttggtggatccaaggtctcaagtaagattggtgtcattgagtccttgctggcgagagtcgatatcctcatccttggtggtggtatgatctacacattttacaaggcacaaggatattctgttggaaaatctctcgtggaagaggataaacttg

SEQ ID NO: 891 - DNA, 303 bp, Zea mays
  Clone ID: 700103176H1
caaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttggctgccgctttgccagaaggtggagttctgctcctagagaatgttagattctacaaggaggaagagaagaacgaacctgagtttgctaagaagctagcatctgttgctgacctttatgtcaatgatgcttttggcacggcacacagagctcatgc

SEQ ID NO: 892 - DNA, 306 bp, Zea mays
  Clone ID: 700262312H1
gtgatggccaatgattgcattggtgaagaagttgagaagttggctgccgctttgccagaaggtggagttctgctcctagagaatgttagattctacaaggaggaagagaagaacgaacctgagtttgctaagaagctagcatctgttgctgacctttatgtcaatgatgcttttggcacggcacacagagctcatgcttcaaccgaaggagttaccaagtatttgaagcctgctgttgccggcttcctcatgcagaaggaacttgactaccttgttggagctgttgccaacccaaagaagccattt

SEQ ID NO: 893 - DNA, 307 bp, Zea mays
  Clone ID: 700103182H1
tggagttgaagtcgtgatggccaatgattgcattggtgaggaagttgagaagttggctgccgctttgccagaaggtggagttctgctcctagagaatgttagattctacaaggaggaagagaagaacgaacctgagtttgctaagaagctagcatctgtagctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaaccca

SEQ ID NO: 894 - DNA, 306 bp, Zea mays
  Clone ID: 700216542H1
ctgagtttgctaagaagctagcatctgttgctgacctttatgtcaatgatgcttttggcacggcacacagagctcatgcttcaaccgaaggagttaccaagtatttgaagcctgctgttgccggcttcctcatgcagaaggaacttgactaccttgttggagctgttgccaacccaaagaagccatttgccgctattgttggtggatccaaggtctcaagtaagattggtgtcattgagtccttgctggcgaaggtcgatatcctcatccttggtggtggtatgatctacacattttacaaggcac

SEQ ID NO: 895 - DNA, 290 bp, Zea mays
  Clone ID: 700104446H1
caacgaagaggagcgtgggcacctcggcgaggcggatctgacggggaagaaggtgttcgtacgcacagacctcaacgtcccgctcgacgatgcccagaagatcaccaacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgca

SEQ ID NO: 896 - DNA, 277 bp, Zea mays
  Clone ID: 700236428H1
agaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttggctgccgcttt

SEQ ID NO: 897 - DNA, 308 bp, Zea mays
  Clone ID: 700257977H1
tgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcactccaaagtacagcttgatacctcttgttccacgcttgtctgagctccttggagtt

SEQ ID NO: 898 - DNA, 303 bp, Zea mays
  Clone ID: 700072449H1
cactaccacccatctcgtcgtccgccgattcgatccggttcttccaacccaggggctgtgatggcgacgaagaggagcgtgggcaccctcggcgaggcggatctgatggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgtt

SEQ ID NO: 899 - DNA, 344 bp, Zea mays
  Clone ID: 700089147H1
attttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctag

SEQ ID NO: 900 - DNA, 339 bp, Zea mays
  Clone ID: 700208306H1
cccacgcgtccggctgctactgctgctgcgtgcagggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcatt

SEQ ID NO: 901 - DNA, 309 bp, Zea mays
  Clone ID: 700104358H1
cggacgcgtggcgagacgcgtgggtggccaatgattgcattggtgaggaagttgagaagttggctgccgctttgccagaaggtgacgttctgctccaagagaatgttagattctacaaggaggaagagaagaacgaacctgagtttgctaagaagctagcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgcca

SEQ ID NO: 902 - DNA, 301 bp, Zea mays
  Clone ID: 700266788H1
agcctgctgttgccggcttcctcatgcagaaggaacttgactaccttgttggagctgttgccaacccaaagaagccatttgccgctattgttggtggatccaaggtctcaagtaagattggtgtcattgagtccttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcc

SEQ ID NO: 903 - DNA, 274 bp, Zea mays
  Clone ID: 700219877H1
gttagattctacaaggaggaagagaagaacgaacctgagtttgctaagaagctagcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgctattgttggtggatccaaggtctcaagtaagattggtgtcattgagc

SEQ ID NO: 904 - DNA, 313 bp, Zea mays
  Clone ID: 700083123H1
atcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaag

SEQ ID NO: 905 - DNA, 292 bp, Zea mays
  Clone ID: 700087896H1
ctaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaag

SEQ ID NO: 906 - DNA, 278 bp, Zea mays
  Clone ID: 700265143H1
atctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagct

SEQ ID NO: 907 - DNA, 307 bp, Zea mays
  Clone ID: 700097447H1
catcccgtcgcatcccatcccactaccacccatctcgtcgtccgccgattcgatccggttcttccaacccaggggcagtgatggcgacgaagaggagcgtgggcaccctcggcgaagcggatctgaaggggaagaaggtgttcgtgcgcgccgacctcaacgtcccgctcgacgatgcccagaagatcaccgacgacacccgcatccgcgcctccgtccccaccatcaagttcctcatcgagaagggcgccaaggtcatcctcgccagcctactgggtcgtccaaaaggtgtcaccccaaagtacag

SEQ ID NO: 908 - DNA, 310 bp, Zea mays
  Clone ID: 700072364H1
tcccgtcgcatcccatcccactaccacccatctcgtcgtccgccgattcgatccggttcttccaacccaggggctgtgatggcgacgaagaggagcgtgggcaccctcggcgatgcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttga

SEQ ID NO: 909 - DNA, 306 bp, Zea mays
  Clone ID: 700099968H1
atcccgtcgcatcccatcccactaccacccatctcgtcgtccgccgattcgatccggttcttccaacccaggggctgtgatggcgacgaagaggagcgtgggcaccctcggcgaggcggatctgaacgggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacag

SEQ ID NO: 910 - DNA, 312 bp, Zea mays
  Clone ID: 700075887H1
cggaccgtgggtcccatcccactaccacccatctcgtcgtccgccgattcgatccggttcatccaacccaggggcagtgatggcgacgaagaggagcgtgggcatcctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaa

SEQ ID NO: 911 - DNA, 297 bp, Zea mays
  Clone ID: 700027135H1
ccgtcgcatcccatcccactaccacccatctcgtcgtccgccgattcgatccggttcttccaacccaggggcagtgatggcgacgaagaggagcgtgggcaccctcggcgaggcagatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaa

SEQ ID NO: 912 - DNA, 307 bp, Zea mays
  Clone ID: 700097469H1
catcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacag

SEQ ID NO: 913 - DNA, 303 bp, Zea mays
  Clone ID: 700267426H1
agtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagc

SEQ ID NO: 914 - DNA, 283 bp, Zea mays
  Clone ID: 700215049H1
gcttgaagcctcttgttccacgcttgtctgagctccttggagttgaagtcgtgatggccaatgattgcattggtgaagaagttgagaagttggctgccgctttgccagaaggtggagttctgctcctagagaatgttagattctacaaggaggaagagaagaacgaacctgagtttgctaagaagctagcatctgttgctgacctttatgtcaatgatgcttttggcacggcacacagagctcatgcttcaaccgaagagttaccaagtattgaagctgctgt

SEQ ID NO: 915 - DNA, 338 bp, Zea mays
  unsure (1)...(338): unsure at all n locations
  Clone ID: 700619962H1
ccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaaggcgccaaggtcatcctcgccagccacctgggtcgtccanaaggtgtcaccccaaagtacagcttgaagcctcttgttccacgcttgtctgagctctt

SEQ ID NO: 916 - DNA, 297 bp, Zea mays
  Clone ID: 700332089H1
catcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccc

SEQ ID NO: 917 - DNA, 297 bp, Zea mays
  Clone ID: 700351610H1
cccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaa

SEQ ID NO: 918 - DNA, 307 bp, Zea mays
  Clone ID: 700075430H1
acatcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtaca

SEQ ID NO: 919 - DNA, 310 bp, Zea mays
  Clone ID: 700092332H1
cccgtcgcatcccatcccactaccacccatctcgtcgtccgccgattcgatccggttcttccaacccaggggctgtgatggcgacgaagaggagcgtgggcaccctcggcgaggcggatctgaatgggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaa

SEQ ID NO: 920 - DNA, 299 bp, Zea mays
  Clone ID: 700405456H1
gttgccaacccaaagaagccatttgccgctattgttggtggatccaaggtctcaagtaagattggtgtcattgagtcgttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagccgatgctgagagcaagattgt

SEQ ID NO: 921 - DNA, 288 bp, Zea mays
  Clone ID: 700798970H1
cccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtg

SEQ ID NO: 922 - DNA, 262 bp, Zea mays
  Clone ID: 700028644H1
aagtatttgacgcctgctgttgccggcttcctcatgcagaaggaacttgactaccttgttggagctgttgccaacccaaagaagccatttgccgctattgttggtggatccaaggtctcaagtaagattggtgtcattgagtccttgctggcgaaggtcgatatcctcatccttggtggtggtatgatctacacattttacaaggcacaaggatattctgttggaaaatctctcgtggaagaggataaacttgagctcgcaa

SEQ ID NO: 923 - DNA, 325 bp, Zea mays
  Clone ID: 700092404H1
ccgacggtgggtgttacaaggcacaaggatattctgttggaaaatctctcgtggaagaggataaacttgagctcgcaacttctcttattgagaaggcgaacgcaaagggggtttctcttttgcttcccactgatattgtagtagcggacaagtttgcagccgatgctgagagcaagattgtccctgccactgctatccctgatgactggatgggtcttgatgttggccctgatgccacgaaaaccttcaacgaagcattggacaccaccaagactgttatttggaacggccccatgggagtgtttgagttcgagaagtttgcagc

SEQ ID NO: 924 - DNA, 336 bp, Zea mays
  Clone ID: 700093208H1
cccacgcgtccgcgacgcggtatgatctacacattttacaaggcacaaggatattctgtaggaaaatctcccgtggaagaggataaacttgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccacgaaaaccttcaacgaagcattggacaccaccaagactgttatttggaacggccccatgggagtgtttgagttcgag

SEQ ID NO: 925 - DNA, 293 bp, Zea mays
  Clone ID: 700073284H1
atcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtca

SEQ ID NO: 926 - DNA, 337 bp, Zea mays
  Clone ID: 700620115H1
catcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctga

SEQ ID NO: 927 - DNA, 262 bp, Zea mays
  Clone ID: 700262412H1
atcccgtcgcatcccatcccactaccacccatctcgtcgtccgccgattcgatccggttcttccaacccaggggctgtgatggcgacgaagaggagcgtgggcaccctcggcgaggcggatctgatggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctc

SEQ ID NO: 928 - DNA, 291 bp, Zea mays
  Clone ID: 700025960H1
catcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgtacgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtg

SEQ ID NO: 929 - DNA, 285 bp, Zea mays
  Clone ID: 700549575H1
gaagaacgaacctgagtttgctaagaagctagcatctgttgctgacctttatgtcaatgatgcttttggcacggcacacagagctcatgcttcaaccgaaggagttaccaagtatttgaagcctgctgttgccggcttcctcatgcagaaggaacttgactaccttgttggagctgttgccaacccaaagaagccatttgccgctattgttggtggatccaaggtctcaagtaagattggtgtcattgagtccttgctggcgaaggtcgatatcctcatccttgg

SEQ ID NO: 930 - DNA, 328 bp, Zea mays
  unsure (1)...(328): unsure at all n locations
  Clone ID: 700579774H1
tggtatgatctacacattttacaaggcacaaggatattctgttggaaaatctctcgtggaagaggataaacttgagctcgcaacttctcttattgagaatgcgaaggcaaagggtgtgtctcttttgcttcccactgatattgtagtagcggacaagtttgcagccgatgctgagagcaagattgtccctgccactgctatccctgatgactggatgggtcttgatgttggctctgatgccacgaaaaccttcaacgaagcattggacaccaccaagactgttatgtggaacggccccatgggagtgtntgagtcggaagtttcagct

SEQ ID NO: 931 - DNA, 289 bp, Zea mays
  Clone ID: 700264301H1
agtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtca

SEQ ID NO: 932 - DNA, 286 bp, Zea mays
  Clone ID: 700333669H1
atcccgtcgcatcccatcccactaccactcatctcgtcgtccgccgattcgatccggttcttccaacccaggtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtacaaaaggtgt

SEQ ID NO: 933 - DNA, 290 bp, Zea mays
  Clone ID: 700268190H1
ccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtca

SEQ ID NO: 934 - DNA, 290 bp, Zea mays
  Clone ID: 700050952H1
ccgtcgcatcccatcccactaccacccatctcgtcgtccgccgattcgatccggttcttccaacccaggggcagtgatggcgacgaagaggagcgtgggcaccctcggcgaggcggatctgaacgggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtca

SEQ ID NO: 935 - DNA, 269 bp, Zea mays
  Clone ID: 700349338H1
gttgaagtcgtgatggccaatgattgcattggtgaagaagttgagaagttggctgccgctttgccagaaggtggagttctgctcctagagaatgttagattctacaaggaggaagagaagaacgaacctgagtttgctaagaagctagcatctgttgctgacctttatgtcaatgatgcttttggcacggcacacagagctcatgcttcaaccgaagagttaccaagtattgaagcctgtgttgccggctcctctgcagaggaactgac

SEQ ID NO: 936 - DNA, 309 bp, Zea mays
  Clone ID: 700282206H2
tcacatcccacgaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgatagctcttg

SEQ ID NO: 937 - DNA, 298 bp, Zea mays
  Clone ID: 700344952H1
cgcacatcccgtcgcatcccatcccactaccacgcatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcatcgacgacacccgcatccgcgcctccgtccccaccatcaagttcctcctcgagaagggcgccaaggtcatcctcgccagcgacctaggtcgtccaaaaggtgtca

SEQ ID NO: 938 - DNA, 277 bp, Zea mays
  Clone ID: 700043612H1
cccgtcgcatcccatcccactaccacccatctcgtcgtccgccgattcgatccggttcttccaggccaggggcagtgatggcgacgaagaggagcgtgggcacctcggcgaggcggatctgacagggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgt

SEQ ID NO: 939 - DNA, 311 bp, Zea mays
  Clone ID: 700221930H1
tccgtcgcatcccatcccactaccacccatctcgtcgtccgtcgattcgatccggttcttccaacccatgggcagtgatggcgacgaagagtagcgtgtgcaccctcggcgaggcggatcttaatgggaagaaggtgttcgtgcgcgccgacctcaacgtcccgctcgacgatgcccagaagatcaccgacgacacccgcatccgcgcctccgtccccagcatcaagttcctcctcgacaagggcggcaatgtcatcctcagcagccacctgggtcgtccaaaaggtgtcacccaaagtacagcttggagc

SEQ ID NO: 940 - DNA, 292 bp, Zea mays
  Clone ID: 700204594H1
ggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttacaaccacgaagggtgtcactaccatcatc

SEQ ID NO: 941 - DNA, 308 bp, Zea mays
  Clone ID: 700099108H1
cacacgcgtccgggaccgtggtatgatctacacattttacaaggcacaaggatattctgttggaaaatctctcgtggaagaggataaacttgaactcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccacgaaaaccttcaacgaagcattggacaccaccaagactgttatttgga

SEQ ID NO: 942 - DNA, 251 bp, Zea mays
  Clone ID: 700570931H1
ccaaagtacagcttgaagcctcttgttccacgcttgtctgagcatttggagttgaagtcgtgatggccaatgattgcattggtgaagaagttgagaagttggctgccgctttgccagaaggtggagttctgctcctagagaatgttagattctacaaggaggaagagaagaacgaacctgagtttgctaaaagctagcatctgttgctgacctttatgtcaatgatgcttttggcacggcacacagagctc

SEQ ID NO: 943 - DNA, 305 bp, Zea mays
  Clone ID: 700077368H1
cccacgcgtccgcccacgcgtccgaccacgcgtccgcgtcgcatcccatcccactaccacccatctcgtcgtccgccgattcgatccggttcttccaacccagcggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacct

SEQ ID NO: 944 - DNA, 267 bp, Zea mays
  Clone ID: 700044806H1
atcccgtcgcatcccatcccactaccacccatctcgtcgtccgccgattcgatccggttcttccaacccaggtgatggcgacgaagaggagcgtgggcaccctcggcgacgcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacc

SEQ ID NO: 945 - DNA, 268 bp, Zea mays
  Clone ID: 700217737H1
cccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagcca

SEQ ID NO: 946 - DNA, 273 bp, Zea mays
  Clone ID: 700805779H1
cccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcagcgacgacacccgcatccgcgcctccgtccccaccatcaagttcctcctcgagaagggcgccaaggtcatcctcgccagccacctgg

SEQ ID NO: 947 - DNA, 290 bp, Zea mays
  unsure (1)...(290): unsure at all n locations
  Clone ID: 700211352H1
ttcgatccggttcttccaacccaggggcagtgatggcgacgaagaggagcgtgggcaccctcggcgangcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccanaaggtgtcaccccaaagtacagcttgaagcctcttgttccacgcttgtctgag

SEQ ID NO: 948 - DNA, 295 bp, Zea mays
  Clone ID: 700088868H1
gcctgctgttgctggcttcctcatgcagaaggcacttgactaccttgttggagctgttgccaacccaaagaagccatttgccgctattgttggtggatccaaggtctcaagtaagattggtgtcattgagtcgttgctggcgaaggtcgatatcctcatccttggtgcgtggtatgatctacacattttacaaggcacaaggatattctgttggaaaatctctcgtggaagaggattaaacttgagctcgcaacttctcttattgagaaggcgaggcaaagggggtttctctttt

SEQ ID NO: 949 - DNA, 238 bp, Zea mays
  Clone ID: 700348871H1
caatgatgcttttggcacggcacacagagctcatgcttcaaccgaaggagttaccaagtatttgaagcctgctgttgctggggtcctcatgcagaaggaacttgactaccttgttggagctgttgccaacccaaagaagccatttgccgctattgttggtggatccaaggtctcaagtaagattggtgtcattgagtcgttgctggcgaaggtcgatatcctcatccttggtggtggt

SEQ ID NO: 950 - DNA, 268 bp, Zea mays
  Clone ID: 700243521H1
catcccgtcgcatcccatcccactaccacccatctcgtcgtccgccgattcgatccggttcttccaacccaggggcagtgatggcgacgaagacgagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccag

SEQ ID NO: 951 - DNA, 292 bp, Zea mays
  Clone ID: 700350430H1
cggctcgagcccgtcgcatcccatcccactaccacgcatctcgtcgtccgccgattcgatccagttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaa

SEQ ID NO: 952 - DNA, 237 bp, Zea mays
  Clone ID: 700150315H1
cccacgcgtccgggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgt

SEQ ID NO: 953 - DNA, 272 bp, Zea mays
  Clone ID: 700350880H1
atcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacgcgaatccgcgcctccgtcccaccatcaagttcctcttcgagaaggcgccaggtcatcccgccactactgggtc

SEQ ID NO: 954 - DNA, 300 bp, Zea mays
  Clone ID: 700093908H1
cccacgcgtccgatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcggcgagcagctaggtcgtccaaaagg

SEQ ID NO: 955 - DNA, 280 bp, Zea mays
  Clone ID: 700076677H1
taccacgcgtccgcatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgcca

SEQ ID NO: 956 - DNA, 255 bp, Zea mays
  Clone ID: 700091547H1
cccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccag

SEQ ID NO: 957 - DNA, 269 bp, Zea mays
  Clone ID: 700458384H1
tcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcacagacgacacccgcatccgcgcctccgtccccaccatcaagttcctcctcgagaagggcgccaaggtcatactcgccagcca

SEQ ID NO: 958 - DNA, 280 bp, Zea mays
  Clone ID: 700222907H1
cccgtcgcatcccatcccactaccacccatctcgtcgtccgccgattcgatccggggcgtccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtcc

SEQ ID NO: 959 - DNA, 270 bp, Zea mays
  Clone ID: 700618842H1
atcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagcca

SEQ ID NO: 960 - DNA, 277 bp, Zea mays
  Clone ID: 700339442H1
cagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggcccatgggagt

SEQ ID NO: 961 - DNA, 294 bp, Zea mays
  Clone ID: 700240067H1
gagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccacgaaaaccttcaacgaagcattggacaccaccaagactgttatttggaacggccccatgggagtgtttgagttcgagaagtttgcagctggaactgaggcgattgctaagaagctagctgagcttacaactacgaagggtgtcact

SEQ ID NO: 962 - DNA, 226 bp, Zea mays
  Clone ID: 700266865H1
aagtatttgaagcctgctgttgccggcttcctcatgcagaaggaacttgactaccttgttggagctgttgccaacccaaagaagccatttgccgctaatgttggtggatccaaggtctcaagtaagattggtgtcattgagtccttgctggcgaaggtcgatatcctcatccttggtggtggtatgatctacacattttacaaggcacaaggatattctgttggaa

SEQ ID NO: 963 - DNA, 269 bp, Zea mays
  Clone ID: 700451654H1
acatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtttcgtgcgcgccgacctcaacgtccctctcgacgacgccctcaagatcaccgacgacacccgcatccgcgcctccgtccccaccatcaagttcctcctcgagaagggcgccaaggtcatcctcgccagc

SEQ ID NO: 964 - DNA, 340 bp, Zea mays
  Clone ID: 700087164H1
cccgtcgcatcccatcccactaccacccatctcgtcgtccgccgattcgatccggttcttccaacccaggggcagtgatggcgacgaagaggagcgtgggcaccctcggtcgaggcggatctgaaggggaagaagctgttcgtgcgcgccgacctcaacgtcccgctcgacggatgcccagaagatcaccgacgacacccgcatccgctcctccgtccccaccatcaagttcctcctcgagaagggcgccaaggtcatcctcgccagccacctgggtcgtccaaaaggtgtcaccccaaagtacagcttgaagccttcttgttccacgcttgtctgagct

SEQ ID NO: 965 - DNA, 299 bp, Zea mays
  Clone ID: 700343701H1
tcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttg

SEQ ID NO: 966 - DNA, 267 bp, Zea mays
  Clone ID: 700800530H1
ccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagcca

SEQ ID NO: 967 - DNA, 278 bp, Zea mays
  Clone ID: 700441116H1
gtcgcatctcatcccactaccacgcatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcaacgacgcccagaagatcaccgacgacacccgcatccgcgcctccgtccccaccatcaagttcctcctcgagaagggcgccaaggtcatcctcgccagctcactgggtcgtcca

SEQ ID NO: 968 - DNA, 336 bp, Zea mays
  Clone ID: 700094769H1
cagacgcgtggtcgctagttctagatcgcgagccgccgcccacgcgtccgatcccgtcgcatcccatcccactaccacccatctcgtcgtccgccgatctgatccggttcctccaacccaagggctgtgatggcgacgaagaggaacgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagcccactgggtcgtccaaaa

SEQ ID NO: 969 - DNA, 261 bp, Zea mays
  Clone ID: 700457925H1
ctcgagccgattcggctcaatcccatcccactaccacccatctcgtcgtccgccgattcgatccagttcttcgaacccaggggctgtgatggcgacgaagaggagcgtgggcaccctcggcgaagcggatctgaaggggaagaaggtgttcgtgcgcgccgacctcaacgtccctctcgacgacgcccagaagatcaccgacgacacccgcatccgcgcctccgtcaccaccatcaagttcctcctcgagaagggcgccaa

SEQ ID NO: 970 - DNA, 258 bp, Zea mays
  Clone ID: 700571062H1
cacatcgcgtcgcatcccatcccactaccacccatctcgtcgtccgctgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtcgccaccatcaagttcctcctcgagaagggcgccaaggt

SEQ ID NO: 971 - DNA, 264 bp, Zea mays
  Clone ID: 700258601H1
atcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgc

SEQ ID NO: 972 - DNA, 271 bp, Zea mays
  Clone ID: 700579874H1
tggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccacgaaaacctcaacgaagcattggacacca

SEQ ID NO: 973 - DNA, 266 bp, Zea mays
  Clone ID: 700454374H1
tcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgcaaaggtcatcctcgccag

SEQ ID NO: 974 - DNA, 275 bp, Zea mays
  Clone ID: 700094413H1
cccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcggcagccacctgggt

SEQ ID NO: 975 - DNA, 326 bp, Zea mays
  Clone ID: 700072959H1
cccacgcgtccgcccacgcgtccgcccacgcgtccgatcccgtcgcatcccatcccactaccacccatctcgtcgtccgccgattcgatccggttcttccaactcaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtcatcctcgccagccacctgggtcgtccaaaaggtg

SEQ ID NO: 976 - DNA, 246 bp, Zea mays
  Clone ID: 700161495H1
agctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcga

SEQ ID NO: 977 - DNA, 243 bp, Zea mays
  Clone ID: 700153976H1
ccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaaggg

SEQ ID NO: 978 - DNA, 250 bp, Zea mays
  Clone ID: 700156134H2
cacatcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggg

SEQ ID NO: 979 - DNA, 258 bp, Zea mays
  Clone ID: 700043126H1
ggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaa

SEQ ID NO: 980 - DNA, 252 bp, Zea mays
  Clone ID: 700159683H1
gtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccacgaaaaccttca

SEQ ID NO: 981 - DNA, 239 bp, Zea mays
  Clone ID: 700157671H1
gccatttgccgctattgttggtggatccaaggtctcaagtaagattggtgtcattgagtcgttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattg

SEQ ID NO: 982 - DNA, 299 bp, Zea mays
  unsure (1)...(299): unsure at all n locations
  Clone ID: 700549008H1
cgtcgtccgccgattcgatccggttcttccaacccaggggcagtgatggcgacgaagacgagcgtgggcaccctcggcgaggcggatctgaaggggaagaaggtgttcgtgcgcgccgacctcaacgtcccgctcgacgatgcccagaagatcaccgacgacatccgcatccgtgcctccgtccccaccatcaagttcctcctctccataggcggcaaggtcatcctcgncagctcactgggtcgtccaaaaggtgtcacgccaaagtacagcttgaagcctctagttccacgcttgtc

SEQ ID NO: 983 - DNA, 241 bp, Zea mays
  Clone ID: 700104417H1
catcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctctcgag

SEQ ID NO: 984 - DNA, 307 bp, Zea mays
  Clone ID: 700094721H1
cagacgcgtggtcgctagttctagatcgcgagcagccgcccacgcgtccgatcccgtcgcatcccatcccactaccacccatctcgtcgtccgccgagacgatccggttcctcccagcccaggggctgtgatggcgacgaagaggagcgtgggcaccctcggcgaagcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcgccaaggtc

SEQ ID NO: 985 - DNA, 159 bp, Zea mays
  Clone ID: 700611620H1
ggcacacagagctcatgcttcaaccgaaggagttaccaagtatttgaagcctgctgttgctggcttcctcatgcagaaggaacttgactaccttgttggagctgttgccaacccaaagaagcaatttgccgctattgttggtggatcaagggtctcaag

SEQ ID NO: 986 - DNA, 262 bp, Zea mays
  Clone ID: 700455655H1
tcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgagcctccgtccccaccatcaagttcctcctcgaaaagggcgccaaggtcatcctcg

SEQ ID NO: 987 - DNA, 265 bp, Zea mays
  Clone ID: 700549606H1
aaggtctcaagtaagattggtgtcattgagtcgttgctggcgaaggtcgatatcctcatccttggtggtggtatgatctacacattttacaaggcacaaggatattctgttggaaaatcttcgtggaagaggatcaacttgagctcgcaacttctcttattgagaaggcgaatgcaaagggggtttctcttttgcttcccactgatattgtagtagcggacgaatttgcagccgatgctgagagcaagattgtccctggcactgc

SEQ ID NO: 988 - DNA, 238 bp, Zea mays
  Clone ID: 700165361H1
cccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcga

SEQ ID NO: 989 - DNA, 237 bp, Zea mays
  Clone ID: 700076792H1
gtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgaga

SEQ ID NO: 990 - DNA, 297 bp, Zea mays
  Clone ID: 700048731H1
gtttgcagctgatgctgagagcaagattgtccctgccactgctatccctgatgactggatgggtcttgatgttggccctgatgccaccagaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgag

SEQ ID NO: 991 - DNA, 194 bp, Zea mays
  Clone ID: 700168266H1
gtcaatgatgcttttggcacggcacacagagctcatgcttcaaccgaatgagttaccaagtatttgaagcctgctgttgctggcttcctcatgcagaaggaacttgactaccttgttggagctgttgccaacccaaagaagccatttgccgctattgttggtggatccaaggtctcaagtaagattggtgtcat

SEQ ID NO: 992 - DNA, 253 bp, Zea mays
  Clone ID: 700045117H1
ctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggcccatggga

SEQ ID NO: 993 - DNA, 318 bp, Zea mays
  Clone ID: 700209421H1
acccacgcgtccgcggacgcgtggatcccgtcgcatcccatcccactaccacccatctcgtcgtccgccaattcgatccgactcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccagcatcaagttcctcctcgagaagggcgccaaggtcatcctcgccagccacctgggtcgtccaaaggtgtcacc

SEQ ID NO: 994 - DNA, 235 bp, Zea mays
  Clone ID: 700806575H1
ccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctc

SEQ ID NO: 995 - DNA, 279 bp, Zea mays
  Clone ID: 700456047H1
cctcgagccgattcggctcgagtcccatcccactaccacccatctagtcgtccgccgattcacatccggttcttccaacccacgggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagttcctcctcgagaagggcggcaaggtcatcctcgccag

SEQ ID NO: 996 - DNA, 227 bp, Zea mays
  Clone ID: 700623432H1
gttgctggcttcctcatgcagaaggaacttgactaccttgttggagctgttgccaacccaaagaagccatttgccgctattgttggtggatccaaggtctcaagtaagattggtgtcattgagtcgttgctggcgaaggtcgatatcctcatccttggtggtggtatgatctacacattttacaaggcacaaggatattcctgttggaaaatctctcgtgggaagag

SEQ ID NO: 997 - DNA, 309 bp, Zea mays
  Clone ID: 700569724H1
ggctggcatgggtcttgatgttggcgctgatgccaccacaacattcaacgaagcattggacaccaccaagactgttatttggaacggccacatgggagtgtttgagttcgagaagtttgcagctggcactgaggcgattgccaagaagctagctgagcttacaaccacgaagggtgtcactaccatcatcggcggcggcgactctgttaaggctgtcgagaacgctgggctggccgacaagatgagccacatttcgaccggcggcggtgcgagcttggagatcttggaaggcaagatctactggtgtcc

SEQ ID NO: 998 - DNA, 289 bp, Zea mays
  Clone ID: 700220377H1
gccacgcgtccggccacgcgtccgcggacgcgtgggctgttggaaaatctctcgtggaagaggataaacttgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccacgaaaaccttcaacgaagcattggacaccaccaagactgttatttggaa

SEQ ID NO: 999 - DNA, 248 bp, Zea mays
  Clone ID: 700336275H1
cccaaagtacagcttgaagcctcttgttccacgcttgtctgagcttcttggagttgaagtcgtgatggccaatgattgcattggtgaagaagttgagaagttggctgcacgtttgccagaaggtggagttctgctcctagagaatgttagattctacaaggaggaagagaagaacgaacctgagtttgctaagaagctagcatctgttgctgaccttatgtcaatgatgctttggcacggcacacaga

SEQ ID NO: 1000 - DNA, 229 bp, Zea mays
  Clone ID: 700151932H1
atcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaag

SEQ ID NO: 1001 - DNA, 228 bp, Zea mays
  Clone ID: 700258488H1
cccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctccgtccccaccatcaagt

SEQ ID NO: 1002 - DNA, 282 bp, Zea mays
  Clone ID: 700333184H1
catcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccaactgggtcgtc

SEQ ID NO: 1003 - DNA, 168 bp, Zea mays
  Clone ID: 700236590H1
agaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaa

SEQ ID NO: 1004 - DNA, 270 bp, Zea mays
  Clone ID: 700440409H1
atcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgt

SEQ ID NO: 1005 - DNA, 221 bp, Zea mays
  Clone ID: 700615448H1
agaagaacgaacctgagtctgctaagaagctagcatctgttgctgacctttatgtcaatgatgcttttggcacggcacacagagctcatgcttcaccgaagagttacaagtattgaagctgctgttgctggctctcatgcagaagaacttgactacctgtggagctgtgccaaccaagaagcatgcgtatgtgtgaccagccagagatggcatgagcgtct

SEQ ID NO: 1006 - DNA, 236 bp, Zea mays
  unsure (1)...(236): unsure at all n locations
  Clone ID: 700023196H1
gtcattgagtcgtnctggcgaaggncgatatcctcatccttggtggtggtatgatctacacattttacaaggcanagggatattctgttggaaaatctctcgtggaagaggataaactcgagctcgcaacttctcttattganaaggcgaaggcaaagggggtttctcttttgcttcccantgatattgtagtagcggacaagtttgcagncgatgctgagagcaagantgtccct

SEQ ID NO: 1007 - DNA, 276 bp, Zea mays
  Clone ID: 700577864H1
gatgccacgaaaaccttcaacgaagcattggacaccaccaagactgttatttggaacggccccatgggagtgtttgagttcgagaagtttgcagctggaactgaggcgattgccaagaagctagctgagcttacaaccacgaagggtgtcactaccatcatcggcggcggcgactctgtcgctgctgtcgagaaggctgggctggcggacaagatgagccacatttcgaccggcggcggtgcgagcttggaactcttggaaggcaagactctacct

SEQ ID NO: 1008 - DNA, 298 bp, Zea mays
  Clone ID: 700073368H1
cggacgcgtgggcggacgcgtgggcggacgcgtgggtgttggccctgatgccaccaaaacattcaacgaagcattggacaccaccaagactgttatttggaacggccccatgggcgtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaa

SEQ ID NO: 1009 - DNA, 288 bp, Zea mays
  unsure (1)...(288): unsure at all n locations
  Clone ID: 700344214H1
tcncatcccactaccacgcatctcgtcgtccgccgattcgatccggttctaccaacccaggggcagtgatggcgacgaggaggagcgtgggcaccctcggcgaggcggatctgaaggggaagaaggtgttcgtgcgcggcgacctcagcgtcccgctcgacgctgcccagaagaccaccgacgacacccgcatccgcgcctccgtccccaccatcaagttcctcctcgagaagggcgccaaggtcatcctcgccagtcacctgggtcgtcccncaggtgtcaccccaa

SEQ ID NO: 1010 - DNA, 223 bp, Zea mays
  Clone ID: 700019682H1
gcacgaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagact

SEQ ID NO: 1011 - DNA, 212 bp, Zea mays
  Clone ID: 700153175H1
aagtaagattggtgtcattgagtccttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcgg

SEQ ID NO: 1012 - DNA, 278 bp, Zea mays
  Clone ID: 700236532H1
gttggccctgatgccaccaaaacattcaacgaagcattggacaccaccaagactgttatttggaacggccccatgggagtgtttgagttcgagaagttttcagctggcactgaggcgattgccaagaagctagctgagcttacaaccacgaagggtgtcactaccatcatcggcggcggcgactctggtgctgctgtcgagaaggctgggctggccgacaagatgagccacatttcgaccggcggcggtgcgagcttggaactcttggaaagcaagac

SEQ ID NO: 1013 - DNA, 169 bp, Zea mays
  Clone ID: 700263441H1
ccaggggcagtgatggcgacgaagaggagcgtgggcaccctcggcgaggcggatctgaaggggaagaaggtgttcgagcgcgccgacctcaacgtcccgctcgacgatgcccagaagatcaccgacgacacccgcatccgcgcctccgtccccaccatcaagttcctcc

SEQ ID NO: 1014 - DNA, 155 bp, Zea mays
  Clone ID: 700473818H1
aggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacaca

SEQ ID NO: 1015 - DNA, 187 bp, Zea mays
  Clone ID: 700471618H1
ccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatc

SEQ ID NO: 1016 - DNA, 210 bp, Zea mays
  Clone ID: 700612632H1
gtcgcatcccatcccactaccacccatctcgtcgtccgccgattcgatccggttcttccaacccaggtgatggcgacgaagaggagcgtgggcaccctcggcgaggcggatctgaaggggaagaaggtgttcgtgcgcgccgacctcaacgtcacgctcgacgatgcccagaagatcaccgacgacacccgcatccgcgcctccgtcccc

SEQ ID NO: 1017 - DNA, 251 bp, Zea mays
  Clone ID: 700266580H1
gaggcgattgccaagaagctagctgagcttacaaccacgaagggtgtcactaccatcatcggcggcggcgactctgtcgctgctgtcgagaaggctgggctggcggacaagatgagccacatttcgaccggcggcggtgcgagcttggaactcttggaaggcaagactctacctggtgtccttgccctcgatgacgcctagatccgctgctgctgctgctgctgctactcaggttctgccagctttgcgtg

SEQ ID NO: 1018 - DNA, 184 bp, Zea mays
  Clone ID: 700474244H1
ctaccacccatctcgtcgtccgccgattcgatccggttcttccaacccaggggcagtgatggcgacgaagaggagcgtgggcaccctcggcgcggcggatctgaaggggaagaaggtgttcgtgcgcgccgacctcaacgtcccgctcgacgatgcccagaagatcaccgacgagacccgcatc

SEQ ID NO: 1019 - DNA, 253 bp, Zea mays
  Clone ID: 700195129H1
gagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctg

SEQ ID NO: 1020 - DNA, 337 bp, Zea mays
  Clone ID: 700104765H1
ctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccgcacatggacttttggggataggcttgccaccgtgttttgctagatgagtcgtggaataag

SEQ ID NO: 1021 - DNA, 276 bp, Zea mays
  Clone ID: 700029314H1
caagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaagg

SEQ ID NO: 1022 - DNA, 279 bp, Zea mays
  Clone ID: 700041618H1
gcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccgcacatg

SEQ ID NO: 1023 - DNA, 328 bp, Zea mays
  Clone ID: 700050511H1
gaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggact

SEQ ID NO: 1024 - DNA, 228 bp, Zea mays
  Clone ID: 700195775H1
gaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctg

SEQ ID NO: 1025 - DNA, 250 bp, Zea mays
  Clone ID: 700195425H1
tgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagc

SEQ ID NO: 1026 - DNA, 238 bp, Zea mays
  Clone ID: 700440268H1
tggcactgaggcgatagccaagaagctagctgagactacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgctagatccgctgctgctgctgctactcaggttctg

SEQ ID NO: 1027 - DNA, 251 bp, Zea mays
  Clone ID: 700160639H1
gctggaactgaggcgattgccaagaagctagctgagcttacaaccacgaagggtgtcactaccatcatcggcggcggcgactctgtcctgctgtcgagaaggctgggctggcggacaagatgagccacatttcgaccggcggcggtgcgagcttggaactcttggaaggcaagactctacctggtgtccttgccctcgatgacgcctagatccgctgctgctgctgctgctgctactcaggttctgccagc

SEQ ID NO: 1028 - DNA, 250 bp, Zea mays
  Clone ID: 700617741H1
acttgagctcgcaacttctcttattgagaaggcgaaggcaaagggggtttctcttttgcttcccactgatattgtagtagcatacaagtttgcagctgatgctgagagcaagattgtcctgccactgctatccctgatgactggatgggtcttgatgttggccctgatgccaccaaaacattcaacgaagcattggacaccaccaagactgttatttggaacggccccatgggagtgtttgagttcgaga

SEQ ID NO: 1029 - DNA, 272 bp, Zea mays
  Clone ID: 700578506H1
acgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagacttcaacctggtgtccttgccctggatgacgcctagatcggctgcggctgctgctactcaggtcctgcaagcttgcgggtcaa

SEQ ID NO: 1030 - DNA, 311 bp, Zea mays
  Clone ID: 700618491H2
tggatattctgttggacaatctctcgtggaagaggtcaacttgagctacgaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacatccacaagactgttatttggaacggcccatgggagtgtttgagttcgagaagttgcagctggcactgaggcga

SEQ ID NO: 1031 - DNA, 268 bp, Zea mays
  Clone ID: 700803231H1
gggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttct

SEQ ID NO: 1032 - DNA, 267 bp, Zea mays
  Clone ID: 700195008H1
gaagtttgcagctggcactgaggcgattgccacgaagctagctgagcttacaaccacgaagggtgtcactatcatcatcggcgtcggcgactctgttgctgctgtcgagaaggctgggctggccgacaagatgagccacatttcgaccggcggcggtgcgagcttggaactcttggaaggcaagactctacctggtgtccttgccctctatgacgcctagatccgctgctgctgctgctactcaggttctgccaactttgcgtgtca

SEQ ID NO: 1033 - DNA, 184 bp, Zea mays
  Clone ID: 700257337H1
atcccgtcgcatagcatcccacaaccacccatctcgtcgtccgccgattcgatccggttcttccaacccaggggcagtgatggcgacgaagaggagcgtgggcaccctcggcgaagcggatctgaaggggaagaaggtgttcgtacgcaccgacctcaacgtcccgctcgacgatgcccagaag

SEQ ID NO: 1034 - DNA, 163 bp, Zea mays
  Clone ID: 700153701H1
ggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcag

SEQ ID NO: 1035 - DNA, 189 bp, Zea mays
  unsure (1)...(189): unsure at all n locations
  Clone ID: 700458028H1
tgatgttggccctgatgccaccaaaacattacaacgaagacattggacaccaccaagactgttatttggaacggccccatgggagtgtttganttcgagaagtttgacagctggcactgaggcgattgccaagaagctagctgagcttacaaccacgaagggtgtcactaccatcatacggcggcggcg

SEQ ID NO: 1036 - DNA, 276 bp, Zea mays
  Clone ID: 700350024H1
cttgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggacttgatgttggccctgatgccacgaaaaccttcaacgaagcattcggacaccaccaagactgttatttggaacggccccatgggagtgtttgagttcgagaagttgcagctggaactgagcgatgc

SEQ ID NO: 1037 - DNA, 179 bp, Zea mays
  Clone ID: 700150871H1
cccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaaggtcccgctcgacgatccccaa

SEQ ID NO: 1038 - DNA, 169 bp, Zea mays
  Clone ID: 700804078H1
cggcgactctgtcgctgctgtcgagaaggctgggctggcggacaagatgagccacatttcgaccggcggcggtgcgagagtggaactcttggaaggcaagactctacctggtgtccttgccctcgatgacgcctagatccgctgctgctgctgctgctgctactcaggt

SEQ ID NO: 1039 - DNA, 168 bp, Zea mays
  Clone ID: 700267617H1
ccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcga

SEQ ID NO: 1040 - DNA, 276 bp, Zea mays
  Clone ID: 701165809H1
gactctgatgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccgcacatggacttttggggataggcttgcaccgtgttttgctagatga

SEQ ID NO: 1041 - DNA, 268 bp, Zea mays
  Clone ID: 700552775H1
atatgatctacacattttacaaggcagaaggatattctgttggaaaatctctcgtggaagaggataaacttgagctcgcaacttctcttattgagaaggcgaaggcaaagggggtttctcttttgcttcccactgaattgtagtagcggacaagtttgcagccgatgctgagagcaagattgtccctgccactgctatccctgatgactggatgggtcttgatgttggccctgatgccacgaaaaccttcaacgaagcattggacacc

SEQ ID NO: 1042 - DNA, 272 bp, Zea mays
  Clone ID: 700616491H1
ggatattctgttggaaaatctctcgtggaagaggataaacttgagctcgcaacttctcttattgagaaggcgaggcaaagggggttctcttttgcttcccactgtatttagtagcggcaatttgcactgatgctgagacaagatttcctgcactgctatcctgatgactggatggctatttggctgatgccacaacatcacgaacattgcccacagctgttattgacggccatggatttagtcgaaattcactgcatgaggcgatcagaact

SEQ ID NO: 1043 - DNA, 134 bp, Zea mays
  Clone ID: 700450825H1
acatcccgtcgcatcccatcccactaccacccatctcgtcgtccgccgattcgatccggttcttccaacccaggggctgtgatggcgacgaagaggagcgtgggcaccctcggcgatgcggatctgaaggggaa

SEQ ID NO: 1044 - DNA, 125 bp, Zea mays
  Clone ID: 700334736H1
cggatattctgttggaaaatctctcgtggaagaggataaacttgagctcgcaacttctcttattgagcaggcgaaggcaaagggggtttctcttttgcttcccactgatattgtagtagcggaca

SEQ ID NO: 1045 - DNA, 120 bp, Zea mays
  unsure (1)...(120): unsure at all n locations
  Clone ID: 700202264H1
tgtcgcatctcatcgcactaccacccatctcgtcgtccgccgattcgatccggttcttccaacccaggggcagtgatggcgacgaagaggagcgtgggcaccctcggcgangcggatctg

SEQ ID NO: 1046 - DNA, 84 bp, Zea mays
  Clone ID: 700583352H1
caaggtcatcctcgccagccacctgggtcgtccaaaaggtgtcaccccaaagtacagcttgagagctcttgttcaacacaacat

SEQ ID NO: 1047 - DNA, 133 bp, Zea mays
  Clone ID: 700802543H1
atcccgtcgcatcccatcccactaccacccatctcgtcgtctgccgattcgatccggttcttccaacccaggggctgtcttggcgacgaagaggagcgtgggcaccctcggcgaggcggatctgaaggggaag

SEQ ID NO: 1048 - DNA, 220 bp, Zea mays
  Clone ID: 700018689H1
gcacgaggagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccacacatggactttcgaggataggcttgc

SEQ ID NO: 1049 - DNA, 301 bp, Zea mays
  unsure (1)...(301): unsure at all n locations
  Clone ID: LIB3062-018-Q1-K1-F2
atcgtgtgcacatgcacaaataggtgataaaggcagatgatgttgttggaccagaagtgganaagttggtgtctgcattgccaaacggtaatgttgtgctccttgaaaatgttagattctacaaggaggaagagaagaatgacccagagtttgcaaagaagcttgcctctttagcagatctttatgtgaacgatgcctttggaactgctcacagagcacatgcgtcaactgagggagttaccaagttcttgaagccctcagtcgcagggttccttttgcaaaaggagcttgattaccttgt

SEQ ID NO: 1050 - DNA, 432 bp, Zea mays
  Clone ID: LIB3062-049-Q1-K1-H7
ggttcttccttggttgaagatgacaagcttgagcttgcgacctctctccttagaagagcggaggagaagggtgtctcccttatgttgccattcgatctggtcgtcgctgataagtttgctcctgatgctagcagtcagctctccaggttgttcctgcatctgcaattcctgatgcatggatgggtctggacataggtccagattcgatttcggcgttcagttctgccctggaaactactcagacagtcatctggaatggacccatgggagtttttgaatttgacaagtttgcagttggaaccaaggcaattgcaaagaagttagccgagcttagtggcaagggcgtcactacaatagttggtgggggagactccattgcagctgttgaaaagggtggtgtcgccgactctctgagccacatttcaactgggg

SEQ ID NO: 1051 - DNA, 137 bp, Zea mays
  Clone ID: LIB3067-004-Q1-K1-A5
ctcgagaagggcgccaaggtcatcctcgccagccacctgggtcgtccaaaaagtgtcaccccaaagtacagcttgaagcctcttgttccacgcttgtctgagctccttggagttgaaagtctgatggccaatgattg

SEQ ID NO: 1052 - DNA, 441 bp, Zea mays
  unsure (1)...(441): unsure at all n locations
  Clone ID: LIB3078-050-Q1-K1-D12
tgacaagttcgccgtaggaaccgaggctgtggcaaagaagctggcagaactcagcggcgggggcgtcacaactatcatcggaggtggagactccgtcgccgccgtcgagaaggtgggagttgctgacgttatgagccacatttccacgggtggtggcgctagcctggaattgttggaaggaaaggagcttccgggagttgttgccttgaatgaagccgccactgtgactgtatgaagcatgctttcattttgtttcgtcttcgtcttcatgtgccgttgtatacttgctacattctcgcttgcacctncccagccgctcgctcgaaatgtaagagaccaatgttttatagagccaatggaaatcgtttgaacaacgacgacccatatagtatgtgctttaccgaagtgatctttcctcggtaacgtactagtgatataaaa

SEQ ID NO: 1053 - DNA, 279 bp, Zea mays
  Clone ID: LIB3078-049-Q1-K1-H7
ctagcctggaattgttggaaggaaaggagcttccgggagttgttgccttgaatgaagccgccactgtgactgtatgaagcatgctttcattttgtttcgtcttcgtcttcatgtgccgttgtatacttgctacattctcgcttgcacctccccagccgctcgctcgaaatgtaagagaccaatgttttatagagccaatggaaatcgtttgaacaacgacgacccaaatagtatgtgctttaccgagtgatctttcctcggtaacgtaactagtgatat

SEQ ID NO: 1054 - DNA, 433 bp, Zea mays
  Clone ID: LIB3078-002-Q1-K1-C4
gcgcaagccgtccggttccttctgcagaaggaactcgactaccttgtcggagctgtttcaagccctaaacgcgcttttgctgccatcgtgggtggttcaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcaacgtctctacttgcaaaggctaaggaaaagggtgtctcccttatgctgccaaccgatgttgtcattgctgacaagtttgcccctgatgctaacagccagattgttccagcatctgcaattcctgatggttggatgggcctggatattggcccagattctgtcgcttcattcaacgcagccctgg

SEQ ID NO: 1055 - DNA, 392 bp, Zea mays
  unsure (1)...(392): unsure at all n locations
  Clone ID: LIB36-001-Q1-E1-B11
gcgtattagtgcgcgccgacctcaacgtgccgctcgacgagaaccagaacatcaccgacgacacccgcatccgggccgccatccccaccatccagtacatcctcagcaagggcgccaaggtcatcctctcaagccacttgggtcgccctaagggttttacacccaagtttagcttagctccccttgtaggacggttgtctgagcttcttggcattcaggtgcaaaaagccgacgatgttattggccctgaagttgagaggctggtggcggccttgcccaacggtggggttctgctgcttgagaacgtaagattctacaaggaanaggagaagaatgacccagagtttgcacagaagcttgcctccctagcagatctttatgttaacgatgca

SEQ ID NO: 1056 - DNA, 413 bp, Zea mays
  Clone ID: LIB36-009-Q1-E1-G7
caaagttcttgaagccttctgttgcagggttccttttgcagaaggagcttgactaccttgtcggagctgtttcaagccctacacgcccatttgctgccatcgtgggtggttcaaaggtgtcatccaagatcggggttattgaatccttgttggagaagtgtgatatccttctcttgggtggtggtatgatcttcacattttacaaggcacaaggtctttctgtcggtgcttcgttggttgaggaagacaaactcgatcttgcaacatctctacttgcaaaggctaaggaaaagggtgtctcccttatgttgccaaccgatgttgtcatcgctgataagtttgctcctgatgctaacagccagattgttccagcatctgcaattcctgatggttggatggggctggatattggg

SEQ ID NO: 1057 - DNA, 344 bp, Zea mays
  Clone ID: LIB3078-003-Q1-K1-G10
gcttgagaacgtaagattctacaaggaagaggagaagaatgacccagagtttgcacaggggcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttaca

SEQ ID NO: 1058 - DNA, 430 bp, Zea mays
  Clone ID: LIB36-008-Q1-E1-H5
gaagaatgacccagagtttgcacagaagcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatcgtgggtggttcaaaggtgtcatccaagatcggggttattgagtccctgttggagaagtgtgatatccttctcttgggtggtggtatgatcttcacgttttacaaggcacaaggtctccctgttggtgcttcattggtcgaggaagacagacgcgagcttgcgacgtctctccttgcacaggctaaggaaaagggcctctcccttatggcgccaactgatgtt

SEQ ID NO: 1059 - DNA, 403 bp, Zea mays
  Clone ID: LIB3078-014-Q1-K1-F7
cggacgcgtgggcggacgcgtgggaaaggtgtcatccaagatcggggttattgagtccctgttggagaagtgtgatatccttctcttgggtggtggtatgatcttcacgttttacaaggcacaaggtctccctgttggtgcttcattggtcgaggaagacaaactcgagcttgcaacgtctctacttgcaaaggctaaggaaaagggtgtctcccttatgctgccaaccgatgttgtcattgctgacaagtttgcccctgatgctaacagccagattgttccagcatctgcaattcctgatggttggatgggcctggatattggcccagattctgtcgcttcattcaacgcaagcctggatacaaccaagacggtcatctggaacgggcccatgggtggcttc

SEQ ID NO: 1060 - DNA, 403 bp, Zea mays
  Clone ID: LIB36-017-Q1-E1-D8
acatgtaggacggttgtctgagcttcttggcattcaggtgcaaaaagccgacgatgttattggccctgaagttgagaagctggtggcggccttgcccaacggtggggttctgctgcttgagaacgtaagattctacaaggaagaggagaagaatgacccagagtttgcacagaagcttgcctccctagcagatctttatgttaacgatgcatttggaacagcccacagggcgcatgcatcgaccgagggagttaccaagtttttgcagccttctgttgcagggttccttctgcagaaggaactcgactaccttgtcggagctgtttcaagccctaaacgcccttttgctgccatccgtggtggttcaaacgtgtcatccaggatcggcgttattgaatccctg

SEQ ID NO: 1061 - DNA, 427 bp, Zea mays
  Clone ID: LIB3078-052-Q1-K1-F3
ggctaaggaaaagggtgtctcccttatgttgccaaccgatgttgtcatcgctgataaggttgctcctgatgctaacagccagattgttccagcatctgcaattcctgatggttggatggggctggatattggcccagattccattgctgcattcaacgcagccctggaaacaacccatactgtcatctggaacgggcccatgggtgtttttgaatatgacaagttcgctataggaactgaagctgtggcaaagaagttggcagaacttagccgcatgggtgtgacaactatcatcggaggtggagactctagtcccggctttgagaatgtctgagttgctgacgttatgagccacatttccaccggatgtggttccagcttggaaatgttggaaggtaaggagctttcaggagttactgcattggat

SEQ ID NO: 1062 - DNA, 441 bp, Zea mays
  unsure (1)...(441): unsure at all n locations
  Clone ID: 11-LIB189-015-Q1-E1-C11
cttcncttgggtgggtgggtatgatcttcacgttttacaaagggcacaaagggtccccctgttnggtgcttcattgggtcnaaggaagacaaaactccgaagccttgcaaacgtctctactttgcaaagggctaaaggaaaagggtgtctcccttatgctgccaaccgatgttgtcattgctgacaagtttgcccctgatgctaacagccagattgttccagcatctgcaattcctgatggttggatgggcctggatattggcccagattctgtcgcttcattcaacgcagccctggatacaaccaagacggtcatctggaacgggcccatgggtgtcttcgaatttgacaagttcgctgtaggaaccgangctgtggcaaagaanctggcaaaactcaaccgnnaangggcttcanaactatcatcggagggcgggaaac

SEQ ID NO: 1063 - DNA, 364 bp, Zea mays
  unsure (1)...(364): unsure at all n locations
  Clone ID: LIB143-014-Q1-E1-A9
aggcgggtgtcgtaggaatacaattgtcggaagccnngaagnnnntaaatgncggggccccccacgcgtccgcatcgcatcccatcccactaccacccatctcgtcgtccgccgattcgatccggttcttccaacccagggtgagtctccggatccgtcgccgtctggtatccgtgtgctctcgtcgccgtcgccgtcgccgccgtctgactgcccccctcgcctcccgcggcgtcgggtctctggtgctgctgctgctgctgctgctgctgcgtgcagggcagtgatggcgacgaagaggagcgtgggcaccctcggcgaggcggatctgaaggggaagaaggtgttcgtgcgcgccgacctc

SEQ ID NO: 1064 - DNA, 429 bp, Zea mays
  unsure (1)...(429): unsure at all n locations
  Clone ID: LIB3060-012-Q1-K1-H11
gttctgctcctagagaatgttagattctacaaggaggaagagaagaacgaacctgaggttgctaagaagctagcatctgttgctgacctttatgtcaatgatgcttttggcacggcacacagagctcatgcttcaaccgaaggagttaccaagtatttgaagcctgctgttgccggcttcctcatgcagaaggaacttgactaccttgttggagctgttgccaacccaaagaagccatttgccgctattgttggtggatccaaggtctcaagtaagattggtgtcattgagtccttgctggcgaaggtcgatatcctcatccttggtggtggtatgatctacacattttacaaggcacaaggatattctgttggaaaatctctcgtggaagaggataaactngagctcgcaacttctcttattgagaac

SEQ ID NO: 1065 - DNA, 439 bp, Zea mays
  Clone ID: LIB3069-045-Q1-K1-C4
catcccgtcgcatcccatcccactaccacctatcttttcgtccgccgattcgatccggttgttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatacgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgagtcgtgatggccaatgattgcattggtgaagaagttgagaagttggctgccgctttgccagaaggtggagttctgctcctagagaat

SEQ ID NO: 1066 - DNA, 425 bp, Zea mays
  Clone ID: LIB3059-047-Q1-K1-A8
catcccgtcgcatcccatcccactaccacccatctcgtcgtccgccgattcgatccggttcttccaacccaagggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaagggtgtcaccccaaagtacagcttgaagcctcttgttccacgcttgtctgagctccttggagttgaagtcgtgatggccaatgattgcattggtgaggaagttgagaaattggctgccgctttgccggaaggtggagtt

SEQ ID NO: 1067 - DNA, 422 bp, Zea mays
  Clone ID: LIB189-027-Q1-E1-D10
agagagaagaacgaacctgagtttgctaagaagcttgcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgccattgttggtggatccaaggtctcaactaagattggtgtcattgagtcgttgctggcgaaggtcgatatcctcatccttggtggtggtatgatctacacattttacaaggcacagggatattctgttggaaaatctctcgtggaagaggataaactcgaactcgcaaaatttcccatattgaaagggcaagggcaaagggggtttctcttttc

SEQ ID NO: 1068 - DNA, 424 bp, Zea mays
  Clone ID: LIB83-006-Q1-E1-F2
ggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccg

SEQ ID NO: 1069 - DNA, 434 bp, Zea mays
  Clone ID: LIB3060-017-Q1-K1-G5
caaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttc

SEQ ID NO: 1070 - DNA, 386 bp, Zea mays
  Clone ID: LIB143-011-Q1-E1-B6
cttaatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaagaagttgagaagttg

SEQ ID NO: 1071 - DNA, 639 bp, Zea mays
  unsure (1)...(639): unsure at all n locations
  Clone ID: LIB3059-006-Q1-K1-A4
agattnagagggcgtcgtattcaggctggattggtagccgtanagctatggcggtacncggtctcggaatatacccgggtcgacnccacgccgnntccgcaaggggtgctcaaccttaagaattggtggtcattttgtagtctgttgcttggctgaaggggtcganntatccgtgcatcctnntggtggtngnngtatgatnnctacacannttttatcaaggggcaccagggnnagtattcnntgttgnngaaaatcntnnctcgtcggaagagggataatnnactcgagccttcgcannnacttctctttannttgagaagggggcgaaggcataaagagggggtttcttcttttttgcgttctccacctggagtatttgtagtatgccggacccacagtttgtcagccccgatgccttgagtaagcaagaaattggtcccttgcnctacttgctatctnnnctgatgactngcgatnngggtcttgggatgttgtgcccttgattgccactcataaacccattctgacgaagccattgtgacactcaccccaagacttggtgtatttggaaccggcgcccatggggaagatgtttgagtttccaccaagttttgcagcttggcacccgaggcgaat

SEQ ID NO: 1072 - DNA, 454 bp, Zea mays
  Clone ID: LIB143-011-Q1-E1-E3
tagcaatatactagcgactcagcactgacacgcgtgtggtcatacaggcctctagattgagtcatattagccagaaggtggagttctgctcctatagaatgttagattctacaaggaggaagagaagaacgaacctgagtttgctaagaagctagcatctgttgctgacctttatgtcaatgatgcttttggcacggcacacagagctcatgcttcaaccgaaggagttaccaagtatttgaagcctgctgttgctggcttcctcatgcagaaggaacttgactaccttgttggagctgttgccaacccaaagaagccatttgccgctattgttggtggatccaaggtctcaagtaagattggtgtcattgagtcgttgctggcgaaggtcgatatcctcatccttggtggtggtatgatctacacattttacaaggcacaaggatattctgtt

SEQ ID NO: 1073 - DNA, 428 bp, Zea mays
  Clone ID: LIB3059-041-Q1-K1-D2
cccacgcgtccggtcattgagtcgttgctgtcgaaggtcgatatcctcatccttggtggtgggatgatctacacattttacaaggcacagggatattctgttggaaaatctctcgtggaagaggataaactcgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcagctggcaccgaggcgattgccaagaagctagctgagcttac

SEQ ID NO: 1074 - DNA, 459 bp, Zea mays
  Clone ID: LIB3079-002-Q1-K1-H3
cccacgcgttcggagctgttgccaacccaaagaagccatttgccgccattgttggtggatgcaaggtctcaactaagattggcgtcattgagtcgttgctggcgaaggtcgatatcctcatccttggtggtggtatgatctacacattttacaaggcacagggatattctgatggaaaatctctcgtggaagaggataaactcgagctcgcaacttctcttattgagaaggcgaaagcaaagggggtttctcttttgcttcccactgatattgtagtagcggacaagtttgcagccgatgctgagagcaagattgtccctgccactgctatccctgatgactggatgggtcttgatgttggccctgatgccaccaaaacattcgacgaagcattggacaccaccaagactgttatttggaacggccccatgggagtgtttgagttccagaagtttgcac

SEQ ID NO: 1075 - DNA, 450 bp, Zea mays
  unsure (1)...(450): unsure at all n locations
  Clone ID: LIB3061-049-Q1-K1-G6
cggctatgcgtgnagcttcatctcgaaaacaaaagcgtaccacccnctgagttcagttcccgggacggcgtacgataccatcccactaccacccatctcgtcgttcgccgattcgatccggttcttccaacccagggggtgggggggcgacgaagaggagcgtgggcaccctcggcgaggcggatctgaacgtgaagaaggtgttcgtgcgcgccgacctcaacgtacctctcgacgacgcccagaagatcaccgacgacacccgcatccgcgcctacgtccccaccatcaagttcctcctcgagaaaggcgccaaggtcatcctcgccagccacctgggtcgtccaaaaggtgttaccccaaagtacagcttgaaacctcttggtccacgcttgtctgagcttcttggagttgaagtcgtgatggccaatgattgcattggtgaggaag

SEQ ID NO: 1076 - DNA, 511 bp, Zea mays
  unsure (1)...(511): unsure at all n locations
  Clone ID: LIB3059-038-Q1-K1-H8
nagttntagatcgtgttctaatacagacgacggaaagtaactgtcaaaccgttcggaattccggttccaggctacgacccacgcgtccgcggacgcgtgggcggacgcgtgggtcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgattctgtcgctgctgtcgagaaggctgggctggccgacaagatg

SEQ ID NO: 1077 - DNA, 383 bp, Zea mays
  Clone ID: LIB3062-017-Q1-K1-D10
atcccgtcgcatcccatcccactaccacccatctcgtcgtccgccgattcgatccggggcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttggagttgaagtcgtgatggccaatgattgcattggtgaag

SEQ ID NO: 1078 - DNA, 377 bp, Zea mays
  unsure (1)...(377): unsure at all n locations
  Clone ID: LIB3059-022-Q1-K1-C10
aaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgangcgattgccaagaagctagctgagcttacaaccacgaanggtgtcactaccatcatncgcggcggcgattctgtcgctgctgt

SEQ ID NO: 1079 - DNA, 414 bp, Zea mays
  Clone ID: LIB3059-027-Q1-K1-C7
gaaaatctttcgtggacgaggataaacttgagctcgcaacttctcttattgagaaggggaatgcacagggggcttctcttttgcttcccactgatattgtagtagcggacaagtttgcagctgatgctgagagcaagattgtccctgccactgctatccctgatgactggatgggtctcgatgttggccctgattccaccaaaacattcaacgaatcattggacaccaccaagactgttatttggaacggccccatgggagtgtttgagttcgagaagtttgcaactggcactgaggcgattgccaagaagctagctgagcttacaaccacgaagggtgtcactaccatcatcggctgccacgactctgttgctgctgtctagaaagctaggctgtccgacaagatgaaccaca

SEQ ID NO: 1080 - DNA, 386 bp, Zea mays
  Clone ID: LIB3060-011-Q1-K1-A10
ggttgaggtggcttcttacacacaatgttatatttttcccgggactgataataacggggctctggtggcttataaaattgcatctcttgctgacctttatgtcaatgatgcttttggcacggcacacaaagctcatgcttcaacccaaggagttaccaagtatttgaagcctgctgttgccggcttcctcatgcataatgaacttgactaccttgttggaactgttgccaacccaaagaagccatttgccgctattgttggtggatccaaggtctcaagtaagattggtgtcattgaatccttgctggcgaaagtcgatatccttatccttggtggtggtatgatctacacattttacaaagcacaaggatattctgttggaaaat

SEQ ID NO: 1081 - DNA, 431 bp, Zea mays
  Clone ID: LIB3067-046-Q1-K1-A9
ggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatg

SEQ ID NO: 1082 - DNA, 370 bp, Zea mays
  Clone ID: LIB3061-049-Q1-K1-G5
atcccgtcgcatcccatcccagtaccacccatctcgtcgtccgccgattcgatccggttcttccaacccaggggctgtgggggcgacgaagaggagcgtgggcaccctcggcgaggcggatctgaaggtgaagaaggtgttcgtgcgcgccgacctcaacgtccctctcgacgacgcccagaagatcaccgacgacacccgcatccgcgcctacgtccccaccatcaagttcctcctcgagaagggcgccaaggtcatcctcggcagccacctgtgtcgtgcaaaaggtgtcaccctaaagtacagcttgaagcctcttgatccacgcttgtctgagctccttggagttgaagtcgtgatggccaatgat

SEQ ID NO: 1083 - DNA, 339 bp, Zea mays
  Clone ID: LIB3067-007-Q1-K1-E6
ggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagttgttgagtt

SEQ ID NO: 1084 - DNA, 470 bp, Zea mays
  Clone ID: LIB143-052-Q1-E1-C5
taacatcgccaggcagactcaatactaggactcgcgggccgatacaagcctctagcatgagtctcactaccactgctatccctgatgactggatgggtcttgatgttggccctgatgccacgaaaaccttcaacgaagcattggacaccaccaagactgttatttggaacggccccatgggagtgtttgagttcgagaagtttgcagctggaactgaggcgattgccaagaagctagctgagcttacaaccacgaagggtgtcactaccatcatcggcggcggcgactctgtcgctgctgtcgagaaggctgggctggcggacaagatgagccacatttcgaccggcggcggtgcgagcttggaactcttggaaggcaagactctacctggtgtccttgccctcgatgacgcctaaatccgctgctgctgctgctgctgctactcaggttctgccagctttgcgtgtcat

SEQ ID NO: 1085 - DNA, 356 bp, Zea mays
  unsure (1)...(356): unsure at all n locations
  Clone ID: LIB143-068-Q1-E1-H4
gggggnnnnnnctttacnctgcagggtacggcaggatagcgggccgaggcacgcgtcagtcccatcgcatcccatcccactaccacccatctcgtcgtccgccgattcgaccggttctccaacccagggctgtgatggcgacgaagaggagcgtgggcaccctcggcgaagcggatctgaaggggaagaacgtgttcgtgcgcgccgacctcaacgtccctctcgacgacgcccagaagatcaccgacgacacccgcatccgcgcctccgtccccaccatcaagttcctcctcgagaatggcgccaaggtcatcctcgccagccacctgggtcgtccaaaaggtgtccacccaaag

SEQ ID NO: 1086 - DNA, 447 bp, Zea mays
  unsure (1)...(447): unsure at all n locations
  Clone ID: LIB3069-052-Q1-K1-E12
aggagtgccnnnnaggcaaanccttttgagctagngncctagcagnaccaannnnggnngangangcgtccgcccacgcgtncgcccacgcgtccgatcccgttgcatcccattccactaccacccatctcggggtccgccgattcgatccgggtcttccaacccaggggcagtgatggcgacgaagaggagcgtgggcaccctcggcgaggcggatctgaaggggaagaaggtgttcgtgcgcgccgacctcaacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttggagcctcttgtccacgcttgctgagctcttggagtgagtcg

SEQ ID NO: 1087 - DNA, 398 bp, Zea mays
  Clone ID: LIB3059-012-Q1-K1-B7
cccacgcgtccggaagaacgaacctgagtttgctaagaagctaacttctgtcgctgaggtttatgtgaatgatgcgtttgggcacgggacacagagctcatgcttcaaccgaaggagttaccaagtttttgaaacctgctgttgctggcttcctcatgcagaaagaacttgactacctttgttggagctgttgccaacccaaagaagccatttgccgctattgttggtggatccaaggtctcaagtaagattggtgtcattgagtcgttgctggcaaaggtcgatatcctcatccttggtggtggtatgatctacacattttacaaggcacaaggatattctgttggaaaatctctcgtggaagaggataaacttgagctcgcaacttctcttattga

SEQ ID NO: 1088 - DNA, 451 bp, Zea mays
  unsure (1)...(451): unsure at all n locations
  Clone ID: LIB3078-056-Q1-K1-D5
atgccaccaaaacattcgacgaagcattggacaccaccaagactgttatttggaacgggcccatgggagtgtttgagttccagaagtttgcagctggcaccgaggcgattgccaagaagctagctgagcttacaaccacgaagggtgtcactaccatcatcggcggtggcgactctgtcgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctncacacatggactttcgaggataggcttgccaccgtgttttgctagatgagtcg

SEQ ID NO: 1089 - DNA, 440 bp, Zea mays
  unsure (1)...(440): unsure at all n locations
  Clone ID: LIB3062-035-Q1-K1-H2
cacgaagactgttatttggaacggccccatgggagtgtttgagttctagaagtttgcagctggcactgacgcgattcgcaaggagctagctgagcgtacagaccacgaaaggtgtcactaccatcatcggcggcggcgactctgttgctgctgtcgagaaggctgggctggccgacaagatgagccacatttcgaccggctgctgtgcgagcttggaactcttggaaggcaagactctacctggtgtccttgccctcgatgactcctagatccgctgctgctgctgctactcaagttctgccagctttgcgtgtcatcttgtttcggaccttggtgtaacactgcaaggctaaagtttactcctncgcacatggacttctggcgataggcttgccaccgtgtattgctagatgagtcgtggaataagcttttacttcctc

SEQ ID NO: 1090 - DNA, 436 bp, Zea mays
  unsure (1)...(436): unsure at all n locations
  Clone ID: LIB3069-045-Q1-K1-D11
cccacgcgtccgggagtgtttgttttcgttaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatcttgtttcggaccttggtgtagcactgcaaggctaaggtttactcctccgcacatggacttttggggataggcttgccaccgtgttttgctagatgagtcgtggaataagcttttacttnctcgctgctgtgggtgaag

SEQ ID NO: 1091 - DNA, 286 bp, Glycine max
  unsure (1)...(286): unsure at all n locations
  Clone ID: 700561750H1
attcctaatgcaganngnnttgattatntagttggggtttgacacagccccaactagataatcaagctccttctgcattncggaatcctgcaacagagggcttcaagtatttggcaactccttctgtagaagcatgagctctgaancgcagtgccaaatgcatcattcacatagagatcagctagagaagccaacttctttctcgagccgatcggctcgagccagtttgctggatcatcttgggagagctcaaacacatacgccangctgtgggctttctggtttt

SEQ ID NO: 1092 - DNA, 234 bp, Glycine max
  unsure (1)...(234): unsure at all n locations
  Clone ID: 700655290H1
gcttngcanctctngtganccggctntctgagctcnttggtatccaggtgcgttcaaggctgaagacantattggtccanaagtagannagttggtggctctctccagatgcagnngttcttcttctagaaaatgtgaggttctacaacngcggangaaaagnnnngaatcccgagnnatgcnganaancttgcnctctggcagttntngtgngtganggctgcctttgggaac

SEQ ID NO: 1093 - DNA, 254 bp, Glycine max
  unsure (1)...(254): unsure at all n locations
  Clone ID: 700846548H1
cttgctgccactggggtgattcgtcttcatccttcattggcattgcgcttcacaaattctcagtctacgacttggtggatttcattaaattgtgataaacatggggataaaatcagagactttagagactatanngtgttcgtgagggtcgatctgaacgtgcctttggatgacaaccttaacatcaccgatgacactagagtccgtgctgctgttcccaccatcaagtacttaactggtcatgggccatagtg

SEQ ID NO: 1094 - DNA, 269 bp, Glycine max
  Clone ID: 700867263H1
gttttctaactaatatagttgttgggttgtcattcttttatttggttttaaccttttcttttgggtgtattagtagaggagttactattattctattaagaccatgaatgtcagaaaagtgtggtgagtagtagtgacttgaaaagtgattttgccttgactatgctgttttcagggacgtccaaaaggtgtaacacctaaatacagtttgaagcctcttgtgccaaggctgtctcaacttcttggaattgaggttacgatggccaatg

SEQ ID NO: 1095 - DNA, 311 bp, Glycine max
  unsure (1)...(311): unsure at all n locations
  Clone ID: 700989319H1
tcacttttagaaaaagttgacatccttcttcttggtggaggaatgatcttcacattttacaagggcacaaggtctttcagtgggttcatcccttgtngaagaagatnagttggatcttgctacatcactacttgcaancanccaaggaaanaggggngtccctctngttaccaagtganntgggtgattgcagnacnaatttgctccngatgntaatnngccaaggtccgngccangcatctgnncatcccctgatgggctgggaatggnatggganatngggtcccagatcnggtnaactcnnttcaggg

SEQ ID NO: 1096 - DNA, 221 bp, Glycine max
  unsure (1)...(221): unsure at all n locations
  Clone ID: 700998533H1
gttggatcttgctacatcactacttgcaaaagccaaggaaaagggggtgtctctcttgttaccaagtgatgtggtgattgcagacaaatttgctcctgangctaatagcaaggtngtgccacnatcaaccnacccgcanggctgncntggncccatnnncnccaanntncttaaacnattccaggaaccnttggnacnnancccccacncctcnntggnnt

SEQ ID NO: 1097 - DNA, 132 bp, Glycine max
  Clone ID: 701104514H1
cggctcgagttgagaagttggttgcacaacttccagaaggtggtgttttgactctagagaatgtcaggttcatataaggaggaagagaagaattgaccctcgagtttagcaaagatagttcggcttgctctt

SEQ ID NO: 1098 - DNA, 256 bp, Glycine max
  Clone ID: 701108251H1
gtcgtgccagcatctgccatccctgatggctggatgggattggatattggtccagattctgttaaatcattcagtgaagcattggatactacccaaaccatcatatggaatggaccaatgggagtgtttgagtttgacaagtttgctgttggtacagaggtatgtatgcaagaacacccacccacatatgaaattccattcaaattttatgttaaaccaaagttcaccgtcaatataaaaaatgtccactctaagc

SEQ ID NO: 1099 - DNA, 279 bp, Glycine max
  Clone ID: 701045420H1
gtttgcaaagaagttggcttctcttgctgatctctacgtgaatgatgctttcggcactgcccacagagctcatgcttctacagaaggagtggccaaatacttgaagccctctgttgcaggattccttatgcagaaggaacttgactatctagttggagctgtgtcaaaccccaagagaccatttgctgctatcgttggtgggtcaaaggtgtcttccaagattggagttattgagtccttgttggagaaagttaacgttctcttgcttggtggaggatg

SEQ ID NO: 1100 - DNA, 274 bp, Glycine max
  unsure (1)...(274): unsure at all n locations
  Clone ID: 700979939H1
gaagaatgaccctgagtttgcaaagaagttggcttctcttgctgatctctacgtgaatgatgctttcggcactgcccacagagctcatgcttctacagnaggantggccaaatacttgaagccctctgttgcaggattccttatgcagaaggaacttgactatctagttggagctgtgtcaaaccccaagagaccatttgctgctatcgttggtgggtcaaaggtgtcttccaagattggagttattgagtccttgttgncgaaantaacgttc

SEQ ID NO: 1101 - DNA, 255 bp, Glycine max
  Clone ID: 700962832H1
ctttgcttctagagaatgtgaggttctacaaggaggaagagaagaatgatcctgaatttgcaaagaagttggcttctctagctgatctctatgtgaatgatgcatttggcactgcccacagagctcatgcttctacagaaggagttgccaaatacttgaagccctctgttgcaggattcctaatgcagaaggagcttgattatctagttggggctgtgtcaaaccccaagagaccatttgctgctattgtcggtg

SEQ ID NO: 1102 - DNA, 309 bp, Glycine max
  unsure (1)...(309): unsure at all n locations
  Clone ID: 700648009H1
ctagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcnacttctcggaattgaggttacgatggcaaatgactctattggggangaagttgagaagttggttgcacaacttccagaaggtggtgttttgcttctagagaatgtgaggttctataaggaggaagagaagaatgaccctgagtttgcaaagaagttggcttctcttgctg

SEQ ID NO: 1103 - DNA, 260 bp, Glycine max
  Clone ID: 700901512H1
aaggctgtctcaacttctcggaattgaggttacgatggcaaatgactctattggggaggaagttgagaagttggtagcacaacttccagaaggtggtgttttgcttctagagaatgtgaggttctataaggaggaagagaagaatgaccctgagtttgcaaagaagttggcttctcttgctgatctctacgtgaatgatgctttcggcactgcccacagagctcatgcttctacagaaggagtggccaaatacttgaagc

SEQ ID NO: 1104 - DNA, 281 bp, Glycine max
  Clone ID: 701120901H1
gttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacgatggcaaatgactctattggggaggaagttgagaagttggttgcacaacttccagaaggtggtgttttgcttctagagaatgtgaggttctataaggaggaagagaagaatgaccctgagtttgcaaagaagttggc

SEQ ID NO: 1105 - DNA, 264 bp, Glycine max
  Clone ID: 700731242H1
cttccagaaggtggtgttttgcttctagagaatgtgaggttctacaaggaggaagagaagaatgatcctgaatttgcaaagaagttggcttctctagctgatctctatgtgaatgatgcatttggcactgcccacagagctcatgcttctacagaaggagttgccaaatacttgaagccctctgttgcaggattcctaatgcagaaggagcttgattatcaattggggctgtgtaaaccccaagagaccattgctgctattgtc

SEQ ID NO: 1106 - DNA, 260 bp, Glycine max
  unsure (1)...(260): unsure at all n locations
  Clone ID: 700995275H1
ggttctacaaggnggaagagaagaatgatcctgaatttgcaaagaagttggcttctctagctgatctctatgtgaatgatgcatttggcactgcccacagagctcatgcttctacagaaggagttgccaaatacttgaagccctctgttgcaggattcctaatgcagaaggagcttgattatctagttggggctgtgtcaaaccccaagagaccatttggctgcnattgtcggtggancgaaggtnttctncaagattgg

SEQ ID NO: 1107 - DNA, 288 bp, Glycine max
  unsure (1)...(288): unsure at all n locations
  Clone ID: 700566593H1
ctaagaggagcgtgggaacgttgaaggagtgtgatttgaaggggaagagggtattcgtgagggtcgatctgaacgngcctttggatgacaaccttaacatcaccgatgacactagagtccgtgctgctgttcccaccatcaagtacttgactggttatggtgctaaagtgatcctttctagccatttgggacgtccanaaggtgtaacacctaaatacagtttgaagcctcttgtgccaaggctgtctcaacttcttggaattgaggttacgatggccaatgactcta

SEQ ID NO: 1108 - DNA, 280 bp, Glycine max
  Clone ID: 701152346H1
tacggctgcgagaagacgacagaaggggttgaaaagttggttacacaacttccagaaggtggtgttttgcttctagagaatgtgaggttctacaaggaggaagggaagaatgatcctgaatttgcaaagaagttggcttctctagctgatctctatgtgaatgatgcatttggcactgcccacagagctcatgcttctacagaaggagttgccaaatacttgaagccctctgttgcaggattcctaatgcagaaggagcttgattatctagttggggctg

SEQ ID NO: 1109 - DNA, 265 bp, Glycine max
  unsure (1)...(265): unsure at all n locations
  Clone ID: 700999851H1
gtgaggttctacanggacgaagannccgaatgatcctgaatttgcaaagaagttggcttctctagctgatctctatgtgaatgatgcatttggcactgcccacagagctcatgcttctacagaaggagttgccnaatacttgaagccctctgttgcaggattcctaatgcagaaggagcttgattatctagttggggctgtgtcaaaccccaagagaccatttgctgctattgtcggtggatcgaagtgtcttccagattggagt

SEQ ID NO: 1110 - DNA, 243 bp, Glycine max
  unsure (1)...(243): unsure at all n locations
  Clone ID: 700877067H1
gttctataaggaggaagagaagaatgaccctgagtttgcaaagaagttggcttctcttgctgatctctacgtgaatgatgctttcggcactgcccacagagctnctgcttctacagaaggagtggccaaatacttgaagccctctgttgcaggattccttatgcagaaggaacttgactatctagttggagctgtgtcaaaccccaagagaccatttgctgctagcgttggtgggtcaaggtg

SEQ ID NO: 1111 - DNA, 245 bp, Glycine max
  Clone ID: 700743313H1
ctcgagcgcttccagaaggtggtgttttgcttctagagaatgtgaggttctacaaggaggacgagaagaatgatcctgaatttgcaaagaagttggcttctctagctgatctctatgtgaatgatgcatttggcactgcccacagagctcatgcttctacagaaggagttgccaaatacttgaagccctctgttgcaggattcctaatgcagaaggagcttgattatctagttggggctgtgtca

SEQ ID NO: 1112 - DNA, 278 bp, Glycine max
  Clone ID: 700605425H2
gtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttctcaccatcaagtacttgactggttatggtgctaaagtgatcctttctagccatttgggacgtccaaaaggtgtaacacctaaatacagtttgaagcctcttgtgccaaggctgtctcaacttcttgg

SEQ ID NO: 1113 - DNA, 262 bp, Glycine max
  Clone ID: 700846107H1
gaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatacagtttgaagcctcttgtgccaaggctgtctc

SEQ ID NO: 1114 - DNA, 228 bp, Glycine max
  Clone ID: 700755167H1
ggcaaatgactctattggggaggaagttgagaagttggctgcacaacttccagaaggtggtgttttgcttctagagaatgtgaggttctataaggaggaagagaagaatgaccctgagtttgcaaagaagtaggcttctcttgctgatctctacgtgaatgatgctttcggcactgcccacagagctcatgcttctacagaaggagtggccaaatacttgaagccctc

SEQ ID NO: 1115 - DNA, 274 bp, Glycine max
  unsure (1)...(274): unsure at all n locations
  Clone ID: 700986996H1
cacaacttccagaaggtggtgttttgcttctagagaatgtgaggttctataaggaggaagagaagaatgaccctgagtttgcnaagnagtggcttctcttgctgtctctacgtggattgatgctttccggnactgccnanngagctcatgcttctacaganggagtggccaaatncttgancccctctgttgcaggattccttatgcagaaggaacttgactanctagttggagctgtgtcaaaccccaagagaccatttgctgctatcgttgg

SEQ ID NO: 1116 - DNA, 255 bp, Glycine max
  Clone ID: 700873077H1
ggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatacagtttgaagcctcttgtgccaaggctgtctcaacttcttggaattgaggttacgatggccaa

SEQ ID NO: 1117 - DNA, 248 bp, Glycine max
  Clone ID: 700995849H1
gcgaataaatggcgactaagaggagcgtgggaacgttgaaggagggtgatttgaaggggaagagggtgttcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatacagtttgaagcctctt

SEQ ID NO: 1118 - DNA, 254 bp, Glycine max
  Clone ID: 700754326H1
cacaacttccagaaggtggtgttttgcttctagagaatgtgaggttctacaaggaggaagagaagaatgatcctgaatttgcaaagacgttggcttctctagctgatctctatgtgaatgatgcatttggactgcccacagagctcatgcttctacagaaggagttgccaaatacttgaagccctctgttgcaggattcctaatgcagaaggagcttgattatctagttggggctgtgtcaaaccccaagagac

SEQ ID NO: 1119 - DNA, 300 bp, Glycine max
  unsure (1)...(300): unsure at all n locations
  Clone ID: 701063449H1
ccgagattccncctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttggccaaggctgtctca

SEQ ID NO: 1120 - DNA, 254 bp, Glycine max
  Clone ID: 700906269H1
cgcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctc

SEQ ID NO: 1121 - DNA, 279 bp, Glycine max
  Clone ID: 701121153H1
acactacaccgatatttccaccaaacccgtttgcaatgttgtttgcgaataaatggcgactaagaggagcgtgggaacgaagaaggagggtgatttgaaggggaagagggtatcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctagatacagt

SEQ ID NO: 1122 - DNA, 252 bp, Glycine max
  Clone ID: 700750611H1
cgtttgcgttgttgtttgcgaataaatggcaactaagaggagcgtgggaacgttgaaggagggtgatttgaaggggaagagggtattcgtgatggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatacag

SEQ ID NO: 1123 - DNA, 279 bp, Glycine max
  Clone ID: 701051356H1
acacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgataaacctaaatac

SEQ ID NO: 1124 - DNA, 271 bp, Glycine max
  Clone ID: 701040938H1
acacactacaccgatatttccaccaaacccgtttgcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacac

SEQ ID NO: 1125 - DNA, 277 bp, Glycine max
  Clone ID: 701141327H1
caccaaacccgtttgcgttgttgtttgcgaataaatggcaactaagaggagcttgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgcttggttatggtgctaaagtgatcctttctagccatttgggacgtccaaaaggtgtaacacctaaatacagtttgaagcctcttgtg

SEQ ID NO: 1126 - DNA, 281 bp, Glycine max
  Clone ID: 701041022H1
cttgctggttgccacactacaccgatatttccaccaaacccgttagcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaaca

SEQ ID NO: 1127 - DNA, 286 bp, Glycine max
  Clone ID: 700560223H1
gccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatccttctagccacttgggacgtcctaaaggtgtaacacctaaatacagtttgt

SEQ ID NO: 1128 - DNA, 263 bp, Glycine max
  Clone ID: 701069688H1
ccgagattccccctaaacccgtttgccttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacct

SEQ ID NO: 1129 - DNA, 253 bp, Glycine max
  Clone ID: 700868226H1
cgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggt

SEQ ID NO: 1130 - DNA, 226 bp, Glycine max
  Clone ID: 700867389H1
tctcgagccgattcggctcgaggttttgcttctagagaatgtgaggctctacaaggaggaagacgaagaatgatcctgaattagcaaagaagttggcttctctagctgatctctatgtgaatgatgcatttggcactgcccacagagctcatgcttctacagaaggagttgccaaatacttgaagccctctgttgcaggattcctaatgcagaaggagcttgatta

SEQ ID NO: 1131 - DNA, 260 bp, Glycine max
  Clone ID: 700792652H1
ctggttgccacactacaccgatatttccaccaaacccgtttgcgttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggac

SEQ ID NO: 1132 - DNA, 258 bp, Glycine max
  Clone ID: 701206846H1
cttgctagttgccacactacaccgatatttccaccaaacccgtttgcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatt

SEQ ID NO: 1133 - DNA, 259 bp, Glycine max
  Clone ID: 700966925H1
cttgctggttgccacactacaccgatatttccaccaaacccgtttgcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccattt

SEQ ID NO: 1134 - DNA, 264 bp, Glycine max
  Clone ID: 700676242H1
cttgctggttgccacactacaccgatatttccaccaaacccgtttgcgttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggac

SEQ ID NO: 1135 - DNA, 278 bp, Glycine max
  unsure (1)...(278): unsure at all n locations
  Clone ID: 700982087H1
ccacactacaccgagattccccctaaacccgtttgcnttgttgtttgcgaagaaatggcgactaagaggagcgtgggaacgttgaaggagggtgatttgaaagggaagccggtgttcgtgagggtcgatctgaacgtgcctttggatgacaaccttaacatcaccgatgacactagagtccgtgctgctgttcccaccatcaagtacttaactggtcatggagccaangtgatcctttctagccacttggggacgtcctaaaggtgtaacacctaaat

SEQ ID NO: 1136 - DNA, 268 bp, Glycine max
  Clone ID: 701206122H1
cactacaccgagattccccctaaacccgtttgcgttgttgtttgcgaagaaatggcgactaagaggagcgtgggaacgttgaaggagggtgatttgaaagggtagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacac

SEQ ID NO: 1137 - DNA, 269 bp, Glycine max
  Clone ID: 700561967H1
gctggttgccacactacaccgatatttccaccaaacccgtttgcgttgttggtttgcgcaggtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatccttctagccattggga

SEQ ID NO: 1138 - DNA, 264 bp, Glycine max
  Clone ID: 701038580H1
cacactacaccgatatttccaccaaacccgtttgcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaggtgt

SEQ ID NO: 1139 - DNA, 224 bp, Glycine max
  Clone ID: 700831261H1
gaacagtgattttgccttgactatgctgttttcagggacgtccaaaaggtgtaacacctaaatacagtttgaagcctcttgtgccaaggctgtctcaacttcttggaattgaggttacgatggccaatgactctattggggaggaagttgaaaagttggttacacaacttccagaaggtggtgttttgcttctagagaatgtgaggttctacaaggaggaagag

SEQ ID NO: 1140 - DNA, 253 bp, Glycine max
  Clone ID: 700909538H1
tatttccaccaaacccgtttgcgttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgta

SEQ ID NO: 1141 - DNA, 253 bp, Glycine max
  Clone ID: 701109480H1
atcgagcgattcggctgagcaccgatatttccaccaaaccactttgcactgttgtacgcgaataaatggcgactacgaggagcgtgggaacgttgaaggagggtgatttgaaggggaagagggtgttcgtgagggtcgatctgaacgtgcctttggatgacaaccttaacatcaccgatgacactagagtccgtgctgctgttcccaccatcaagtacttgactggttatggtgctaaagtgatcctttctag

SEQ ID NO: 1142 - DNA, 267 bp, Glycine max
  Clone ID: 700754158H1
ctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgt

SEQ ID NO: 1143 - DNA, 272 bp, Glycine max
  Clone ID: 701138938H1
cccgtttgccttgttgtttgcgaataaatggcaactaagaggagcgcgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatacagtttgaagcctcttgtgcc

SEQ ID NO: 1144 - DNA, 261 bp, Glycine max
  Clone ID: 700728645H1
atttccaccaaacccgtaatagaagatgtttgcgaataaatggcgactaagaggagcgtgggaaagttgaaggaacgtgatttgaaggggaagagggtgttcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaa

SEQ ID NO: 1145 - DNA, 269 bp, Glycine max
  Clone ID: 701037523H1
cgagattcccccaaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaataca

SEQ ID NO: 1146 - DNA, 277 bp, Glycine max
  Clone ID: 700746355H1
gctggttgccacactacaccgatatttccaccaaacccgtttgcgttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaaggatcctttctagccatttgggacgtccaaaaggtgtaaca

SEQ ID NO: 1147 - DNA, 242 bp, Glycine max
  Clone ID: 700753250H1
tgctggttgccacactacaccgatatttccaccaaacccgtttgcgttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaccgtgat

SEQ ID NO: 1148 - DNA, 202 bp, Glycine max
  Clone ID: 700742113H1
ctcgagccgcttccagaaggtggtgttttgcttctagagaatgtgaggttctacaaggaggaagagaagaatgatcctgaatttgcaaagaagttgttttctctagctgatctctatgtgaatgatgcatttggcactgcccacagagctcatgcttctacagaaggagttgccaaatacttgaagccctctgttgcaggat

SEQ ID NO: 1149 - DNA, 232 bp, Glycine max
  Clone ID: 700754067H1
caggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatacagttgacgcctcttgtgccacggctg

SEQ ID NO: 1150 - DNA, 249 bp, Glycine max
  Clone ID: 701060528H1
cacagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttcta

SEQ ID NO: 1151 - DNA, 285 bp, Glycine max
  Clone ID: 701002709H2
ctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacac

SEQ ID NO: 1152 - DNA, 249 bp, Glycine max
  Clone ID: 700958261H1
agttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagcc

SEQ ID NO: 1153 - DNA, 234 bp, Glycine max
  Clone ID: 701212692H1
cgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagcca

SEQ ID NO: 1154 - DNA, 262 bp, Glycine max
  Clone ID: 701129677H1
tgccacactacaccgatatttccaccaaacccgtttgcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaa

SEQ ID NO: 1155 - DNA, 240 bp, Glycine max
  Clone ID: 700755130H1
ctttaccagttgccacactacaccgagatgccccctaaacccgtttgcgttgttgtttgcgaagaagtggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaa

SEQ ID NO: 1156 - DNA, 255 bp, Glycine max
  Clone ID: 700855106H1
gttgccacactacaccgagataccccctaaacccgtttgcgttgttgtttgcgaagaaatggcgactaagaggagcgtgggaacgttgaaggagggtgatttgaaagggaagagggtgttcgtgagggtcgatcagtacgtgcctttggatgacaaccttaacatcaccgatgacactagagtccgtgctgctgttcccaccatcaagtacttaactggtcatggagccaaagtgatcctttctagccacttggg

SEQ ID NO: 1157 - DNA, 251 bp, Glycine max
  unsure (1)...(251): unsure at all n locations
  Clone ID: 700672102H1
cgagattccccctaaacccgtttgcgttgttgtatgcgaagaaatggcgactaagaggagcgtgggaacgttgaaggagggngatttgaaagggaaganggtgttcgtganggtcgatctgaacgtgcctttggatgacaaccttaacatcaccgatgacactagagtccgtgctgctgttcccaccatcangtacttaactggtcatggagccaaagtgatcctttctagccanttggacgtctaaaggt

SEQ ID NO: 1158 - DNA, 291 bp, Glycine max
  unsure (1)...(291): unsure at all n locations
  Clone ID: 700985023H1
ctttaccagttgccacactacannganncaacnccctaaacccgtttgcnttgttgtttgcgaagaaatggcgacncagaggagcntgggaacgttgaaggagggtgatttgaaagggaagagggtgttcgtgagggtcgatctgnacgtgcctttggatgacaaccttaacatcaccgatgacactagagtccgtgctgctgttcccaccatcaagtacttaactggtcatggagccaaagtggatcctttctagccacttggtatgttctttataaaccattttatttt

SEQ ID NO: 1159 - DNA, 293 bp, Glycine max
  unsure (1)...(293): unsure at all n locations
  Clone ID: 700561815H1
cttgctggttgccacactacaccgatangcgccaccaaacccgtttgcnntgttgtttgcgaataaatggcaactaagaggagncnnnggaaanttgaaggagggtgatttgnaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatac

SEQ ID NO: 1160 - DNA, 264 bp, Glycine max
  unsure (1)...(264): unsure at all n locations
  Clone ID: 700650261H1
gatcgatctctttaccagttgccacactacaccgagatnccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgacctttctagcc

SEQ ID NO: 1161 - DNA, 277 bp, Glycine max
  Clone ID: 701155840H1
gagaagacgacagaagggggaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtg

SEQ ID NO: 1162 - DNA, 264 bp, Glycine max
  Clone ID: 701011614H1
ctttaccagttgccacactacaccgagattcccccaaaacccgttagcgttgttgtttgcgaagaaatggcgactaagaggagcgtgggaacgttgaaggagggtgatgcgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttggga

SEQ ID NO: 1163 - DNA, 232 bp, Glycine max
  unsure (1)...(232): unsure at all n locations
  Clone ID: 700756614H1
cctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaaggtactaacgtggcagtgagccaaagngagccgttctagccacggttgac

SEQ ID NO: 1164 - DNA, 245 bp, Glycine max
  Clone ID: 700753242H1
ctttaccagttgccacactacaccgagattccccctaaacccgtttgcgttgttgtctgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgat

SEQ ID NO: 1165 - DNA, 258 bp, Glycine max
  Clone ID: 701062065H1
gctggttgccacactacaccgatatttccaccaaacccgtttggtttgttgtttccgaataaatggcaactaagaggagcgtgggaacgttgaaggagggtgatttgaaggggaagagggtattcgtgagggtcatctgaacgtgcctttggatgacaaccttaacatcaccgatgacactagagtccgtgctgctgttcccaccatcaagtacttgactggttatggtgctaaagtgatcctttctagccatttggg

SEQ ID NO: 1166 - DNA, 225 bp, Glycine max
  Clone ID: 700734980H1
gtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgta

SEQ ID NO: 1167 - DNA, 256 bp, Glycine max
  Clone ID: 700894670H1
ttgccacactacaccgagattccccctaaacccgtttgcgttgttgtttgcgaagaaatgccgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtactaactggtcatggagccaaagtgatcctttctagccacttgggacg

SEQ ID NO: 1168 - DNA, 261 bp, Glycine max
  Clone ID: 701004704H1
ctttaccagttgccacactacaccgacctatcgctcaaaacccgcttgcgttgctgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaagtgatcctttctagccacttg

SEQ ID NO: 1169 - DNA, 203 bp, Glycine max
  Clone ID: 701125560H1
ctagttgccacactacaccgatatttccaccaaacccgtttgcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctgctgttccca

SEQ ID NO: 1170 - DNA, 217 bp, Glycine max
  Clone ID: 700673963H1
cttgctggttgccacactacaccgatatatccaccaaacccgttagcattgttgtatgcgaataaatggcaactaagaggagcgtgggaacattgaaggagggtgatttgaaggggaagagggtattcgtgagggtcgatctgaacgtgcctttggatgacaaccttaacatcaccgatgacactagagtccgtgctgctgttcccaccatcaagta

SEQ ID NO: 1171 - DNA, 249 bp, Glycine max
  Clone ID: 700664685H1
aaccttaacatcaccgatgacactagagtccgtgctgctgttcccaccatcaagtacttgactggttatggtgctaaagtgatcctttctagccatttgggacgtccaaaaggtgtaacacctaaaacagtttgaagcctcttgtgccaaggctgtctcaacttcttggaattgaggttacgatggccaatgactctattggggaggaagttgaaaagttggttacacaacttccagaaggtggtgttt

SEQ ID NO: 1172 - DNA, 261 bp, Glycine max
  unsure (1)...(261): unsure at all n locations
  Clone ID: 700756635H1
cctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgcntcntntcccaccagcaaggatcgtaacngggcaggtagccaaagggatcctgtctagtcacgtgtgtacgcctaaatgtgtatcaccgaaatacag

SEQ ID NO: 1173 - DNA, 267 bp, Glycine max
  Clone ID: 701066933H1
tctctctataaatctttctagaaagttccctcactccctgaacctgatcgatctctttaccagttgctacactacaccgagatttgccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatc

SEQ ID NO: 1174 - DNA, 280 bp, Glycine max
  Clone ID: 701156137H1
cggctgcgagaagacgacagaaggggaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaa

SEQ ID NO: 1175 - DNA, 189 bp, Glycine max
  Clone ID: 701043044H1
tcgaatcgagcgaatcggctcgagcccgtttgcgttgttgtttgcgcataaatggcgactaacaggagcgtgggaacgttgacaggagggtgatttgaaggggaagagggtattcgtgagggtcgatctgaacgtgcctttggatgacaaccttaacatcaccgatgacactagagtccgtgctgctgt

SEQ ID NO: 1176 - DNA, 235 bp, Glycine max
  Clone ID: 700832331H1
ctttaccagttgccacactacaccgagattccccctaaacacgattgcagtggtgcttgcgaagaaatgggcgataaggagagcgtgggaacgttgaaagagggtgatttgaaagggaagaaggtgttcgtgagggtcgatctgaacgtgcctttggatgacaaccttaacatcaccgatgacactagagtccggctgctgttcccaccatcaagtacttaactggtcatggagc

SEQ ID NO: 1177 - DNA, 202 bp, Glycine max
  Clone ID: 701046244H1
atctcttgctagttgccacactacaccgatatttccaccaaacccgtttgcgttgttgtttgcgaataaatggcgactaagaggagcgtgggaacgttgaaggagggtgatttgaaggggaagagggtattcgtgagggtcgatctgaacgtgcctttggatgacaaccttaacatcaccgatgacactagagtccgtgctg

SEQ ID NO: 1178 - DNA, 261 bp, Glycine max
  unsure (1)...(261): unsure at all n locations
  Clone ID: 700555893H1
ttaccagttgccacactacaccgagatnccccctaaacccgnttgcgttgttgtttgcgaagaaatggcgactaagaggagcgtgggaacgttgaaggagggtgatttgaaagggaagagggtgttcgtgagggtcgatctaacgtgccttggatgacaaccttaacatcaccgatgacactagagtccgtgctgctgttcccaccatcaagtacttaactggtcatggagccaaagtgatcctttctagccacttgggag

SEQ ID NO: 1179 - DNA, 271 bp, Glycine max
  unsure (1)...(271): unsure at all n locations
  Clone ID: 700999829H1
tgctggttgccacactacaccgatatttccaccaaacccgtttgccntgttgtttgcnaataaatggcaactaagaggagcgtgggaacgttnaangagggtgatttgaaggggaagagggtattcgtgagggtcgatctaanncntgcctttggatgacaaccttaacatcaccgatgacactagagtccgtgctgctgttcccaccatcaagtacttgactggttatggtgctaaagtgatcctttctagccatttgggacgtccaaaa

SEQ ID NO: 1180 - DNA, 148 bp, Glycine max
  Clone ID: 701142924H2
cgtttgccttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactaga

SEQ ID NO: 1181 - DNA, 222 bp, Glycine max
  Clone ID: 701156281H1
cggctgcgagaagacgacagaaggggaacctgatcgatctctttaccagttgccacactacaccgagatacacccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatg

SEQ ID NO: 1182 - DNA, 214 bp, Glycine max
  Clone ID: 701015402H1
cacacgcacgcggacttcagctcgaactctttaccagttgccacactacaccgagataccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacact

SEQ ID NO: 1183 - DNA, 239 bp, Glycine max
  Clone ID: 700870906H1
gatctcttgctggttgccacactacaccgatatctccaccaaacccgtttgccttgttgtttgcgaataaatggcaactaagaggagcgtgggaacgttgaaggagggtgatttgaaggggaagagggtattcgtgagggtcgatcctgaacgtgcctttggatgacaaccttaacatcaccgatgacactagagtccgtgctgctgttcccacatcaagtacttgactggttatggtg

SEQ ID NO: 1184 - DNA, 272 bp, Glycine max
  Clone ID: 701060159H1
ctttaccagttgccacactacaccgagataccccctaaaccagtttgcgttgttgtttgcgaagaaatggcgactaagaggagcgtgggaacgttgaaggagggtgatttgaaagggaagagggtgttcgtgagggtcatctgaacgtgcctttggatgacaaccttaacatcaccgatgacactagagtccgtgctgctgttcccaccatcaagtacttaactggtcatggagccaaagtgatcctttctagccacttgggacgtcctaaa

SEQ ID NO: 1185 - DNA, 234 bp, Glycine max
  Clone ID: 700830018H1
ccaaaaccggtttgcgttgttgtttgcgaagaaatggcgactaagaggagctcaggaacgttgacggagggtgatttgacagggaagagggtgttcgtgagggtcgatccccacgtgcctttggatgacaaccttaacatcaccgatgacactagagtccgtgctgctgttcccaccatcaagtacttcactggtcatggagccaaagtgatcctttctagccacttgggacgt

SEQ ID NO: 1186 - DNA, 267 bp, Glycine max
  Clone ID: 700910043H1
ctctttaccagttgccacactacaccgagattccccctaaacccgtttgcgttgttgtttgcgaagaaatggcgactaagaggagcgtgggaacgttgaaggagggtgatttgaaagggaagagggtgttcgtgaggtcgatctgaacgtgcctttggatgacaaccttaacatcaccgatgacactagagtccgtgctgctgttcccaccatcaagtacttaactggtcatggagccaaagtgatcctttctagccacttgggacg

SEQ ID NO: 1187 - DNA, 151 bp, Glycine max
  Clone ID: 701043760H1
cgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatc

SEQ ID NO: 1188 - DNA, 265 bp, Glycine max
  Clone ID: 700845883H1
gttgctagttgccacactacaccgatatgtccaccaaacccgtttaggatgttgtttgcgaataaatggcgactaagaggagcgtgggaacgagttaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacg

SEQ ID NO: 1189 - DNA, 247 bp, Glycine max
  Clone ID: 700967838H1
gtctttaccagttgccactctacaccgagattccccctacacccgtttgcgttgttgtttgcgaagaaatggcgactaagcggagcgttggaacgttgacggagggtgatttgaaagggacgagggtgttcgtgagggtcgatctgaacgtgcctttggatgacaaccttaacatcaccgatgacactagagtccgtgctgctgttcccaccatcaagtacttaactcgtcatggagccaaagtgat

SEQ ID NO: 1190 - DNA, 233 bp, Glycine max
  Clone ID: 700731857H1
gctggttgccacactacaccgatatttccaccaaacccgtttgcgttgttgtttgcgaataaatggcaactaagaggagcgtgggaacgttaaaggagggtgatttgacggggaagagggtattcgtgaggttcgatctaaacgtgcctttggatgacaaccttaccatcaccgatgacactaaagtccgtcttgctgttcccaccatcaggtacttgactggttatggtgct

SEQ ID NO: 1191 - DNA, 151 bp, Glycine max
  Clone ID: 701064594H1
gctggttgccacactacaccgatatttccaccaaacccgtttgccctgttgtttgcgaataaatggcaactaagaggagcgtgggaacgttgaaggagggtgatttgaaggggaagagggtattcgtgagggtcgatctgaacgtgccttt

SEQ ID NO: 1192 - DNA, 254 bp, Glycine max
  Clone ID: 701062162H1
acgagattccacctaaacccgtttgcgttgttgtttgcgcagaaatggcgactaagccgagcctgggaacgttgaaggagggtgatttgaaagggcagagggtgtccgtgagggtcgatctgaacgtgccttggatgacaaccttaacatcaccgatgacactagagtccgtgctgctgttcccaccatcaagtacttaactggtcatggagccaaagtgatcctttctagccacttgggacgtcctaaaggtg

SEQ ID NO: 1193 - DNA, 285 bp, Glycine max
  unsure (1)...(285): unsure at all n locations
  Clone ID: 700560995H1
aaatacctgaagccatctgttgctggttttcttttgcaaaaggaacttgattaccttgttggggcagtatcaaaccccaaaaggccatttgctgccattgttggtggttccaaagtctcatctaaaattggagtgattgagtcacttttagaaaaagttgacatccttcttcttggtggaggaatgatcttcacattttanaaggcacaaggtctttcagtgggttcatcccttgtagaagaagataagttggatcttgctacatcactacttgcaaaagccaag

SEQ ID NO: 1194 - DNA, 295 bp, Glycine max
  unsure (1)...(295): unsure at all n locations
  Clone ID: 700562380H1
catttggtactgctcacagggcacatgcatcaacagagggtgttactaaatacctgaagccatctgttgctggttttcttttgcaaaaggaacttnattaccttgttngggcagtatcaaaccccaaaaggccatttgctgccattgttggtggttccaaagtctcatctaaaattggagtgattgagtcacttttagaaaaagttgacatccttcttcttggtggaggaatgatcttcacattttacaaggcacaaggtctttcagtgggttcatccttgtagaagaagataag

SEQ ID NO: 1195 - DNA, 276 bp, Glycine max
  Clone ID: 700985880H1
cccaaatacagcttggcacctcttgtgccccggctttctgagctcattggtatccaggttgtcaaggctgaagacagtattggtccagaagtagaaaagttggtggcttctcttccagatggaggtgttcttcttctagaaaatgtgaggttttacaaggaggaagaaaagaatgatcccgagcatgcaaaaaagcttgcctctctggcagatctgtttgtgaatgatgcatttggtactgctcacagggcacatgcatcaacagagggtgttact

SEQ ID NO: 1196 - DNA, 282 bp, Glycine max
  Clone ID: 700560287H1
gagtgattgagtcacttttggaaaaagttgacattcttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgcccccgatgcaaacagcaaggtcgtgccagcatctgccatccctgatggctggatgggattggatattggtc

SEQ ID NO: 1197 - DNA, 269 bp, Glycine max
  Clone ID: 700963530H1
aaagggtgtcactaccaaatacagcttggcacctcttgtgccccggctttctgagctcattggtatccaggttgtcaaggctgaagacagtattggtccagaagtagaaaagttggtggcttgtcttccagatggaggtgttcttcttctagaaaatgtgaggttttacaaggaggaagaaaagaatgatcccgagcatgcaaaaaagcttgcctctctggcagatctgtttgtgaatgatgcatttggtactgctcacagggcacatg

SEQ ID NO: 1198 - DNA, 248 bp, Glycine max
  Clone ID: 700875947H1
cagattgtcaaggccgaggacagtattggtccagaagtagaaaagttggtggcttctcttccagatggaggtgttctccttctagaaaatgtgaggttttacaaggaggaagaaaagaatgaccccgagcatgcaaaaaagcttgcctctctggcagatctgtatgtgaatgatgcatttggtactgctcacagggcacatgcatcaacagagggtgttactaaatacctgaagccatctgttgctgg

SEQ ID NO: 1199 - DNA, 285 bp, Glycine max
  unsure (1)...(285): unsure at all n locations
  Clone ID: 701000877H1
gcgtgggggagctgagcgcggcggacctgaaggggaagaangtcttcgtcagggccgacctcaacgtcccgctcgacgacaancagaacatcaccgacgacaccagaattcgcgccgccattcccaccatcaaacacctaatccaaaacggcgccaaagttattctctccagccacttggggaggccgaagggtgtcactcccaaatacagcttggcacctcttgtgccccggctttctgagctcattggtatccaggttgtcaaggctgaagacagtattggtc

SEQ ID NO: 1200 - DNA, 252 bp, Glycine max
  Clone ID: 700875149H1
ggctgaagacagtattggtccagaagtagaaaagttggtggcttctcttccagatggaggtgttcttcttctagaaaatgtgaggttttacaaggaggaagaaaagaatgatcgcgagcatgcaaaaaagcttggcctctctggcagatctgtttgtgaatgatgcatttggtactgctcacagggcacatgcatcaacagagggtgttactaaatacctgaagccatctgttgctggttttcttttgcaaa

SEQ ID NO: 1201 - DNA, 301 bp, Glycine max
  unsure (1)...(301): unsure at all n locations
  Clone ID: 700562040H1
gcatttggtactgctcacagggcactgcatcaacagagggtgttactaaatacctgaagccatctgttgctggttttcttttgcaaaaggaacttgattaccttgttggggcagtatcaaaccccaaaaggccatttgctgccattgttggtggttccaaagtctcatctaaaattggagtgattgagtcattttagaaaaagttgacatccttcttcttggtggaggaatgatcttcacatttacaaggcacaaggtctttcatgggttcatccctgtagaagagntanttggatctgct

SEQ ID NO: 1202 - DNA, 282 bp, Glycine max
  unsure (1)...(282): unsure at all n locations
  Clone ID: 700988386H1
ccatctgttgctggttttcctttgcaaaaggaacttgattaccttgttggggcagtatcaaaccccaaaaggccatttgctgncattgttggtggttccaaagtctcatctnnaatttcagtgattgagtcacttttagaaaaagtngacatccttcttcttggtggaggnatgatcttcacatttgacaaggcacaaggtctttcagtgggttcatcccttgtngaagaagataagttggatcttgctacatcatacttgcaaaagccaaggnaaaggggg

SEQ ID NO: 1203 - DNA, 249 bp, Glycine max
  Clone ID: 700684389H1
ctcttccagattgaggtgttcttcttctagaaaatgtgaggttttacaaggaggaagaaaagaatgatcccgagcatgcaaaaaagcttgcctctctggcagatctgtttgtgaatgatgcatttggtactgctcacagggcacatgcatcaacagagggtgttactaaatacctgaagccatctgttgctggttttcttttgcaaaaggaacttgattaccttgttggggcggtatcaagccccaaaa

SEQ ID NO: 1204 - DNA, 300 bp, Glycine max
  unsure (1)...(300): unsure at all n locations
  Clone ID: 700561801H1
aacatctcatccaanatngcgccaaagtnattctctccagccacttggggcggccgaagggtgtcactacnaantacagcttggngcctcttgtaccccggctttctgnnctcattggtatccagattgtcaaggccgaggacagtattggnccagaagtagaaaaatnggtggcttctcttccagatggangtgttctccttctagaaaatgtgaggttttacaaggaggcagaaaagaatgaccccgagcatgcgaanaagctngcntctctggcnagatctgtatgtgaatgatgcc

SEQ ID NO: 1205 - DNA, 253 bp, Glycine max
  Clone ID: 700898022H1
gatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatctgcccccgatgcaaacagcaaggtcgtgccagcatctgccatccctgatggctggatgggattggatattggtccagattctgttaaatcattcagtgaa

SEQ ID NO: 1206 - DNA, 235 bp, Glycine max
  Clone ID: 700790662H2
ggctgaagacagtattggtccagaagtagaaaagttggtggcttctcttccagatggaggtgttcttcttctagaaaatgtgaggttttacaaggaggaagaaaagaatgatcccgacatgcaaaaaagcttgcctctctggcagatctgtttgtgaatgatgcatttggtactgctcacagggcacatgcatcaacagagggtgtcactaaatacctgaagccatctgttgctg

SEQ ID NO: 1207 - DNA, 257 bp, Glycine max
  Clone ID: 700684507H1
aaaattggagtgattgagtcacttttggaaaaagttgacattcttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgcccccgatgcaaacagcaaggtcgtgccagcatctgccat

SEQ ID NO: 1208 - DNA, 232 bp, Glycine max
  Clone ID: 700844926H1
atgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgcccccgatgcaaacagcaaggtcgtgccagcatctgccatccctgatggctggatgggattggatattggtccag

SEQ ID NO: 1209 - DNA, 245 bp, Glycine max
  Clone ID: 700875409H1
cagattgtcaaggccgaggacagtattggtccagaagtagaaaagttggtggcttctcttccagatggaggtgttctccttctagaaaatgtgaggttttacaaggaggaagaaaagaatgaccccgagcatgcaaaaaagcttgcctctctggcagatctgtatgtgaatgatgcatttggtactgctcacagggcacatgcatcaacagagggtgtgacgaaatacctgaagccatctgttgc

SEQ ID NO: 1210 - DNA, 255 bp, Glycine max
  Clone ID: 700677812H1
ctcgagccgaatcggctcgaggaagaaaagaatgaccccgagactgcaaaaaagcttgactctctggcagatctgtaactgaatgatgcatttggtactgctcacagggcacatgcatcaacagagggtgttactaaatacctgaagccatctgttgctggttttcttttgcaaaaggaacttgattaccttgttggggcagtatcaaaccccaaaaggccatttgctgccattgttggtggttcaaagtctcat

SEQ ID NO: 1211 - DNA, 267 bp, Glycine max
  Clone ID: 701133849H1
gcgtgggggagctgagcgcggcggacctgaaggggaagaaggtcttcgtcagggccgacctcaacgtcccgctcgacgacaaccagaacatcaccgacgacaccagaattcgcgccgccattcccaccatcaaacacctaatccaaaacggcgccaaagttatctctctccagccacttggggaggccgaagggtgtcactcccaaatacagcttggcacctcttgtgccccggctttctgagctcattggtatccaggttgtcaag

SEQ ID NO: 1212 - DNA, 257 bp, Glycine max
  unsure (1)...(257): unsure at all n locations
  Clone ID: 700978393H1
ggtgttctccttctagaaaatgtgacggttttacaaggaggacgaaaagaatgaccccgagantgcaaaaaagcttgcctctctggcagatctgtatgtgaatgatgcatttggtactgctcacgggcacatgcatcaacagagggtgttactaaatacctgaagccatctgttgctggttttcttttgcaaaaggaacttgattaccttgttggggcagtatcaaaccccaaaaggccatttgctgccattgttgg

SEQ ID NO: 1213 - DNA, 250 bp, Glycine max
  Clone ID: 700741608H1
gtcttcgtcagggccgacctcaacgtcccgctcgacgacaaccagaacatcaccgacgagaccagaattcgcgccgccattcccaccatcaaacacctaatccaaaacggcgccaaagttattctctccagccacttggggaggccgaagggtgtcactcccaaatacagcttggcacctcttgtgccccggctttctgagctcattggtatccagttgtcaaggctgaagacagtattggtccagaagt

SEQ ID NO: 1214 - DNA, 221 bp, Glycine max
  Clone ID: 700741228H1
aggtctcatctaaaattggagtgattgagtcacttttggaaaaagttgacattcttcttcttggtggaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagac

SEQ ID NO: 1215 - DNA, 300 bp, Glycine max
  Clone ID: 700562038H1
gcatttggtactgctcacagggccatgcatcaacagagggtgttactaaatacctgaagccatctgttgctggttttcttttgcaaaaggaacttgattaccttgttggggcagtatcaaaccccaaaaggccatttgctgccattgttggtggttccaaagtctcatctaaaattggagtgattgagtcacttttagaaaaagttgacatcctcttcttggtggaggaatgatcttcacatttacaaggcacaaggtcttcatgggttcatccctgtagaagaagataagttggacttg

SEQ ID NO: 1216 - DNA, 248 bp, Glycine max
  Clone ID: 700740204H1
ggggaggccgaagggtgtcactcccaaatacagcttggcacctcttgtgccccggctttctgcgctcattggtatccaggttgtcaaggctgaagacagtattggtccagaagtagaaaagttggtggcttctcttccagatggaggtgttcttcttctagaaaatgtgaggttttacaaggaggaagaaaagaatgatcccgagcatgcaaaaaagcttgcctctctggcagatctgtttgtgaatg

SEQ ID NO: 1217 - DNA, 229 bp, Glycine max
  Clone ID: 700740733H1
gaggaatgatcttcacattttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgcccccgatgcaaacagcaaggtcgtgccagcatctgccatccctgatggctggatgggattggatat

SEQ ID NO: 1218 - DNA, 244 bp, Glycine max
  Clone ID: 700685870H1
attcctccaccaagaagaaggatgtcaacttttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgctcctgatgctaatagcaaggtcgtgccagcatctgccatccctgatggctggatgggattggatattgg

SEQ ID NO: 1219 - DNA, 289 bp, Glycine max
  unsure (1)...(289): unsure at all n locations
  Clone ID: 700554310H1
ccagaatccgcgccgccattcccaccatncaaacatctcatccaaaacggcgccaaagtcattctctccagccacttgnggcggccgaanggtgtcactcccaaatacagcttggcgcctcttgtaccccggctttctgagctcattggtatccagattgtcaaggccgaggacagtattggtccagaagtagaaaagttggtggcttctctccagatggaggtgttctcctctagaaaatgtgaggttttacaaggaggaagaaaagaatgaccccgagcatgcaaaa

SEQ ID NO: 1220 - DNA, 228 bp, Glycine max
  Clone ID: 700863147H1
ggaggaaagggcgcgaggggggtggtgtcgatggcgaagaagagcgtgggggacctgagcgcggcggacctgaaggggaagaaggtcttcgtcagggccgacctcaacgtcccgctcgacgacaaccagaacatcaccgacgacaccagaatccgcgccgccattcccaccatcaaacatctcatccaaaacggcgccaaagtcattctctccagccacttggggcgg

SEQ ID NO: 1221 - DNA, 259 bp, Glycine max
  unsure (1)...(259): unsure at all n locations
  Clone ID: 700991401H1
gggagctgagcgcggcggacctgaaggggaagaaggtcttcgtcagggccgaccttcaacgtcccgctncgacgacaaccagaacatcaccnacgacaccagaattcgcgccgccattcccaccatcaaacacctaatccaaaacggcgccaaagttattctctccagccacttggggaggccgaagggtgtcactcccaaatacagcttggcacctcttgtaccccggctttctgagctcattggtatccaggttgtc

SEQ ID NO: 1222 - DNA, 252 bp, Glycine max
  unsure (1)...(252): unsure at all n locations
  Clone ID: 700998332H1
ttacaaggcacaaggtctttcagtgggttcatcccttgtagaagaagataagttggatcttgctacatcactacttgcaaaagccaaggaaaagggggtgtctctcttgttaccaagtgatgtggtgattgcagacaaatttgctcctgatgctaatagcaaggtcgtgccagcatctgccatccctgatggctggatgggatggatgctngtccagatccgntaaatcantcagtgaagcttgggtacnac

SEQ ID NO: 1223 - DNA, 239 bp, Glycine max
  Clone ID: 700945115H1
caccagaatccgcgccgccattcccaccatcaaacatctcatccaaaacggcgccaaagtcattctctccagccacttggggcggccgaagggtgtcactcccaaatacagcttggcgcctcttgtaccccggctttctgagctcattggtatccagattgtcaaggccgaggacagtattggtccagaagtagaaaagttggtggcttctcttccagatggaggtgttctccttctag

SEQ ID NO: 1224 - DNA, 278 bp, Glycine max
  Clone ID: 700556386H1
gaaaatgtgaggttttacaaggaggaagaaaagaatgatcccgagcatgcaaaaaagcttgcctctctggcagatctgtttgtgaatgatgcatttggtactgctcacagggcacatgcatcaacagagggtgttactaaatacctgaagccatctgttgctggttttctttgcaaaaggaacttgattacctgttggggcggtatcaagccccaaaaggccattgctgccatgttggtggttccaaggtctctctaaaattgagtgattgagtcatt

SEQ ID NO: 1225 - DNA, 226 bp, Glycine max
  unsure (1)...(226): unsure at all n locations
  Clone ID: 700566403H1
gcatttggtactgctcacagggcacatgcatcaacagagggtgttactaaatacctgaagccatctgttgctggttttcttttgcaaaaggancttgattaccttgttggggcagtatcaaaccccaaaaggccatttgctgccattgttggtggttccaaagtctcatctcaaattggagtgattgagtcattttagaaaaagttgacatccttcttcttggtgg

SEQ ID NO: 1226 - DNA, 250 bp, Glycine max
  Clone ID: 700683958H1
ctcttccagatggaggtgttcttcttctagaaaatgtgaggttttacaaggaggtagaaaagactgatcccgagcatgcaaaaaagcttgcctctctggcagatctgtttgtgaatgatgcatttggtactgctacagggcacatgcatcaacagagggtgttactaaatacctgaagccatctgttgctggttttcttttgcaaaaggaacttgattaccttgttggggcggtatcaagccccaaaagg

SEQ ID NO: 1227 - DNA, 247 bp, Glycine max
  Clone ID: 700686245H1
ggctcgagctgctcacagggcacatgcatacaacagagggtgttacacaatacctgaagccatctgacgctggttttcttttgcaaaaggaacttgattaccttgttggggcggtatcaagcccaaaaggccatttgctgccattgttggtggttccaaggtctcatctaaaattggagtgattgagtcacttttggaaaaagttgacattcttcttcttggtggaggaatgatcttcacattttac

SEQ ID NO: 1228 - DNA, 243 bp, Glycine max
  Clone ID: 700787536H1
ctcgagccgaatcggctcaggcttggcacctcttgtaccccaggtttctgagctcatatggtatccaggttgtcaaagctgaagacagtattggtccagaagtagaaaagttggtggcttctcttccagatggaggtgttcttcttctagaaaatgtgaggttttacaaggaggaagaaaagaatgatcccgagcatgcaaaaaagcttgcctctctggcagatctgtttgtgaatgatgcat

SEQ ID NO: 1229 - DNA, 258 bp, Glycine max
  Clone ID: 700740635H1
cttgattaccttgttggggcggtatcatgccccaaaaggccatatgctgccattgttggtggttccaaggtctcatctaaaattggagtgatgagtcacttttggaaaaagttgagattcttcttcttggtggaggaatgatcttcacattttacaaggcacaaggtctttcagtgggttcatcccttgtagaagaagataagttggatcttgctacatcactacttgcaaaagccaaggaaaagggggtgtctctct

SEQ ID NO: 1230 - DNA, 165 bp, Glycine max
  Clone ID: 700875038H1
gctcattggtatccaggttgtcaaggctgaagacagtattggtccagaagtagaaaagttggtggcttctcttccagatggaggtgttcttcttctagaaaatgtgaggttttacaaggaggaagaaaagaatgatcccgagcatgcaaaaaagcttgcctctct

SEQ ID NO: 1231 - DNA, 239 bp, Glycine max
  Clone ID: 700677613H1
ctcgagccgaatcggctcgaggaagaaaagaatgaccccgagcacgcaaaaaagcttgcagctctggcagatctgtatacgaatgatgcatttggtactgctcacagggcacatgcatcaacagagggtgttactaaatacctgaagccatctgttgctggttttcttttgcaaaaggaacttgattaccttgttggggcagtatcaaaccccaaaaggccatttgctgccattgttgg

SEQ ID NO: 1232 - DNA, 266 bp, Glycine max
  Clone ID: 700683146H1
cgacgagcgtgggggacctgagcgcggcggacctgaaggggaagaaggtcttcgtcagggccgacctcaacgtcccgctcgacgacaaccagaacatcaccgacgacaccagaatccgcgccgccattcccaccatcaaacatctcatccaaaacggcgccaaagtcattctctccagccacttggggcggccgaagggtgtcactcccaaatacagcttggcgcctcttgtaccccggctttctgagctcattggtatccagatt

SEQ ID NO: 1233 - DNA, 333 bp, Glycine max
  Clone ID: 700652503H1
gctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttagccttgcaactacacttctcgataaggccaaggctaaaggggtttctttgttgctccaactgatgtggtcatagcagacaagtttgctgctgatgctaacagcaagactgtgccagcatcaagcatcccagacgggtggatgggattagatattggtcccgattccatcaaga

SEQ ID NO: 1234 - DNA, 304 bp, Glycine max
  Clone ID: 700653271H1
gctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgctgtggagaaggttggacttgcagacaagatgagccacatctccactggtggtggtg

SEQ ID NO: 1235 - DNA, 345 bp, Glycine max
  Clone ID: 700653809H1
gctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgctgtggagaaggttggacttgcagacaagatgagccacatctccactggtggtggtgccacttagacttcttgagggaaagcaactcctggtgtcttg

SEQ ID NO: 1236 - DNA, 305 bp, Glycine max
  Clone ID: 700653270H1
gctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgctgtggagaaggttggacttgcagacaagatgagccacatctccactggtggtggtgc

SEQ ID NO: 1237 - DNA, 340 bp, Glycine max
  unsure (1)...(340): unsure at all n locations
  Clone ID: 700653817H1
gctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactngcaaagctgantgggaagggagtgacaaccatcattggaggaggtgactccgttgccgctgtggagaaggttggacttgcagacaagatgagccacatctccactggtggtggtgccagcttagacttcttgagggaaagcaactcctggt

SEQ ID NO: 1238 - DNA, 295 bp, Glycine max
  Clone ID: 701105168H1
gtttgctgctgatcctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgtgtggagaagttggacttgcagacaagatgaccac

SEQ ID NO: 1239 - DNA, 283 bp, Glycine max
  Clone ID: 701045331H1
ctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggagg

SEQ ID NO: 1240 - DNA, 282 bp, Glycine max
  Clone ID: 701049149H1
ggagtggccaaatacttgaagccctctgttgcaggattccttatgcagaaggaacttgactatctagttggagctgtgtcaaaccccaagagaccatttgctgctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttagccttgcaactacacttctc

SEQ ID NO: 1241 - DNA, 337 bp, Glycine max
  unsure (1)...(337): unsure at all n locations
  Clone ID: 700661992H1
gtttgctgctgatgctancngcaagactgtgcnggcatcaagcatcccagatgcgtggatggggttggacattngtcctgattccatcaanacatttggtgaagcattggatacgactcagnncattattggantggaccaatgggtgtcttgagtttganaantttgccacaggaacannggctatngccaaganactggcagagctgagtgggaagggagtgacaaccatcattggaggaggtgactccgttgccgctgtggagaangntggactgcagacaagatgagccacatctccacggcngtngtgccatctagagctctngagggaaac

SEQ ID NO: 1242 - DNA, 271 bp, Glycine max
  Clone ID: 701051265H1
cggctcgagctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagt

SEQ ID NO: 1243 - DNA, 273 bp, Glycine max
  Clone ID: 701058557H1
caaatacttgaagccctctgttgcaggattccttatgcagaaggaacttgactatctagttggagctgtgtcaaaccccaagagaccatttgctgctatcgttggtgggtcaaaggtgtcttccaagattggcgttattgagtccttgttggagaaagttaacgttctcttgcttggtggaggaatgatctttaccttttacaaggctcagggttattcagttggttcatctcttgtggaggaagacaagcttagccttgcaactacacttct

SEQ ID NO: 1244 - DNA, 258 bp, Glycine max
  Clone ID: 700956835H1
aaatacttgaagccctctgttgcaggattcctaatgcagaaggagcttgattatctagttggggctgtgtcaaaccccaagagaccatttgctgctattgtcggtggatcgaaggtgtcttccaagattggagttattgaatccttgttggagaaagttaatgttctcttgcttggtggaggaatgatctttaccttttacaaggctcagggttattcagttgggtcatctcttgtggaggaagacaagcttagcctt

SEQ ID NO: 1245 - DNA, 262 bp, Glycine max
  Clone ID: 701054480H1
acgttctcttgcttggtggaggaatgatctttaccttttacaaggctcagggttattcagttggttcatctcttgtggaggaagacaagcttagccttgcaactacacttctcgaaaaggccaaggctaaaggggtttctttgttgcttccaactgatgtggtcatagcagacaagtttgctgctgatgctaacagcaagactgtgccagcatcaagcatcccagacgggtggatgggattagatattggtcccgattccat

SEQ ID NO: 1246 - DNA, 258 bp, Glycine max
  Clone ID: 700903222H1
ctgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatggaccaatgggtgtttttgagtttgataattttgccacaggaacagaggctatagccaagaaactggcagagctgagtgggaagggagtgacaaccatca

SEQ ID NO: 1247 - DNA, 256 bp, Glycine max
  Clone ID: 700959058H1
gctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgctgtggaga

SEQ ID NO: 1248 - DNA, 265 bp, Glycine max
  Clone ID: 701105272H1
gcaggattccttatgcagaaggaacttgactatctagttggagctgtgtcaaaccccaagagaccatttgctgctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttagccttgcaactacacttctcgaaaaggccaagg

SEQ ID NO: 1249 - DNA, 255 bp, Glycine max
  Clone ID: 701058567H1
caaatacttgaagccctctgttgcaggattccttatgcagaaggaacttgactatctagttggagctgtgtcaaaccccaagagaccatttgctgctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttag

SEQ ID NO: 1250 - DNA, 265 bp, Glycine max
  Clone ID: 701206133H1
gggttattcagttgggtcatctcttgtggaggaagacaagcttagccttgcaactacacttcttgaaaaggccaaggctaaaggggtttctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatgga

SEQ ID NO: 1251 - DNA, 267 bp, Glycine max
  Clone ID: 701061140H1
cagcagacaagtttgctgctgatgctaacagcaagactgtgccagcatcaagcatcccagacgggtggatgggattagatattggtcccgattccatcaagacatttggtgaagcattggataagacccagaccgtcatttcgaatggaccaatgggtgtttttgagtttgataagtttgccacaggaacagaggccatagccaagaaactggcagagctgagtgggaagggagtaacgaccatcattggaggaggtgactctgttg

SEQ ID NO: 1252 - DNA, 263 bp, Glycine max
  Clone ID: 700749775H1
gggtcatctcttgtggaggaagacaagcttagccttgcaactacacttcttgaaaaggccaaggctaaaggggtttctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatggaccaatgggtgt

SEQ ID NO: 1253 - DNA, 266 bp, Glycine max
  Clone ID: 700946208H1
tgcaactacacttcttgaaaaggccaaggctaaaggggtttctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtatgccacaggaacagaggcta

SEQ ID NO: 1254 - DNA, 252 bp, Glycine max
  Clone ID: 700952526H1
gaggaatgatctttaccttttacaaggctcagggttattcagttggttcatctcttgtggaggaagacaagcttagccttgcaactacacttctcgaaaaggccaaggctaaaggggtttctttgttgcttccaactgatgtggtcatagcagacaagtttgctgctgatgctaacagcaagactgtgccagcatcaagcatcccagacgggtggatgggattagatattggtcccgattccatcaagacat

SEQ ID NO: 1255 - DNA, 247 bp, Glycine max
  Clone ID: 700902915H1
gagcttgattatctagttggggctgtgtcaaaccccaagagaccatttgctgctattgtcggtggatcgaaggtgtcttccaagattggagttattgaatccttgttggagaaagttaatgttctcttgcttggtggaggaatgatctttaccttttacaaggctcagggttattcagttgggtcatctcttgtggaggaagacaagcttagccttgcaactacacttcttgaaaaggccaaggcta

SEQ ID NO: 1256 - DNA, 249 bp, Glycine max
  Clone ID: 700739757H1
ctgatgtggtcatagcagacaagtttgctgctgatgctaacagcaagactgtgccagcatcaagcatcccagacgggtggatgggattagatattggtcccgattccatcaagacatttggtgaagcattggataagacccagaccgtcatttggaatggaccaatgggtgtttttgagtttgataagtttgccacaggaacagacgccatagccaagaaactggcagagctgagtgggaagggagtaa

SEQ ID NO: 1257 - DNA, 253 bp, Glycine max
  Clone ID: 700685033H1
agctgtgtcaaaccccaagagaccatttgctgctatcgttggtgggtcaaaggtgtcttccaagattggagttattgagtccttgttggagaaagttaacgttctcttgcttggtggaggaatgatctttaccttttacaaggctcagggttattcagttggttcatctcttgtggaggaagacaagcttagccttgcaactacacttctcgaaaaggccaaggctaaaggggtttctttgttgcttccaact

SEQ ID NO: 1258 - DNA, 243 bp, Glycine max
  Clone ID: 700890918H1
ccggcatcaagcatcccagatgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgctgtggagaaggtt

SEQ ID NO: 1259 - DNA, 242 bp, Glycine max
  Clone ID: 700849869H1
acccgattcgatcaagacatttggtgaagcattggataagacccagaccgtcatttggaatggaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagccacatctccactggtggtggtg

SEQ ID NO: 1260 - DNA, 262 bp, Glycine max
  Clone ID: 701132415H1
ctcgagccggtcatagcagacaagtttgctgctgatgctaacagcaagactgtgccggcatcaagcatcccagatgggtggatggggttggatattggtcctgattccatcaagacatttggtgaagcattggtacgactcagaccattatttggaatggaccaatgggtgtttttggatttgataagtttgccacaggaacagaggctatagccaagaaactggcagagctgagtgggaagggagtgacaaccatcattgg

SEQ ID NO: 1261 - DNA, 283 bp, Glycine max
  Clone ID: 700835725H1
ttcggctcgagctattgtgcggtggatcgaaggtgtcttccaagattggagttattgaatccttgttggagaaagttaatgttctcttgattggtggaggaatgatctttaccttttacaaggctcagggttattcagtgggtcatctcttgtggaggaagacaagcttagccttgcaactacacttcttgaaaaggccaaggctaaaggggtttctttgttgcttccaactgatgttgtcatagcagacaagtttgctgctgatgctaacagcaagactgtg

SEQ ID NO: 1262 - DNA, 255 bp, Glycine max
  Clone ID: 701125828H1
gtcaaaccccaagagaccatttgctgctattgtcggtggatcgaaggtgtcttccaagattggagttattgaatccttgttggagaaagttaatgttctcttgcttggtggaggaatgatctttaccttttacaaggctcagggttattcagttgggtcatctcttgtggaggaagacaagcttagccttgcaactacacttcttgaaaaggccaaggctaaaggggtttctttgttgcttccaactgatgttgt

SEQ ID NO: 1263 - DNA, 233 bp, Glycine max
  Clone ID: 700891372H1
gaaaaggccaaggctaaaggggtttctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatggaccaatgagtgtttttgagtttgataagtttgc

SEQ ID NO: 1264 - DNA, 255 bp, Glycine max
  Clone ID: 700898167H1
agttggttcatctcttgtggaggaagacaagcttagccttgcaactacacttctcgaaaaggccaaggctaaaggggtttctttgttgcttccaactgatgtggtcatagcagacaagtttgctgctgatgctaacagcaagactgtgccagcatcaagcatcccagacgggtggatgggattagatattggtcccgattccatcaagacatttggtgaagcattggataagacccagaccgtcatttggaatgg

SEQ ID NO: 1265 - DNA, 233 bp, Glycine max
  Clone ID: 700891730H1
agttgggtcatctcttgtggaggaagacaagcttagccttgcaactacacttcttgaaaaggccaaggctaaaggggtttctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacga

SEQ ID NO: 1266 - DNA, 255 bp, Glycine max
  Clone ID: 700901850H1
attggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgctgtggagaaggttggacttgcagacaagatgagccacatctccactggtggtggtccagcttagagcttcttgagggaaagcaactccctggtgtcctt

SEQ ID NO: 1267 - DNA, 223 bp, Glycine max
  Clone ID: 700838329H1
tgggtggatggggttggatattggtcctgattccatcaagacatttggtgaagcattggatacgactcagaccattatttggaatggaccaatgggtgtttttgagtttgataagtttgccacaggaacagaggctatagccaagaaactggcagagctgagtgggaagggagtgacaaccatcattggaggaggtgactccgttgccgctgtggagaaggtt

SEQ ID NO: 1268 - DNA, 226 bp, Glycine max
  Clone ID: 700895548H1
aatgatctttaccttttacaaggctcatggttattcagttgggtcatctcttgtggaggtagacaagcttagccttgcaactacacttcttgaaaaggccaaggctaaaggggtttctttgttgcttccaactgatgttgtcatagcagacaagtttgctgctgatgctaacagcaagactgtgccggcatcaagcatcccagatgggtggatggggttggatatt

SEQ ID NO: 1269 - DNA, 282 bp, Glycine max
  Clone ID: 700645519H1
ggccatagccaagacactcaaaaacacccattggataagacccagaccgtcatttggaatggaccaatgggtgtttttgagtatgataagtctgccacaggaacagaggccatagccaagaaactggcagagctgagtgggaagggagtaccgaccatcattggaggaggtgactctgttgccgctgtggagaaggttggtcttgcagacaagatgagccacatctccactggtggtggtgccagcttagagcttcttgaggggaagcaactccctggtgtc

SEQ ID NO: 1270 - DNA, 207 bp, Glycine max
  Clone ID: 701102605H1
atttggtgaagcattggataagacccagaccgtcatttggaatggaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagccacat

SEQ ID NO: 1271 - DNA, 234 bp, Glycine max
  Clone ID: 701039360H1
gtcggtggatcgaaggtgtcttccaagattggagttattgaatccttgttggagaaagttaatgttctcttgcttggtggaggaatgatctttaccttttacaaggctcagggttattcagttgggtctctcttgtggaggaagacaagcttagccttgcaactacacttcttgaaatggccaaggctaaaggggtttctttgttgcttccaactgatgttgtcatagcagaca

SEQ ID NO: 1272 - DNA, 286 bp, Glycine max
  Clone ID: 701151305H1
tacggctgcgagaagacgacagaagggttaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagccacatctccactggtggtggtgccagcttagagcttcttgaggggaagcaactccctggtgtccttgcccttgatgatgcttgagtaaacatcactagtt

SEQ ID NO: 1273 - DNA, 186 bp, Glycine max
  Clone ID: 701151405H1
tacggctgcgagaagacgacagaagggggaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagc

SEQ ID NO: 1274 - DNA, 147 bp, Glycine max
  Clone ID: 700940911H1
cattacttgaaggcctctgttgcaggattcctaatgcagaaggcgcttgattatctagttagggctgtgtcaaatcccaagagaccatttgctgctattatcggtggatcgaaggtgtcttccaagattggagttattgacatcctt

SEQ ID NO: 1275 - DNA, 170 bp, Glycine max
  unsure (1)...(170): unsure at all n locations
  Clone ID: 700648994H1
gccaaatacttgaagccctctgttgcatgnattcctaatgcagaaggagcttgattatctagttggggctgtgtcaaaccccaagagaccatttgctggctatttcggtggatcgaaggtgtcntccaagattggagtnattgaatccttgttngagaaagttaatgttc

SEQ ID NO: 1276 - DNA, 119 bp, Glycine max
  unsure (1)...(119): unsure at all n locations
  Clone ID: 700564729H1
ccaagattggagtnattgagtccttgttggagaaagtnaacgttctcttgcntggtggaggaatgannnnnaccttttacaaggctcagggttattcagttggttcatctctngtggag

SEQ ID NO: 1277 - DNA, 242 bp, Glycine max
  Clone ID: 700894074H1
tgcagacaagatgagccacatctccactggtggtggtgccagcttagagcttcttgaggggaagcaactccctggtgtccttgcccttgatgatgcttgagtaaacatcactagttcctctgtaatttgtgctttatattattattatggttggatttcagccaacagtggattgaggtacaatgagagagctcttgttgctcctgtagaggcttaatataggttaggtttcgaaataagag

SEQ ID NO: 1278 - DNA, 279 bp, Glycine max
  unsure (1)...(279): unsure at all n locations
  Clone ID: 700558488H1
gttaaatcattcagtgaagcattggatactacccaaaccatcatatggaatggaccaatgggagtgtttgagtttgacaagtttgctgttggtacagaggctantgcaaagaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaagagctccaggagtcctgctct

SEQ ID NO: 1279 - DNA, 259 bp, Glycine max
  Clone ID: 700792287H1
gttaaatcattcagtgaagcattggatactacccaaaccatcatatggaatggaccaatgggagtgtttgagtttgacaagtttgctgttggtacagaggctattgcaaagaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaag

SEQ ID NO: 1280 - DNA, 278 bp, Glycine max
  unsure (1)...(278): unsure at all n locations
  Clone ID: 701000168H1
gttggatcttgctacatcactacttgcaaaagccaaggaaaagggngtgtctctcttgttaccaagtgatgtggtgattgcagacaaatttgctcctgatgctaatagcaaggtcgtgccagcatctgccatccctgatggctggatgggcttggatattggtccagattctgttaaatcattcagtgnagcattggatactacccaaaccatcatatggaatggaccaatgggagtgtttgagtttgacaagtttgctgttggtacagaggctattg

SEQ ID NO: 1281 - DNA, 250 bp, Glycine max
  Clone ID: 700739376H1
cccaaaccatcatatggaatggaccaatgggagtgtttgagtttgacaagtttgctgttggtacagaggctattgcaaagaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaagagcttccaggagtccttgctct

SEQ ID NO: 1282 - DNA, 242 bp, Glycine max
  Clone ID: 700854915H1
cccaaaccatcatatggaatggaccaatgggagtgtttgagtttgacaagtttgctgttggtacagaggctattgcaaagaagctggctgacctcagtggaaagggggtgaccacaattattggaggaggagattctgttgcagctgtggagaaagtaggagttgctagtgtcatgagccacatatctactggtggtggtgccagtttggagttattggaaggcaaagagcttccaggagtc

SEQ ID NO: 1283 - DNA, 241 bp, Glycine max
  Clone ID: 700874304H1
gccatccctgatggctggatgggattggatattggtccagattctgttaaatcattcagtgaagcattggatactacccaaaccatcatatggaatggaccaatgggagtgtttgagtttgacaagtttgctgttggtacagaggctattgcaaagaagctggctgatctcagtggaaagggggtgaccacaattatcggaggaggagattctgttgcagctgtggagaaagtaggagttg

SEQ ID NO: 1284 - DNA, 268 bp, Glycine max
  Clone ID: 700656867H1
tcagtggaaagggggtgaccacaattatcggaggaggagattctgttgcagctgtggagaaagtaggagttgctagtgtcatgagccacatatctactggtggtggtgccagtttggagttattggaaggcaaagagcttccaggagtccttgctctcgatgaagccgtcccagttgccgtgtaagacaattttcagctggaaaattttccatcctcagattcggtgttgtcaatctgtaaaagagcatatgttgtaggaccctcgga

SEQ ID NO: 1285 - DNA, 274 bp, Glycine max
  unsure (1)...(274): unsure at all n locations
  Clone ID: 700996544H1
gnttgcngctggtanagaggntanngcnaagaagctggctgatctcagtggaaanggggtgacnacaattatcggaggangagattctgttgcagctgtggagaaagtaggagtngctagtgtncatganccacatatctactggtggtggtgccagtntggagtnattnnaaggcnaagancntccangantccttggtctnnatgaagccgtcccagttgccgtgtaagacnattttcagcttggnnaaatttttccatcctcagattnncg

SEQ ID NO: 1286 - DNA, 108 bp, Glycine max
  Clone ID: 700742706H1
cccaaaccatcatatggaatggaccaatgggagtgtttgagtttgacaagtttgctgttggtacagaggctattgcaaagcagctggctgacctcagtggaaaggggg

SEQ ID NO: 1287 - DNA, 311 bp, Glycine max
  Clone ID: LIB3055-001-Q1-B1-B7
ctaaaattggagtgattgagtcacttttagaaaaagttgaaatccttcttcttggtggaggaatgatcttcacatttgacaaggtacaaggtctttcagtgggttcaacccttgtagaagaagataagttggatcttgctacatcaatacctgcaaaatccaaggaaaagggggtgtctctcgtgttagcaagtgatgtggtgactgcagagaaatttgctcctgatgctaatagcaaagtcgtgccagcatctgccatccctgatggctagatgggatttgctattggtccagattctgttaaatcattc

SEQ ID NO: 1288 - DNA, 394 bp, Glycine max
  Clone ID: LIB3029-012-Q1-B1-G1
ggcctcagccgcatcacccaccactttctctctcctccactccgctacgccttcctcctcctccaccgccacctccgcctccgcctccccctcgcgcgtgcagctcatctcctccctccgcgcccgcccgcgtgcgccgcctgggtttcgccgcagcggacccgctgctcgcggcgagtgtagcggcgcgcgtggcagcggtgcgaggatgatgaaagggcgctaggggggtggtgtcgatggcgaagaagagcgtgggggacctgagcgcggcagacctgaaagggaagaaggtcttcgtcagggccgacctcaacgtcccgctcgacgacacctagaggatcaccgacgacaccagaatccgcgccgcgattcccatcatcagagatctcat

SEQ ID NO: 1289 - DNA, 504 bp, Glycine max
  Clone ID: LIB3040-022-Q1-E1-D5
gggccgacccaagcgtccgaccacgcgtccgtacggctgcgagaagacgacagaagggggaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacaatggcaaatgactctattggggacgaagttgagaagttggttgcacaacttccagaaggtggtgttttgcttctagagaatgtga

SEQ ID NO: 1290 - DNA, 409 bp, Glycine max
  Clone ID: LIB3039-049-Q1-E1-D8
agacggctgcgagaagacgacagaaggggaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacgatggcaaatgactctattggg

SEQ ID NO: 1291 - DNA, 324 bp, Glycine max
  Clone ID: LIB3052-002-Q1-B1-H2
cttgctggttgccacactacaccgatatttccaccaaacccgtttgcgttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacgtccaaaaggtgtaacacctaaatacagtttgaagcctcttgtgccaaggctgtctcaac

SEQ ID NO: 1292 - DNA, 422 bp, Glycine max
  Clone ID: LIB3040-020-Q1-E1-C8
cccacgcgtccgtacggctgcgagaagacgacagaagggggaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacgatggcaaatgactctattgggg

SEQ ID NO: 1293 - DNA, 396 bp, Glycine max
  Clone ID: LIB3056-007-Q1-N1-G5
ctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgtgccaaggctgtctcaacttctcggaattgaggttacgatggcaaatgactctattggggaggaagttgagaagttggttgcacaac

SEQ ID NO: 1294 - DNA, 406 bp, Glycine max
  Clone ID: LIB3039-040-Q1-E1-D8
acgacggctgcgagaagacgacagaagggtacggctgcgagagacgacagaaggggggaacctgatctcttgctggttgccacactacaccgatatttccaccaaacccgtttgcgttgttgtttgcgaataaatggcaactaagaggagcgtgggaacgttgaaggagggtgatttgaaggggaagagggtattcgtgagggtcgatctgaacgtgcctttggatgacaaccttaacatcaccgatgacactagagtccgtgctgctgttcccaccatcaagtacttgactggttatggtgctaaagtgatcctttctagccatttgggacatccaaaaggtgtaacacctaaatacagttgaaaccctcttgtgccaaggctgtctcaacttcttggaattgag

SEQ ID NO: 1295 - DNA, 378 bp, Glycine max
  Clone ID: LIB3040-033-Q1-E1-B5
tacggctgcgagaagacgacagaagggggaacctgatcgatctctttaccagttgccacactacaccgagattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggaaccaaagtgatcctttctagccacttgggacgtcctaaaggtgtaacacctaaatacagtttgaagcctcttgtgccaaggctgtcgcaacttctcggaat

SEQ ID NO: 1296 - DNA, 381 bp, Glycine max
  Clone ID: LIB3039-012-Q1-E1-F12
gacccacgcgtccaacggctgcgagaagacgacagaagggggaacctgatcgatctctttaccagttgcaacactacaccgggattccccctaaacccgtttgcgttgttgtttgcgaagaaatggcgactaagaggagcgtgggaacgttgaaggagggtgatttgaaagggaagagggtgttcgtgagggtcgatctgaacgtgcctttggatgacaaccttaacatcaccgatgacactagagtccgtgctgctgttcccaccatcaagtacttaactggtcatggagccaaagtgatcctttctagccacttgggacgtcctaaaggtgtaacacctaaatacagtttgaagcctcttgttccaaggctgtctcaac

SEQ ID NO: 1297 - DNA, 307 bp, Glycine max
  Clone ID: LIB3053-014-Q1-N1-A3
agctatgacgtcgcctgccctaactcctgaactcggtattagcgacctgtttaccagttgccacactacaccgagattcccgctaaagccgtttgcgttgttgcttgcgaagaaatggcgactcagaggagcgtgcgaacgttgaaggatggtgatttgaaagggaagagggtgttcgtgagggtcgatctgaacgtgcctttggatgacaaccttaacatcaccgatgacactagagtccgtgctgctgatcccaccatcaagtacttaactggtcatggagccaaactgatcctttctagccact

SEQ ID NO: 1298 - DNA, 400 bp, Glycine max
  unsure (1)...(400): unsure at all n locations
  Clone ID: LIB3028-001-Q1-B1-A12
aaaaaaaccttgggggacctgagcgcggcggacctgaaggggaagaaggtcttcgtcagggccgacctcaacgtcccgctcgacgacaaccagaacatcaccgacgacaccagaatccgcgccgccattcccaccatcaaacatctcatccaaaacggcgccaaagtcattctctccagccacttggggcggccgaagggtgtcactcccaaatacagcttggcgcctcttgtaccccggctttctgagctcattggtatccagattgtcaaggccgaggacagtattggtccagaagtagaaaagttggtggcttctcttccagatggaggtgttctccttctagaaaatgtgaggttttacaangaggaagaaaagaatgaccccgagcatgcaaaaa

SEQ ID NO: 1299 - DNA, 436 bp, Glycine max
  Clone ID: LIB3065-008-Q1-N1-F5
aatggcctcagccgcatcccccaccactttctctctcctgcactgggccaccccttcctcctcctccaccgccacctccgcctccccctccccctcgcgcgtgcagctcacctcctccctccgcgcccgcccgctgcgccgcctgggcttcgccgcggcggacccgctgctcgcggcgagtgtagcggcgcgcgtggcggcggtgagaggaggaggaaagggcgccaaggggtggtgtcgatggcgaagaagagcgtgggggacctgagcgcggcggacctgaaggggaagaaggtcttcgtcagggccgacctcaacgtcccgctcgacgacaaccagaacatcaccgacgacaccagaatccgcgccgccattcccaccatcaaacatctcatccaaaacggcgccaaagtcattctctccagccacttggggc

SEQ ID NO: 1300 - DNA, 404 bp, Glycine max
  unsure (1)...(404): unsure at all n locations
  Clone ID: LIB3055-012-Q1-N1-E3
ctctacaatggnctcagnccgatccccaacacttctctgtcctcactcggccacctttcttctcctccaccggcacctccgcctccccctccccctcgcgcgtgcagctcacctcctccctccgcgcccgcccgctgcgccgcctgngcttcgccgcggcggacccgctgctcgcggcgagtgtagcggcgcgcgtggcggcggtgagaggaggaggaaagggcgcgagggggntggtgtcgatggcgaagaagagcgtgggggacctgagcgcggcggacctgaaggggaagaaggtcttcgtcagggccgacctcaacgtcccgctcgacgacaaccagaacaccaccgacgacaccagaatccgcgccgccattcccaccatcaaacatctcatccaaaac

SEQ ID NO: 1301 - DNA, 428 bp, Glycine max
  unsure (1)...(428): unsure at all n locations
  Clone ID: LIB3055-005-Q1-N1-A2
ctcagccgcattcnccaccactctctctctcctcactccggcacggttcctcctcctccaccgccacctccgcctccccctccccctcgcgcgtgcagctcacctcctgcctccgcgcccgcccgctgcgccgcctgngcttcgccgcggcggacccgctgctcgcggcgagtgtagcggcgcgcgtggcggctgtgagaggaggaggaaagggcgcgaggggggtggtgtcgatggcgaagaagagcgtgggggacctgagcgcggcggacctgaaagggaagaaggtcttcgtcagggccgacctcaacgtcccgctcgacgacaaccagaacatcaccgacgacaccagaatccgagccggcattcccaccatcaaacatctcatccaaaacggcgccaaagtcattctctccagccacttgggg

SEQ ID NO: 1302 - DNA, 436 bp, Glycine max
  unsure (1)...(436): unsure at all n locations
  Clone ID: LIB3051-039-Q1-K1-B6
gttcatctcttgtggaggaagacaagcttagccttgcaactacacttctcgaaaaggccaaggctaaaggggtttctttgttgcttccaactgatgtggtcatagcagacaagtttgctgctgatgctaacagcaagactgtgccagcatcaagcatcccagacgggtggatgggattagatattggtcccgattccatcaagacatttggtgaagcattggataagacccagaccgtcatttggaatggaccaatgggtgtttttgagtttgataagtttgccacaggaacagaggccatagccaagaaactggcagagctgagtgggaagggagtaacgaccatcattggaggaggtgactctgttgccgctgtggagaaggttggtcttgcagacaagatgagccacatctncactggtggtggtgccagctt

SEQ ID NO: 1303 - DNA, 357 bp, Glycine max
  Clone ID: LIB3054-007-Q1-N1-A7
gaaagttaatgttctcttgcttggtggaggaatgatctttaccttttacaaggctcagggttattcagttgggtcatctcttgtggaggaagacaagcttagccttgcaactacacttcttgaaaaggccaaggctaaaggggtttctttgttgcttccaactgatgttgtcatagcagacaagtttgctgctgatgctaacagcaagactgtgccggcatcaagcatcccagatgggtggatggggttggatattggtcctgattccatcaagacatttggtgaagcattggatacgactcagaccattatttggaatggaccaatgggtgtttttgagtttgataagtttgccac

SEQ ID NO: 1304 - DNA, 405 bp, Glycine max
  Clone ID: LIB3039-027-Q1-E1-H9
agctgcgagaagacgacagaaggggggctgtgtcaaaccccaagagaccatttgctgctattgtcggtggatcgaaggtgtcttccaagattggagttattgaatccttgttggagaaagttaatgttctcttgcttggtggaggaatgatctttaccttttacaaggctcagggttattcagttgggtcatctcttgtggaggaagacaagcttagccttgcaactacacttcttgaaaaggccaaggctaaaggggtttctttgttgcttccaactgatgttgtcatagcagacaagtttgctgctgatgctaacagcaagactgtgccggcatcaagcatcccagatgggtggatggggttggatattggtcctgaattcatcaagacatttggtgaagcat

SEQ ID NO: 1305 - DNA, 385 bp, Glycine max
  Clone ID: LIB3049-026-Q1-E1-D8
agtacggctgcgagaagacgacagaagggtgatgtggtgattgcagacaaatttgctcctgatgctaatagcaaggtcgtgccagcatctgccatccctgatggctggatgggattggatattggtccagattctgttaaatcattcagtgaagcattggatactacccaaaccatcatatggaatggaccaatgggagtgtttgagtttgacaagtttgctgttggtacagaggctattgcaaagaagctggctgacctcagtggaaaagcggtgaccacaattattggaggaggagattctgttgcacctgtggagaaagtaggagttgctagtgtcatgagccacatatctactggtggtggtgccagtttggagttattgg

SEQ ID NO: 1306 - DNA, 404 bp, Glycine max
  Clone ID: LIB3028-006-Q1-B1-C12
ggaatggaccaatgggagtgtttgagtttgacaagtttgctgttggtacagaggctattgcaaagaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaagagcttccaggagtccttgctctcgatgaagccgtcccagttgccgtgtaagacaattttcagcttggaaaatttttccatcctcagatttcggtgttgtcaatcttgtaaaagagcatatgttgtaggacccttcggagtctgttagtgtaaattttatcatgcttgagttattattggcttcacacataa

SEQ ID NO: 1307 - DNA, 410 bp, Glycine max
  Clone ID: LIB3028-007-Q1-B1-C11
agaagctggctgatctcagtggaaagggggtgaccacaattatcggaggaggagattctgttgcagctgtggagaaagtaggagttgctagtgtcatgagccacatatctactggtggtggtgccagtttggagttattggaaggcaaagagcttccaggagtccttgctctcgatgaagccgtcccagttgccgtgtaagacaattttcagcttggaaaatttttccatcctcagatttcggtgttgtcaatcttgtaaaagagcatatgttgtaggacccttcggagtctgttagtgtaaattttatcatgcttgagttattattggcttcacacataaattgcgtgtaactgtaaaccctggctgagagccataaattcgaataaatcttttagttgctgccaaaaa

SEQ ID NO: 1308 - DNA, 225 bp, Zea mays
  Clone ID: 700016883H1
gcacgagatagagtgaggccttgttcggttattcccaatacatatggattggaaaaaattcttaagaagtttgacttgtttgggattcaaacccatccaatcccactcaatccacatggattgagagctaaccgaacaagccctgagttggtccgtgctgtcagtgtgctgcgcagatcgtgtaacattacttcgtgagttcgaaaggcgtgtgacaattttgtt

SEQ ID NO: 1309 - DNA, 137 bp, Zea mays
  Clone ID: 700021845H1
gcacgaggagatttgacttgtttgggattcaaacccatccaatcctactcaatccacatggattgagagctaaccgaacaagccctaagaattttttccaatctcatccaatccatatgtattgggaataaccgaac

SEQ ID NO: 1310 - DNA, 274 bp, Zea mays
  Clone ID: 700042428H1
atggcgtcgtccatgctctccgctaccaccgtgccagtccagcaggagggcggcctgtccgagttctccgggctcaggagctccgcgtcgctgcccatgcgaccggagatgccacgtccggcgacttcatgtccgccgtctcgttcaggacccacgcagtcggcacgagcggcgggtcgcgtcgggcggcgacggaggcgaactggaaggtggccatcaacgggttcggccgcatcgggcgcgacttcctgcgggtactggcacggacgcggcg

SEQ ID NO: 1311 - DNA, 226 bp, Zea mays
  Clone ID: 700042586H1
tgcgctgctgctgcctggcttgctcgctcgctcgctcgtgcatcacatcaacaaccaggtcggcacgagcggcgggtcgcggcgggcgccgacggaggcgaactagaaggtggccatcaacgggttcggccgcatcgggcgcaacttcctgcggtgctggcacgggcgcggcgacgctcgcccctcgacgtaatcgccatcaacgacaccggcggtgtcaagcagg

SEQ ID NO: 1312 - DNA, 279 bp, Zea mays
  Clone ID: 700076627H1
gaaaaaaattgtgaagaaatttgacttgtttgagatttaaacccaatcaatcccactcaatccacatggattgagagctaaccgaacaagcccttacattgacatctctacgagtgaccctctagccaacaacaatttaggtaattcccatgttgccagctaagagtgaccaatccaaacaagatgcaccaagattacattagggcaaaataattcacggaagctgaataaccaatttattggatcaaacagaaagtagatgttatcacaggatggcta

SEQ ID NO: 1313 - DNA, 324 bp, Zea mays
  Clone ID: 700082565H1
ctcaatccatgtggattgggtgggattgagtgggtttcaatcccaaataagtcaaaatctttgataattttttccaatctcatccaatccacatgggataggaataaccgaacaaagtcttactgaggtatgaatttctgctcgtgagataattttgtaatgagacaaatataggctgtttgcctgcagaatccaggtgcttcggctatgaaccatagtgcaattggagaacagcatcagccccctaagccagcaaaggtctcagcaacgcctccagctccctcagctgagcgcccttacgtctgcccctacgatggttgcgac

SEQ ID NO: 1314 - DNA, 146 bp, Zea mays
  Clone ID: 700083976H1
ccatctgtgacagaaccgctagctaatctcacgtcccatattacccagcggttctgtcacagatggtagcaggaagggaagcaaaagtgcaaaacatgtccagaaccgctcgctaatatgggacctgagattagctttttgctgct

SEQ ID NO: 1315 - DNA, 280 bp, Zea mays
  Clone ID: 700085105H1
gctaggctgcagcttgatcggtgggacttctgagcttggaaattctcacatggctgcctgcgtctgcttagtgctggttcagttagctctcaatccatgtggattgaatgagattatatgggtttaaatcccaaacaagtcaaacttcttaatttttttcaatcccatccaacccatgtgtattaggaataaccgaacaaccccttagggcttgttcggttagctctcaatccatatggattgagtgagattgggtgggattaaatcctaagcaagtcaa

SEQ ID NO: 1316 - DNA, 72 bp, Zea mays
  Clone ID: 700087058H1
cccacgcgtccgacactcgagaactccatttcgatctcatttgaaatcaacccatcctcggttcctccgtct

SEQ ID NO: 1317 - DNA, 248 bp, Zea mays
  unsure (1)...(248): unsure at all n locations
  Clone ID: 700087967H1
tgtttccattggatttcaattattagtcaactctagagttgaaacaaacatacaagttcttcattcagtaatcaatatagaagtgcatatctgtttcctcttcatgcctcttgaccaagttttggccanaaattcagtcaaatcttagttaaatctgtttccatctttttttctctctatcacgtgaattgtaataggtttggcctggtaggcctacaactgcagatagtttgcgaagggatttacat

SEQ ID NO: 1318 - DNA, 241 bp, Zea mays
  Clone ID: 700095618H1
ccacgcgtccgccacgcgtccggccgcatcgggcgcaacttcctgcggtgctggcacgggcgaggcgacgcctcgcccctcgacgtcatcgccatcaacgacaccgcacgcgtcaaccaggcgctccacacgcccaagcacgactccacgatcggcatctccgacgccgacgtcaagcccgtcggccacaacgacatctccctcgacggcaaggccatcaaggtcgctgtacgacagcaac

SEQ ID NO: 1319 - DNA, 72 bp, Zea mays
  Clone ID: 700098365H1
tcttcattcaataatcaatatagaacttgtatgtttgtttcaactctagagttgactagttctagatcgcga

SEQ ID NO: 1320 - DNA, 312 bp, Zea mays
  unsure (1)...(312): unsure at all n locations
  Clone ID: 700100580H1
ggcgtcccacctgctcaagtacgactccacgctcggcatcttcgacgccgacgtcaagcccgtcggcgacaacgccatctccgtcgacggcaaggtcatcaaggtcgtgtccgaccgcatacccagcaacctgccgtggggcgagctcggcatcgacctcgtcatcgagggcatcggcgtcttcgtcgaccgcgtaggcgcggggaagcacatccaggcgggggccaagaaggtgctcatcacggcgcccggcaanggcgacatccccagctacgtcgtcggcgtcaaatgctgacagtacaaccccgacga

SEQ ID NO: 1321 - DNA, 257 bp, Zea mays
  Clone ID: 700103906H1
cttgatccatttaaggccttgttcggttaattccgttacacatggattggatggtattggaaaaaattaagaagaagtttgacttccttgggatttaaaccacccaatcccactcaatccatatggattgagagataaccgaacaagctctaaacgcgcaacacttctcttttaggagctatatatactacgtcgatagaatgtatatataggtcctcaaataaaccagccaattaaccaacagaaccatagctcat

SEQ ID NO: 1322 - DNA, 222 bp, Zea mays
  unsure (1)...(222): unsure at all n locations
  Clone ID: 700152882H1
gcanctttgatgctaaggctggcattgccttgaacggcaacttcgtgaagctcgtgtcctggtacgacaacgagtggggatacagcacccgcgtggtcgncctgatccgccacatgnacagcaccaacnannnttnttggaaacctcanggtngggngttangaancggtttntctcntnncccnccccgnggaganggttttncganaaaattttttcccg

SEQ ID NO: 1323 - DNA, 175 bp, Zea mays
  Clone ID: 700155165H1
cccacgcgtccgcgttcacatttattctcagcatagacaagcagcaaagatggtctgcgaccaaaggccatcggggacgaccctcgatagggaggcagaaatatgaacggtgcccctggacgctggatccatgctggttttggacacggttgtctttttgtgtttaacttatctg

SEQ ID NO: 1324 - DNA, 270 bp, Zea mays
  Clone ID: 700157523H1
gatggatgcaaaattaccaattgatacatttgaaaatgtaatgggacttgcaatagaagggtgcaaagcaattgcaacttacatccgagaggtgctattggagaatacaaagaagcttgagtgtcagcgtggttaaccttaggagtgcaggcaggttgatgacctgaacctacccaacaccggacatcacacagccattaagggcttgttcggttagctcttaatccatgtggattgagtgggattggatgagtttgaatcccaaacaat

SEQ ID NO: 1325 - DNA, 236 bp, Zea mays
  Clone ID: 700163947H1
cccacgcgtccgcaaggattcccatggacatgtggttgtccattacacagatgttgatacaaatgttcagctcctttttaggtaccgttgctcatgttgcagcccgaggttgtagctacacaggaacacaaattcagaagataaaagtacaagcgtgaagcacgagccagtacaagtcagcgtgaacagtacgggggtactgttcatctatttataggcacaggacagagcatgtg

SEQ ID NO: 1326 - DNA, 201 bp, Zea mays
  Clone ID: 700197939H1
gtgacagatccgctcgctaatatgggacctgagattagctgttaaaaaatatgtaatattgctaaacatgtctatattcatcatgaacctggcgacccagacgctcgctccatccacatttattctcggcatacacaagcagcaaccatccatgagaagcatgggtgaaaaacccctattgggtcgtgtacatgtggcgga

SEQ ID NO: 1327 - DNA, 330 bp, Zea mays
  Clone ID: 700201904H1
gtgattgggcgggttcaaatctcaaacaagtcaaagttcttctaaattttttccaatcctatccaatccatgtataatgggaataaccgaacaagacctaacagggatccagccccgcttggtcctagcttgtcgtgcagacaatccgaattcatggcatgaaagcaacctatgtacatgtcgttctagggcttcagtatcatgatgcgcatgttgtttctttccccgccgtttgcttgtttagcatcagtggtccttatttagtcatctggcaaacggtttggttttgtttgctgcaggtgatgcagagtaagcttgtaaaatggagtg

SEQ ID NO: 1328 - DNA, 290 bp, Zea mays
  Clone ID: 700204190H1
gtttcggcaaacaatgtgggctgctgagtaagaggacatatctggtgcacataaaaacattggtgcacatggtgcatatattaaattatcaccactcattttagatctaacgtctttagttgatcattcaatttacaaataacaccttccaggcttccaccactacacaccaccacgttggagggtgcttttagcaaaatataccaaacaactagaaacgttagatctaaaatgagtggtgatgatttaatatgtgcagcatgtgcaccaatcttccatgtgcattagat

SEQ ID NO: 1329 - DNA, 103 bp, Zea mays
  Clone ID: 700236061H1
gaaagattttaacttgtttgaaattgaaatccatccaatcccacctaatccacatgaattaagagcaaaacgaatatgccctaaattgattaattcggttgct

SEQ ID NO: 1330 - DNA, 279 bp, Zea mays
  Clone ID: 700238253H1
caagcttaagcttacaatcaacctctcaatcacagtcacaaaacagccattatgtctatcaaggtcggaatcaacggcttcggccgcattggtcgtatcctgctccgcaacgctctcgagaagcccgagctctccgtcgttgccgtcaacgatcctttcattgagcccacctacgctgcctacatgctcaagtatgattcttcccacggtctcttcaagggcgaggtcgaggttgatggccagaacctcgttgtcaacggcaagcccatccgcttctac

SEQ ID NO: 1331 - DNA, 307 bp, Zea mays
  Clone ID: 700256918H1
actgcttccacctggctggtttcccgaaaggtttgatcagttgtgtgactgggaagggttctgaaataggagattttcttacaatgcatcctggagtcaactgcataagttttactggtggcgatactggtatagccatttcaaagaaggctggaatggtccctcttcagatggagcttgggggaaaagatgcttgcattgtgctagaggatgcagatctggatttggtttccgcaaatatagtaaagggtggcttctcatacagtggccagaggtgcactgctgtcaaagtagtgctgatcatgga

SEQ ID NO: 1332 - DNA, 312 bp, Zea mays
  Clone ID: 700259576H1
ctgttacttgttggttttaaatgttagtaattactacgaagtacaataatttgtatggagcatatccagttttagcaactattccatattttaatctatcttttttataagttttagttcatgtgacttattttagaaacttgaactcacaaactttctcttatttggtctctatatagtggaattatgtcattctataatctctgttcgtttattcagtcgttgtgaacactcttctaattgctccctgtcatggttgtgctgtactaatacatattggatgaagtaaacagccatatcagttaagtcaat

SEQ ID NO: 1333 - DNA, 181 bp, Zea mays
  Clone ID: 700263524H1
gagaaaggcaggcggaggcggacaggccacccccgcacctcattccacaattatttgcgcccgtcccatgtcagtcggctttaaaaggacacgagcgcttaaacccccaccccatatccgcatccgctgcctccgcctctcgagtctcgtccacccgtcatcctcctagctcctctactcg

SEQ ID NO: 1334 - DNA, 180 bp, Zea mays
  Clone ID: 700281884H2
ggactcgggttaaaaccatacgcgatgtgaaaagcatgattgagacgaaggctgatgttgctccgaagctacacgtaagggagcttcggctaactggcggaaaaaggaaccgacctaaaggggaaaaggctatttagctctcattggttcatccataagtcaatagtaaatataaagggc

SEQ ID NO: 1335 - DNA, 164 bp, Zea mays
  Clone ID: 700340490H1
gattggaaaaaattgtgaaagattttgacttgtttgggattgaaacccatccaatcccacccaatccacatggattgagagcaaaacgaacaagccctaagaattgatgatgttgtagtacaaattccaggccttcggttgattttctaagagttagtatggtt

SEQ ID NO: 1336 - DNA, 291 bp, Zea mays
  Clone ID: 700346430H1
tgtaaacaaacgattcctcgtatctctcgtcttcctctccaagcattcccttcttccttcttccccactcagggcttattcggttattcccaatacacatagattggattggatgagattagaaaaaattaagaagaagtttgacttgtttgggattcaaacccatctaatccctctcaatccacctctaaccgaacagggcctcagaggggtccgatcctcgtccctgttccactctggatcctgcaacctcctacccctacgacactcgtcttcgtcgccagcgcgcca

SEQ ID NO: 1337 - DNA, 191 bp, Zea mays
  Clone ID: 700349202H1
cgtgaatcaggcgtcggagggccccctcaagggcatcgtgggctacactgagcaccaggtggtctcctctgagttcaacagcgacacccactcctccacctttgacgctggggctagcattgccctcaacgacgactttgtcaagctcagttcctggtatgacaacgaatttggctacagcggcagggtgg

SEQ ID NO: 1338 - DNA, 225 bp, Zea mays
  Clone ID: 700349272H1
catggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctgaatatgttgtagaatcttctggtgtcttcacgacgactgataaagcatcaccacacttaagaggtggtgc

SEQ ID NO: 1339 - DNA, 177 bp, Zea mays
  Clone ID: 700356209H1
aaacctatgatgagatcaaggctaccctctgcctcgactttgaccgcagccttgatctcatcataggtggcagacttctcaagcctaacagtcagagggtagcctcaagggcaaactgggttatgtcgaggaggaccttgtttccaccgatttccagggtgacagcaggtctagcat

SEQ ID NO: 1340 - DNA, 202 bp, Zea mays
  Clone ID: 700377496H1
attgctttgaacggcaactttgtgaagcttgtgtcctggtacgaggatacagcacccgagtggtcgacctgatccgccacatgaacatcaccaagtaaatgaacaaactgatgaaaacatgcaaagagtgatgaaagcatgcagagagagttgtgtttcttccccggaagtcgctccgagattaaattttcctaaccggatt

SEQ ID NO: 1341 - DNA, 173 bp, Zea mays
  Clone ID: 700404753H1
atggcgtcgtccatgctctccgctaccaccgtgccactccagcaggggggcggcctgtccgagttctccgggctcaggagctccgcgtcgctgcccatgcgccggaatgccaccttcgacgacttcatgtccggcggtctcttcaaggaccaaggcggtcggcacgagcggcg

SEQ ID NO: 1342 - DNA, 209 bp, Zea mays
  Clone ID: 700421516H1
aaaaaagatttcaaaaaagccaagcaagtgttggtgcgcaatattaatttgttagagtgatgaattcatattgcgaggggctactgttgggggccttcaacttctgaaggtcctcaaaaacatagatttgacagatgttttccaggtgaaatatgtgaacaggtatcttcagattcggatcatggccatacagagaatggtcaggacga

SEQ ID NO: 1343 - DNA, 266 bp, Zea mays
  Clone ID: 700427941H1
cagaaaccttcggactcggaataaagttgtacacaatatgaaaagcatggacaggacaaaggttgaaccagttccgaagctacgcgcaaggtagcttcggctcaacggcagagaaaggaaccaacttaaaggggaaaaggctatttagtcctcgctggattatctttaagtcaatagtaaacataaagggaatgaatgtaattttacacaggctgtgccctgtgcctataaatagatgaacagtacccccgtactgttcacgctaa

SEQ ID NO: 1344 - DNA, 208 bp, Zea mays
  Clone ID: 700428888H1
gtggtttatcgtttcggcacacaatgtgggctgctgcgtacgaggacctatctaggtcgcgcatcaactgttggtgcacatggtgcatatattaaattctcaccaatcattttagatcgaacgtctttagttgatcattcaattgacaaataacgaccttccaggcttccaccactacagagcaccacattggagggtgcttctagcg

SEQ ID NO: 1345 - DNA, 181 bp, Zea mays
  Clone ID: 700432127H1
gacgacatggtcaaggtcatctcctggtacgacaacgagtggggctaaacccaaagggtcgtcgacttcgctgacatctgggcaaccagtggaagtgaagcgttgcattgtaatagcactttgtaactcctcaccctccacagggctttgggattcaccccgaaatgactcactttcggtg

SEQ ID NO: 1346 - DNA, 151 bp, Zea mays
  Clone ID: 700438281H1
cccaacctcaagggcaagctcaacgggatcgcgctccgggtgcccaccccgaacgtctcctcgtcgtgcaggtctccaagaagaccctcgccgaggaggtgaaccaggcgttcggcgacggtccgtcgacttcaggtgctccggcgtctcc

SEQ ID NO: 1347 - DNA, 189 bp, Zea mays
  Clone ID: 700551026H1
aagttaatcttcatttgattttatcttgttagcagcgcaggaaccgttgctgattcagtggttggtagtttctttcacttcctgagttgttggtttagggcatgttcgttttgctcttaatccatgtggattgagtgggattggataggtttaatctcacataagttaaaatctttcataatttttttt

SEQ ID NO: 1348 - DNA, 273 bp, Zea mays
  Clone ID: 700553346H1
atgtaattttgtttgggttgtgtcccgtgcctataaatatgtgaacagtacccccgtactgttcacgctgacttggcattcgctttctacgtcacgtttgtactatcatctccttccagttaaaggtacacttgtaattcaacgatatttctgtttatgcctgataataatacataattgtttatgttggcttttatattccttatatttcctccctcgtcattgtataataaagttatgaaggtacgcctctcataaccttcgtccaaaaac

SEQ ID NO: 1349 - DNA, 53 bp, Zea mays
  Clone ID: 700570760H1
tggtgtcacgagaagtagtataagtccgacatccacaatgtctctaatgctag

SEQ ID NO: 1350 - DNA, 276 bp, Zea mays
  Clone ID: 700580159H1
atttgtcctcaaaattttcacatcttttggagggagctgcatgattagtttattccaagatttagttcatatagccttttatatcttgtgtatatgcagggagtacgaaaaaacagcctttcacatttaggccttgttcggttagcttccaatccacatggattgagtgggattgggtgggtttaaatcccaactaagtcaaactctttcttaattttttccaatctcatccaattcatgggtaacgggattaaccgaacaatgccttaagtgata

SEQ ID NO: 1351 - DNA, 285 bp, Zea mays
  Clone ID: 700616468H1
atcggactgagctcttctttcatgaagctcgtgtcttggtatgacaacgagtggggctacagcaaccgggttctggatctgatcgcccacatggccctcgtcagcggcgccgccaagctctgacgtccgtgctcgttcctccagtagtagcctaggagaaaggctgcaattttgacggccattttctgttagctgttgtctggaataaagatcaaatgctggaacacttcgaactcgcgcgagactggactcagatccatggcctgtatgttagttgtagaaggg

SEQ ID NO: 1352 - DNA, 183 bp, Zea mays
  Clone ID: 700616996H1
gccacagggtggtcgatttggcacacctagtagcaagcaagtgaccacgggcagctacagcagggagtggagacccattggaggaattctgcgagacatagcttgcctgatgagcatgcaaagtatatgactagaggagagcgccttttgctgatttgatgattaccattaccagcagcaaac

SEQ ID NO: 1353 - DNA, 198 bp, Zea mays
  Clone ID: 700618295H1
tttcctccgtcacgcagcatctcaacccatggccaagatcaagatcgggatctttcggttcggcaggatacggaagcttgtggccaaggtggccctgcagagtgacgatgtccagctcgtcgccgtggacgaccctctcatagcacgactacatgaccttcatgttcaatacgacactgtgcacggacagtggaagca

SEQ ID NO: 1354 - DNA, 111 bp, Zea mays
  unsure (1)...(111): unsure at all n locations
  Clone ID: 700622760H1
gagaactttggcattattgcgagtttgatgacaactgttcgtgccatcactgccaccctgtngcctgttgattgaccctcagccaaggactggcgcggtggcagggctgcc

SEQ ID NO: 1355 - DNA, 232 bp, Zea mays
  unsure (1)...(232): unsure at all n locations
  Clone ID: 700799777H1
ggatttggctgacattgttgccaacaagtggaagtgagagccatcanattctgaattggtaattcaattattatatgtatgtaccatgccattgtagttttgtatgcttactactactactactaccactataaacacttgttgcttcatttttcattctaaaacttgtactgagaaacagaaccatcaattttctctgccttctcattgtgcaataaaattcttaccttga

SEQ ID NO: 1356 - DNA, 265 bp, Zea mays
  Clone ID: 700801109H1
gcaagattaagatcggaatcaacggtgagtttgtcccctctccccatgctacgctatttctcctcctcgagctggttcggtccgatctgagttgcgccttctctctgcgactgcgtccgcgtccgcgtccgcgtccgctcaggcttcggaaggatcggcaggctcgtggccagggtcgtcctccagagcgaggatgtcgagctcgtcgccgtcaacgaccccttcatcaccacggactacatgacctacatgttcaagtacgaca

SEQ ID NO: 1357 - DNA, 248 bp, Zea mays
  Clone ID: 701161482H1
catggcacgtacccacagcggctgtggcgtcgacggcgagcttctcgatggagagcgcgtagctgaatggcagtgctcgctgcttccagcacaaggcaggctgcttggccaggatcccggtgctttcaactagttagggctcgttcaggtagctctcaatccatgtagattgagtgagattagatgagtttgaatcccaaacaagtcaaacttcttaattgtttccaatcccatctaatccatgtgta

SEQ ID NO: 1358 - DNA, 254 bp, Zea mays
  unsure (1)...(254): unsure at all n locations
  Clone ID: 701166637H1
attgagcgcttgttgacaagtgatcatgccatcaatgccacccagaagactggtgctggaccctcagctatggactgcagaagtgccagggctgccagctgatacatcattcgcagcagtaccgtagctgctgcggctgtcggcaaggttcttcctgaattgaatggctagctcactgatatgtacttccgngttcccaccgtgatgagtcagttgacgacctcatgtcagaatcgagtgggggcctcttacga

SEQ ID NO: 1359 - DNA, 267 bp, Zea mays
  Clone ID: 701169309H1
cctggatcggtcagcaaaacataggagtattctctattatcattatcaagcagctcgccgagccctcttcctgaaagaatgttgtacatattagcatttgaactctggccagtatcgcggaagaagttgggtgctgtttggttcacgaaatgtaacgtaaagggtaatggtaacggtttacactcgattacggacggtaacaagtttgaatagtccggtatcaaattttagtatggtatctgattacgattggactaaaacaaacat

SEQ ID NO: 1360 - DNA, 256 bp, Zea mays
  Clone ID: 701182137H1
gtccgctggttcatttttgaactaaaccgtgacaaataaaaaagaacgcaggagtatctggcaggcctgattgcctgaatacgaagccccatggcggatcagacaggcacttctcttgcagtcctgtttacccttaccacgatgattatctggaggcaaatcaagggaaaacgacaggtgaccaacagtgggcacgtgtaacagcagactgtagttgtagtggtttagttctcgaagctgcatggactatatttaa

SEQ ID NO: 1361 - DNA, 128 bp, Zea mays
  Clone ID: 701186041H1
gtgcacccgtactgttcacgctgacttggcatttgcttttgtgtcacacttgtacttttaccttcttttaagccgaaggtacatttgtaatttgatatcatttctatttttcaataataataatatag

SEQ ID NO: 1362 - DNA, 221 bp, Zea mays
  Clone ID: 700017162H1
gcacgagctcagacattgctggaattcttttgttggcaaatgaacctatgtagagatccgttgtcaggaggatctgcttagggcttgttcggttagccttcaatccatgtggattgagtgggattggatgggtttgaatcccacgcaagtcaaacttcttcataattttttccaaacccattcaatccatgtgtattgggaataagcgaacaaggccttat

SEQ ID NO: 1363 - DNA, 315 bp, Zea mays
  Clone ID: 700100796H1
gccgccctttttttttttttttttctttttttctttttttttttttttttttttttttttttttttttttttttttgggaagcaaaacaaataaggccttgttcgcttattcccaatacacatggattgaatgggtttggaaaaaattatgaagaagtttgacttgcgtgggattcaaacccatccaatcccactcaatccacatggattgaaggctaaccaaacaagccctaagcagatcctcctgacaacggatctctacataggttcatttgccaacaaaagaattccagcaatgtctgaggccttcttcat

SEQ ID NO: 1364 - DNA, 286 bp, Zea mays
  Clone ID: 700623916H1
ggtgcacagacgagttgccagtcatgaacttttcagtcttgtagaattgggaaatttattgggaatggttgaacaagtggaacgccataaaaatgtgacagtgaagtatgcactacactatgatgtttggtttacgaaatgtaaggtaaatagcaatagtaataattcacatccgagtatcagtggtaataagtttgtatagtccggtatcaatttctagtgtggtatctgattatggttggatttaaataaatatgatttaacgttaaaaaaaaaaaggatgaaa

SEQ ID NO: 1365 - DNA, 334 bp, Zea mays
  unsure (1)...(334): unsure at all n locations
  Clone ID: 700623908H1
tggtgcacagacgagttgccagtcatgaacttttcagtcttgtanaattgggaaatttattgggaatggttgaacaagtggaacgccataaaaatgtgacagtgaagtatgcactacactatgatgtttggtttacgaaatgtaaggtaaatagcaatagtaataattcacatccgagtatcagtggtaataagtttgtatagtccggtatcaatttctagtgtggtatctgattatggttggatttaaataaatatgatttaacgttaaaaaaaaaaatgtctagagtaatgtgtcggatgtattgtgttgagttgggtaaaaatgaaggggg

SEQ ID NO: 1366 - DNA, 284 bp, Zea mays
  Clone ID: 700470437H1
cgtaatccaccgatcatgatacatagtatggtttagtagtagcttatctatgcttttgtgctcgcatttacctgtggttgcatatcaagtattattaaaatgccttgttgtctaaatatgatatattgtgttgggggccttcggcttccgaaggtcctcaaaaacatgatttaacaatgtttctggagtataatgtgtgaacaggtatcttcggacttgaatcagaaagggagaagctcaaaagatacgaaggttgacacagtgccgaagctgtgaagcaggaa

SEQ ID NO: 1367 - DNA, 270 bp, Zea mays
  Clone ID: 700578860H1
ggtaatccaacgatcatgatgcttgttatggtttagtagtagcttatctatgcttttgtgctcgcttttacctgtggttgcatatcaagtattattaaaatgccttgttgtctaaatatgatatattgtgttgggggccttcggcttccgaaggtcctcaaaaacatgatttaacaatgtttctggagtataatgtgtgaacaggtatcttcggacttgaatcagaaagggagaagctcaaaagatacgaaggttgacacagtgccgaag

SEQ ID NO: 1368 - DNA, 257 bp, Zea mays
  Clone ID: 700163212H1
ccttcaatgaaggattggagaggaggacgtggtgctggccaaaacataattcctagctccactggtgcagcaaaggctgttggaaaagttctgcctgagctgaatggaaagctcactggcatggccttccgagttccaacaccaaatgtctctgttgtggacttgacatgccggattgagaaaaacgcctcctatgatgatgtgaaagcagccatcaaggcggcatcagagggtgcactcaaaggtattcttggcta

SEQ ID NO: 1369 - DNA, 244 bp, Zea mays
  Clone ID: 700382256H1
cgttgatggtccttcaatgaaggattggagaggaggacgtggtgctggccaaaacataattcctagctccactggtgcagcaaaggctgttggaaaagttatgcctgagctgaatggaaagctcactggcatggccttccgagttccaaaaacaaatgtctctgttgtggacttgacatgccggattgagaaaaacgcctcctatgatgatgtgaaagcagccatcaaggcggcatcagagggt

SEQ ID NO: 1370 - DNA, 311 bp, Zea mays
  Clone ID: 700085317H1
tgcagagattccatggggtaactttggggctgaatatgttgttgaatcttctggtgtcttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcactaccaactgccttgctccacttgccaaggttgtccatgaggaatttggcatcgtggagggccttatgacaactgttcatgcaacaacagctacccaga

SEQ ID NO: 1371 - DNA, 265 bp, Zea mays
  Clone ID: 700222942H1
ctatgatccaaagatgaatgttgtttctaatgcaagttgcactaccaactgccttgctccacttgccaaggttgtccatgaggaatttggcatcgtggagggccttatgacaactgttcatgcaacaacagctacccagaagaccgtcgatggtccttcgatgaaggattggagaggaggacgtggtgctgcccaaaacataattcccagctccactggtgcagcaaaggctgttggaaaagtcctgcctgagctgaatggaaaa

SEQ ID NO: 1372 - DNA, 308 bp, Zea mays
  Clone ID: 700618371H1
tgctgaatatgttgttgaatcttctggtgtcttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcactaccaactgccttgctccacttgccaacgttgtccatgaggaatttggcatcgtggagggccttatgacaactgttcatgcaacaacagctacccagaagaccgtcgatggtccttcgatga

SEQ ID NO: 1373 - DNA, 304 bp, Zea mays
  Clone ID: 700381022H1
gtcacaattacaagcaaaagagatcctgcagagattccatggggtaactttggggctgaatatgttgttgaatcttctggtgtcttcacgacgactgataaagcatcagcacacttaaagggtggtgcaaagaaagtggtgatatctgcaccatcagctgatgctcccatgtttgtagttggagttaatgagaatagctatgatccaaagatgaatgttgtttctaatgcaagttgcactaccaactgccttgctccacttgccaaggttgtccatgaggaatttggcatcgtggagggcctta

SEQ ID NO: 1374 - DNA, 185 bp, Zea mays
  Clone ID: 700264023H1
ggccttatgacaactgttcatgcaacaacagctacccagaagaccgtcgatggtccttcgatgaaggattggagaggaggacgtggtgctgcccaaaacataattcccagctccactggtgcagcaaaggctgttggaaaagtcctgcctgagctgaatggaaaactcactggtatggccttccg

SEQ ID NO: 1375 - DNA, 293 bp, Zea mays
  Clone ID: 700258875H1
agaaggtcacaattacaagcaaaagagatcctgcagagattccatggggtaactttggggctgaatatgttgttgaatcttctggtgtcttcacgacgactgataaagcatcagcacacttaaagggtggtgcaaagaaagtggtgatatctgcaccatcagctgatgctcccatgtttggaattggaagtaaatgagaatacctatgatcccaaagatgaatgttgtttctaatgcaagttgcactaccaactgccttgctccacttgccaaggttgtccatgaggaatttg

SEQ ID NO: 1376 - DNA, 138 bp, Zea mays
  Clone ID: 700612308H1
gctgatgctcccatgtttgtagttggagttaatgagaatagctatgatccaaagatgaatgttgtttctaatgcaagttgcactaccaactgccttgctccacttgccaaggttgtccatgaggaatttggcatcgtg

SEQ ID NO: 1377 - DNA, 270 bp, Zea mays
  Clone ID: 700552370H1
gcaaagaaagtggtgatatctgcaccatcagctgatgctcccatctttggatcatagctattctcattaactccaactacaaacatgggagcatcagctgatggtgccatgttgtttgttggagttaatgagaatagctatgatccaaagatgaatgttgtttctaatgcaagttgcactaccaactgccttgatccacttgccaaggttgtccatgaggaatttggcatcgtggagggccttaagacaactgttcatgcaacaacagct

SEQ ID NO: 1378 - DNA, 201 bp, Zea mays
  Clone ID: 700458135H1
tgtccatgaggaatttggcatcgtggagggccttatgacaactgttcatgcaacaacagctacccagaagaccgtcgatggtccttcgatgaaggattggagaggaagacgtggtgctggccagaacataattcccagctccactggtgcagcagaagctgttggaaaagtcctgcctgagctgaatggaaactcactggt

SEQ ID NO: 1379 - DNA, 299 bp, Zea mays
  Clone ID: 700339973H1
agcaggtctagcatctttgatgctaaggctggcattgccttgaacggcaacttcgtgaagctcgtgtcctggtacgacaacgagtggggatacagcacccgcgtggtcgacctgatccgccacatgaacagcaccaactaagatgaagaactcaagtcaaggtctggtgatacgagcgagttgtcttcttcccccccgggagaaaagtgcttccgagaataaattttttccatcggaatgtctgaaatatgttgggtgtatcctagtggttggttgagcataatggctcatattttgtc

SEQ ID NO: 1380 - DNA, 125 bp, Zea mays
  Clone ID: 700800152H1
attttttccatcggaatgtctgaaactatgttgggtgtatcctagtggttggttgagcattaatggctcatattttgtcaggtctatgtgtcgccgtgaaacttttaatcaaatcagttcactct

SEQ ID NO: 1381 - DNA, 163 bp, Zea mays
  Clone ID: 700381457H1
cgggaagctcactggcatggccttccgtgtccccactgccaacgtgtcagtggtggacctgacctgacgtctacaaaaacctgccgaatatgatgacatcaagaaggtggtgaagcaggcgtcggagggccccctcaagggcatcctgggctacactgagcac

SEQ ID NO: 1382 - DNA, 300 bp, Zea mays
  Clone ID: 700102991H1
cgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgataccacgcaggcgccccctgccatgccacaatattcgagtggggagaagacaaagattggcatcaacgggtttgggcggattggcaggttggtcctgcgaa

SEQ ID NO: 1383 - DNA, 177 bp, Zea mays
  Clone ID: 700017766H1
gctagtctatgtttgttaccattgacggcttgttcggttagctctcaatccatgtggattgagcgggattggatgggtttgaatcccaaacagctcaaacttcttcacaattttttccaatcccatccaatccatgtgtattgggaataaccgaacaagccctgatgatgattgtgt

SEQ ID NO: 1384 - DNA, 178 bp, Zea mays
  Clone ID: 700020155H1
gctagtctatgtttgttaccattgaaggcttgttcggttagctctcaatccatgtggattgagcgggattggatgggtttgaatcccaaacagctcaaacttcttcacaattttttccaatcccatccaatccatgtgtattgggaataaccgaacaagccctgatgatgattgtgtt

SEQ ID NO: 1385 - DNA, 342 bp, Zea mays
  unsure (1)...(342): unsure at all n locations
  Clone ID: 700617018H1
cactccacctccctcagcagccctcacggccactacccactcggctgtaccacctgtacggctgcactgtccgtcgatcggctttgcaccacacgtccgcgcgctcgctccgtcggtgtcggtagccatggcgctggcggggacgggggtgttcgcggagatcctggacggcgaggtgtacaggtactacgccgacggggagtggcgcactccgcctccggcaagtccgtcgccatcgtcaaccccaccacccgcaagacgcagtacagggtgcaagcatgcacgcaggaggaggtgaacaaggcgatggacgcggnttttgtcgcgcaaggcatgggcccg

SEQ ID NO: 1386 - DNA, 239 bp, Zea mays
  Clone ID: 701166093H1
gcagccctcacggccactacccactgcggctgtaccacctgtacggctgcactgtccgtcgatcggctttgcaccacacgtccgcgcgctcgctccgtcggtgtcggtagccatggcgctggcggggacgggggtgttcgcggagatcctggacagcgaggtgtacaggtactacgccgacggggagtggcgcagctccgcctccggcaagtccgtcgccatcgtcaaccccaccaccc

SEQ ID NO: 1387 - DNA, 175 bp, Zea mays
  Clone ID: 700430939H1
caccccctaaccactccacctccctcagcagccctcacggccactacccactgcggctgtaccacctgtacggctgcactgtccgtcgatcggctttgcaccacacgtccgcgcgctcgctccgtcggtgtcggtagccatggcgctggcggggacgggggtgttcgcggagatc

SEQ ID NO: 1388 - DNA, 251 bp, Zea mays
  Clone ID: 701175483H1
aaacatgtggattgaggggtattggggtgtattaaggccttgttcggttatttccaatacatatggattggatgagattgaaaaaaattgagaagaagtttgacttgtttaggattcaaactcatctaatctcactcaatccacatggattgagagctaaccgatcaaggcgtaaggtaaattttgactagttatggatttatttcctctcaatcaacatggatttggaaaaaaatgaacatcataatatt

SEQ ID NO: 1389 - DNA, 239 bp, Zea mays
  unsure (1)...(239): unsure at all n locations
  Clone ID: 701176645H1
aaggatgtggattgaggggtatgtgggtgtatgaaggccttgttcggttatttccaatagcatatgggagtgggatgaggattggaaaagaaatgtggagagaggaagttgtgagcttggggtgaggatgtgcaaagtgcatgctaatgctgcagtgcaagtccagcatgngatgtggaggaggctagagccgatgcaagggcgtgaagggtaaatgtgtggagctagtgtgtgggatg

SEQ ID NO: 1390 - DNA, 298 bp, Zea mays
  Clone ID: 700100660H1
ggcgacgacatggtcaaggtcatctcctggtacgacaacgagtggggctactcgcagagggtcgtcgacctcgctgacatctgcgccaaccagtggaagtgaagcgttgcattgtaatagcactttgtaactcctcaccctccaccgggctttgggattcaccccgaaatgactcactttcggtgaaattcacccgtttcggcgaggtcgtccgaatataccggccaaatgtttccattggatttcaattattagtcaactctagagttgaaacaaacatacaagttcttcattcagt

SEQ ID NO: 1391 - DNA, 302 bp, Zea mays
  Clone ID: 700097261H1
ccctcaccatggtcatgggcgacgacatggtcaaggtcatctcctggtacgacaacgagtggggctactcgcagaggtcgtcgacctcgctgacatctgcgccaaccagtggaagtgaagcgttgcattgtaatagcactttgtaactcctcaccctccacagggctttgggattcaccccgaaatgactcactttcggtgaaattcacccgtttcggcgaggtcgtccgaatataccggccaaatgtttccattggatttcaattattagtcaactctagagttgaaacaaacatacaagt

SEQ ID NO: 1392 - DNA, 324 bp, Zea mays
  Clone ID: 700097360H1
cggacggtgggttttttttttttttttttgaagaggaaacagatatgcacttctatattgattactgaatgaagaacttgtatgtttgtttcaattctagagttgactaataattgaaatccaatggaaacatttggccggtatattcggacgacctcgccgaaacgggtgaatttcaccgaaagtgagtcatttcggggtgaatcccaaagcccggtggagggtgaggagttacaaagtgctattacaatgcaacgcttcacttccactggttggcgcagatgtcagcgaggtcgacgaccctctgcgagtagccccactcgt

SEQ ID NO: 1393 - DNA, 261 bp, Zea mays
  Clone ID: 700098573H1
cgctgacatctgcgccaaccagtggaagtgaagcgttgcattgtaatagcactttgtaactcctcaccctccacagggctttgggattcaccccgaaatgactcactttcggtgaaattcacccgtttcggcgaggtcgtccgaatataccggccaaatgtttccattggatttcaattattagtcaactctagagttgaaacaaacatacaagttcttcattcaataatcaatatagaagtgcatatctgtttcctcttc

SEQ ID NO: 1394 - DNA, 244 bp, Zea mays
  unsure (1)...(244): unsure at all n locations
  Clone ID: 700101255H1
gaaatccaatggaaacatttggccggtatattcggacgantcgccgaaacgggtgaatttcaccgaaagtgagtcattcggggtgaatcccaaagcccggtggagggtgaggagttacaaagtgctattacaatgcaacgcttcacttccactggttggcgcagatgtcagcgaggtcgacgaccctctgcgagtagccccactcgttgtcgtaccaggagatgaccttgaccatgtcgtcgcc

SEQ ID NO: 1395 - DNA, 205 bp, Zea mays
  Clone ID: 700580636H1
taactcctcaccctccacagggctttgggattcaccccgaaatgactcactttcggtgaaattcacccgtttcggcgaggtcgtccgaatataccggccaaatgtttccattggatttcaattattagtcaactctagagttgaaacaaacatacaagttcttcattcaataatcaatatagaagtgcatatctgtttcctcttc

SEQ ID NO: 1396 - DNA, 170 bp, Zea mays
  Clone ID: 700044915H1
gaagcgttgcattgtaatagcactttgtaactcctcaccctccacagggctttgggattcaccccgaaatgactcactttcggtgaaattcacccgtttcggcgaggtcgtccgaatataccggccaaatgtttccattggatttcaattattagtcaactctagagttg

SEQ ID NO: 1397 - DNA, 237 bp, Zea mays
  Clone ID: 700166009H1
caggatgcatttttacaagagacatcaacaaggcaatcctgatcagtgatgcaatggagactggaactgtgcagatcaactctgcaccggctcgtgggcctgatcatttccccttccagggactgaaagacagtggcattgggtcccaggggataacaaacagcattaacatgatgaccaaggtgaagagcactgtcataaacctgccgtcaccatcctacaccatgggctgagata

SEQ ID NO: 1398 - DNA, 311 bp, Zea mays
  Clone ID: 700075283H1
ctagatcgcgagcgggccgccctttttttttttttttactttcaacgcactttattctttaaactgcaaaagatcttctgcaggaagaactgaggtgtaaatagcgtccaaatctcacgtggctatgaaacatttaactctctacattgctcatggagctatagaacacttaacaagaatatctcagcccatggtgtaggatggtgacggcaggtttatgacagtgctcttcaccttggtcatcatgttaatgctgtttgttatcccctgggacccaatgccactgtctttcagtccctggaaggggaaat

SEQ ID NO: 1399 - DNA, 257 bp, Zea mays
  Clone ID: 700158422H1
ggaacatatctggtgcatatataaatttagtgtacatggtgcatatattaaaacagcattactcattttagatataatgtctctagttgttggtatattttgctaagaacaccctccgacgtggtgaagtatagcggtggaaaatattatttataaattgcaatgatcaactagagacgttaaatctaaaataaatagtgatgatttaatatgtgcaccatatatactaagcttccatgtacaccagatatgtcctc

SEQ ID NO: 1400 - DNA, 271 bp, Zea mays
  Clone ID: 700470273H1
tgtatgaatcgcatagtagatcatgttctctattcctgccttcagtttcttttctcagttgtggtttatcgcggcggggttgatgttgagatttgagatcctcacctgaggaatggaaaaatgctcacctgaggaatggaaaaatataaaaggcttgttcggttattcctatcccatgtggattggatgggattggaaaaaattatgaaagattttaacttgtttgagattgaaatccatccaatcccacctaatccacatgaattaagag

SEQ ID NO: 1401 - DNA, 297 bp, Zea mays
  Clone ID: 700212044H1
gcaaaagatgcttgcattgtgctagaggatgcagatctggatttggtatccgcaaatatagtaaagggtggcttctcatacagtggccagaggtgcactgctgtcaaagtagtgctgatcatggaatcgattgctgatgctgtggtacagaaggttaatgccaagttggcgaaactgaaagttggcccacctgaggacgactctgatatcaccccggttgtaacagaatcctcagccaacttcatcgagggtctggtgatggatgcaaaggagaaaggagcaactttctgccaggag

SEQ ID NO: 1402 - DNA, 351 bp, Zea mays
  unsure (1)...(351): unsure at all n locations
  Clone ID: 700201678H1
tgttgacggacgctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagcaggtcgagcatcttcgacgccaaggccgngatcgctctgaa

SEQ ID NO: 1403 - DNA, 382 bp, Zea mays
  Clone ID: 700618123H1
caaaaggttgtcatctctgctcctagcaaggatgccccatgtttgccgttggtgtcaacgagaaggagtacaagtctgacattaacattgtctccaatgctagctgcacaacaagctgcctggctcctctggctaaggtcatcaatgacaagttcggtatcgttgagggtctgatgaccactgtccatgccatcactgctacccagaagactgttgatgggccctcgtctaaggactggaggggtggaagggctgctagtttcaacatcattcccagcagcactggagctgctaaggctgttggcaaagtgcttcctgtccttaacggaaagttgactggaatgtctttccgtgtcgcaaccgtcgatgtgtctgttgttga

SEQ ID NO: 1404 - DNA, 352 bp, Zea mays
  Clone ID: 700091437H1
cctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagcggtcaccgtctttggcatcaggaaccccgaggagatcccgtggggtgaagctggtgctgagtatgtcgtggagtccaccggtgtcttcactgacaaggacaaggctgctgcacatctt

SEQ ID NO: 1405 - DNA, 331 bp, Zea mays
  Clone ID: 700096907H1
cgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccg

SEQ ID NO: 1406 - DNA, 328 bp, Zea mays
  Clone ID: 700090956H1
cgtggccagggatcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgcccc

SEQ ID NO: 1407 - DNA, 346 bp, Zea mays
  unsure (1)...(346): unsure at all n locations
  Clone ID: 700573711H1
ttctgctcctagcaaggatgcccccatgttcgttgttggtgtcaacgagaaggagtacaagtctgacatcaacattgtctctaatgctanctgcacaaccaactgccttgctccgcttgctaaggtcatcaatgacaagttcggtattgttgagggtctgatgaccactgttcatgccatcactgctacccagaagactgttgatgggccctcatctaaggactggaggggtggaagggctgctagtttcaacatcattcccagcagcactggagctgctaaggctgttggcaaagtgcttcctgtcctcaatggaaaattgactggangtcttccgtgtcccaat

SEQ ID NO: 1408 - DNA, 323 bp, Zea mays
  Clone ID: 700208421H1
cgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgag

SEQ ID NO: 1409 - DNA, 350 bp, Zea mays
  unsure (1)...(350): unsure at all n locations
  Clone ID: 700573153H1
ccgctcccctacctctccagcatctcccgtctccgtcgtctcgtctctgctcctcacctcgccgccagccatgggcaagatcaagatcggaatcaacggtttcggaaggatcggcatgctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgntgggtgatgctggtg

SEQ ID NO: 1410 - DNA, 319 bp, Zea mays
  Clone ID: 700106667H1
atgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagt

SEQ ID NO: 1411 - DNA, 313 bp, Zea mays
  Clone ID: 700266257H1
cagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcacgtctttggcatcaggaacccgaggagtcccgt

SEQ ID NO: 1412 - DNA, 324 bp, Zea mays
  Clone ID: 700082726H1
ctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggg

SEQ ID NO: 1413 - DNA, 317 bp, Zea mays
  Clone ID: 700092552H1
ggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaagg

SEQ ID NO: 1414 - DNA, 322 bp, Zea mays
  Clone ID: 700075862H1
ctcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaa

SEQ ID NO: 1415 - DNA, 326 bp, Zea mays
  Clone ID: 700621325H1
cccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagcggtcaccgtctttggcatcaggaacccg

SEQ ID NO: 1416 - DNA, 322 bp, Zea mays
  Clone ID: 700282389H2
ccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaa

SEQ ID NO: 1417 - DNA, 319 bp, Zea mays
  Clone ID: 700082207H1
catttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcagtaaccctgagg

SEQ ID NO: 1418 - DNA, 321 bp, Zea mays
  unsure (1)...(321): unsure at all n locations
  Clone ID: 700103258H1
ctgccccaagcaaagatgcacccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccaaccagaagactgttgatggaccctcagccaaggactggagaggtggcagggctgccagctttaacatcattcccagcagcaccggtgctgccaangctgtcggtaaggntcttcctgaantgaatggcaagctca

SEQ ID NO: 1419 - DNA, 315 bp, Zea mays
  Clone ID: 700331931H1
cactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtctccaccgactt

SEQ ID NO: 1420 - DNA, 344 bp, Zea mays
  Clone ID: 700575033H1
cctccgcctctcgagtctcgtccacctgtcatcctcctagctcctctactcgccagtcgccttgggcaagatctagacttgtatcaacggcttcggaaggatcggcatgctcgtggccatggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctg

SEQ ID NO: 1421 - DNA, 330 bp, Zea mays
  Clone ID: 700073504H1
ccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagcggtcaccgtctttggcatcaggaaccccgaggagatcccgtggggtgaggctg

SEQ ID NO: 1422 - DNA, 341 bp, Zea mays
  unsure (1)...(341): unsure at all n locations
  Clone ID: 700573737H1
gacaactttggcattattgagggcttgatgacaactgttcatgccatcactgccacccagaagactgttgntggacnctcagccaaggactggagaggtggcagggctgccagctttaacatcattcccagcagcaccggtgctgccaaggctgtcggtaaggttcttcctganttgaatggcaagctcactggcatgtccttccgggttcccaccgtggatgtgtcagttgttgacctcactgtcagaatcgagaagggggcctcttacgaggaaatcaagaaagctattaaggctgcttctgagggcccatcaagggtatatgggtacgtggaggagga

SEQ ID NO: 1423 - DNA, 311 bp, Zea mays
  Clone ID: 700077448H1
gggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgaaaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggcattgccttg

SEQ ID NO: 1424 - DNA, 312 bp, Zea mays
  Clone ID: 700082338H1
gactgttgatggaccctcagccaaggactggagaggtggcagggctgccagctttaacatcattcccagcagcaccggtgctgccaaggctgtcggtaaggttcttcctcaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacag

SEQ ID NO: 1425 - DNA, 345 bp, Zea mays
  Clone ID: 700575985H1
cactcatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtcattggcatcaggaacccgaggagatccgtggg

SEQ ID NO: 1426 - DNA, 319 bp, Zea mays
  Clone ID: 700091658H1
ccagctttaacatcattcccagcagcacaggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcat

SEQ ID NO: 1427 - DNA, 311 bp, Zea mays
  Clone ID: 700259305H1
cgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcag

SEQ ID NO: 1428 - DNA, 305 bp, Zea mays
  Clone ID: 700092013H1
cggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctccccttgctaaggtcattcatgacaacttcggcattgttgagggtttg

SEQ ID NO: 1429 - DNA, 308 bp, Zea mays
  Clone ID: 700104625H1
attcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaa

SEQ ID NO: 1430 - DNA, 311 bp, Zea mays
  Clone ID: 700082934H1
cgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggg

SEQ ID NO: 1431 - DNA, 311 bp, Zea mays
  unsure (1)...(311): unsure at all n locations
  Clone ID: 700083987H1
tgacaactttggcattattgagggcttgatgacaactgttcatgccatcactgccacccagaagactgttgatggaccctcagccaaggactggagangtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcc

SEQ ID NO: 1432 - DNA, 313 bp, Zea mays
  unsure (1)...(313): unsure at all n locations
  Clone ID: 700084648H1
tgacaacttcggcattgttganggtttgatgacaactgttcatgccatcactgccacacagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaanggggcctcctatgaggatatcaagaaagctattaaggctgcttccgagggtcca

SEQ ID NO: 1433 - DNA, 312 bp, Zea mays
  Clone ID: 700095742H1
gccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagcaggtcgagcatcttcgac

SEQ ID NO: 1434 - DNA, 314 bp, Zea mays
  unsure (1)...(314): unsure at all n locations
  Clone ID: 700049963H1
cgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactgganaggtggcagggctgccagctttaacatcattcccagcagcaccggtgctgccaaggctgtcggtaaggttcttcctgaattgaatggcaagctcactggcatgtcc

SEQ ID NO: 1435 - DNA, 317 bp, Zea mays
  Clone ID: 700086285H1
atatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcag

SEQ ID NO: 1436 - DNA, 326 bp, Zea mays
  Clone ID: 700622187H1
ccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaaccggtcacgtctttggcatcagaacccgaggagtcccgtggggtgagctggtg

SEQ ID NO: 1437 - DNA, 320 bp, Zea mays
  Clone ID: 700082208H1
caccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgagggtcgtccccgatggcctttggtcgcagacagtctttgctgcttgtctatgctgagaataaatgtgaacggtgcccctggacgctggatccatgctggttttggacacggttgtctttttgtgtttaactta

SEQ ID NO: 1438 - DNA, 355 bp, Zea mays
  unsure (1)...(355): unsure at all n locations
  Clone ID: 700615142H1
ggcttgaaaagtcagcaacctatgatgagatcaagggctgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtcctggtacgacaacgagtggggatacagcacccgcgtggtcgacctgatccgccacatgaacagcaccaataagatgaagaactcaagtctggtgatacgagcantttctctttcccccccggagaaaagtgcttccgngaataatttttttccatcggang

SEQ ID NO: 1439 - DNA, 316 bp, Zea mays
  Clone ID: 700072750H1
cggacgcgtgggtttcgatctcatttgaaatcaacccatcctcgtttcctccgtctagcagcctctcaccctcatggccaagatcaagatcgggatcaatcggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgc

SEQ ID NO: 1440 - DNA, 307 bp, Zea mays
  Clone ID: 700210619H1
gtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgt

SEQ ID NO: 1441 - DNA, 308 bp, Zea mays
  Clone ID: 700083321H1
gaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctg

SEQ ID NO: 1442 - DNA, 310 bp, Zea mays
  Clone ID: 700090105H1
gtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtg

SEQ ID NO: 1443 - DNA, 327 bp, Zea mays
  Clone ID: 700049167H1
cagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgtgggtcgtcccaat

SEQ ID NO: 1444 - DNA, 311 bp, Zea mays
  Clone ID: 700074010H1
tccatttcggtcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcagg

SEQ ID NO: 1445 - DNA, 309 bp, Zea mays
  Clone ID: 700101165H1
gattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactga

SEQ ID NO: 1446 - DNA, 305 bp, Zea mays
  Clone ID: 700049769H1
acaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctctta

SEQ ID NO: 1447 - DNA, 303 bp, Zea mays
  Clone ID: 700263267H1
cgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctt

SEQ ID NO: 1448 - DNA, 302 bp, Zea mays
  Clone ID: 700265580H1
gttgttatctctgccccaagcaaagatgcacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgacaactgttcatgccatcactgccacacagaaaactgttgacggaccctcagccaaggactggagaggtggcagggctgccagctttaacatcattcctagcagcaccggtgctgccaaggctgttggtaa

SEQ ID NO: 1449 - DNA, 304 bp, Zea mays
  Clone ID: 700266447H1
gccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtcca

SEQ ID NO: 1450 - DNA, 303 bp, Zea mays
  Clone ID: 700026705H1
ccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcct

SEQ ID NO: 1451 - DNA, 303 bp, Zea mays
  Clone ID: 700098736H1
tcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgag

SEQ ID NO: 1452 - DNA, 305 bp, Zea mays
  Clone ID: 700106693H1
gtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttg

SEQ ID NO: 1453 - DNA, 314 bp, Zea mays
  Clone ID: 700086276H1
gagctcgtcgccgtcaacccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagacgttgttatctctgcccaagcaaagatgcaccatgtttgttg

SEQ ID NO: 1454 - DNA, 336 bp, Zea mays
  Clone ID: 700087952H1
gctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaaaggggctcttacgaggaaatcaagaaagctattaaggtgctctgaagggccactcaaggtatta

SEQ ID NO: 1455 - DNA, 315 bp, Zea mays
  Clone ID: 700206583H1
gctgcacatctcaagggtggtgccaagaaggttgttatctctgccccaagcaaagacgcacccatgtttgttgttggtgtcaatgaggacaagtacacctcggatgttaacattgtttccaatgctagctgcaccacaaactgccttgctccccttgctaaggtcattcatgacaacttcggcattgttgagggtctgatgacaactgttcatgccatcactgccacccagaaaactgttgacggaccctcagccaaggactggagaggtggcagggctgccagtttaacatcattccgagcagcaccggtgctg

SEQ ID NO: 1456 - DNA, 304 bp, Zea mays
  Clone ID: 700088779H1
cgcctctcgagtctcgtccacccgtcatcctcctagctcctctactcgccagtcgccatgggcaagattaagatcggaatcaacggcttcggaaggatcggcaggctcgtggccagggtcgcactccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcagga

SEQ ID NO: 1457 - DNA, 303 bp, Zea mays
  unsure (1)...(303): unsure at all n locations
  Clone ID: 700212176H1
gcangaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctccgcttgctaaggtcatcaatgacaagttcggtattgttgagggtctgatgaccactgttcatg

SEQ ID NO: 1458 - DNA, 316 bp, Zea mays
  Clone ID: 700085815H1
cacagatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggt

SEQ ID NO: 1459 - DNA, 302 bp, Zea mays
  Clone ID: 700085668H1
ttgatgacaactgttcatgccatcactgccacccagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcat

SEQ ID NO: 1460 - DNA, 302 bp, Zea mays
  Clone ID: 700106805H1
tgccaagaaggttgttatctctgccccaagcaaagatgcgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaagg

SEQ ID NO: 1461 - DNA, 305 bp, Zea mays
  unsure (1)...(305): unsure at all n locations
  Clone ID: 700103136H1
gaaccctgaggagatcccatggggttcggttggcgctgaatatgttgttgagtctactggtgttttcactgaccagnagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctccgcttgctaaggtcatcaatgacaagttcggtattgttganggtctgatgaccactgttcatgccatca

SEQ ID NO: 1462 - DNA, 305 bp, Zea mays
  Clone ID: 700089503H1
gctgcacatctcaagggtggtgccaagaaggttgttatctctgccccaagcaaagacgcacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgacaactgttcatgccatcactgccacccagaaaactgttgacggaccctcagccaaggactggagaggtggcagggctgccagctttaacatcattcctagcag

SEQ ID NO: 1463 - DNA, 312 bp, Zea mays
  Clone ID: 700260534H2
atcatgggttatgtggaagaggatctggtttctaccgacttccttggtgacagcaggtcgagcatcttcgacgccaaggccgggatcgctctgaacgactattcgtcactcgctcgtggtagaaagatgaggtaacaccggtcgtcgacctgatccgccacatgttcaagacccagtaggggtttttcccccctgcttctcatggatggttgcagcttgtgtatgccgagaataaatgtggatggcgcgtgcctctgggtcgccaggtacatgctgagtctggacatgttttgcacttttgtttcccttcct

SEQ ID NO: 1464 - DNA, 306 bp, Zea mays
  Clone ID: 700083056H1
gtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgagggtcgtccccgatggcctttggtcgcagacagtctttgctgcttgtctatgctgagaataaatgtgaacggtgcccctggacgctggatccatgctggttttggacacggttgtctttttgtgtttaacttatctgctgccg

SEQ ID NO: 1465 - DNA, 319 bp, Zea mays
  Clone ID: 700211911H1
agctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagcgggtcaccgtctttggc

SEQ ID NO: 1466 - DNA, 296 bp, Zea mays
  Clone ID: 700343952H1
gagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcagga

SEQ ID NO: 1467 - DNA, 297 bp, Zea mays
  Clone ID: 700220468H1
caagcaaagatgcacccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctg

SEQ ID NO: 1468 - DNA, 306 bp, Zea mays
  Clone ID: 700331968H1
gacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacacctccgatgttaacattgtttccaatgctagctgcaccacaaactgccttgctccccttgctaaggtcattcatgacaa

SEQ ID NO: 1469 - DNA, 301 bp, Zea mays
  Clone ID: 700077160H1
gtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtg

SEQ ID NO: 1470 - DNA, 306 bp, Zea mays
  Clone ID: 700466212H1
gctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagtccgtcgtcgtcaacgaccccttcatcaccacggactacatgacctacatgttcaagtacgacaccgtccacggccactggaagcacagcgacatcacactcaaggactccaagacccttctcttcggtgacaagccggtcaccgtctttggca

SEQ ID NO: 1471 - DNA, 299 bp, Zea mays
  Clone ID: 700085480H1
cgcttctcttcggcgagaagccggtcaccgtctttggcatcaggaaccccgaggagatcccgtggggtgaggctggtgctgagtatgtcgtggagtccaccggtgtcttcactgacaaggacaaagctgctgcacatctgaagggtggtgccaagaaggttgttatctctgccccaagcaaagatgcacccatgtttgttgttggtgtcaatgaggacaagtacacctccgatgttaacattgtttccaatgctagctgcaccacaaactgccttgctccccttgctaaggtcattcat

SEQ ID NO: 1472 - DNA, 308 bp, Zea mays
  Clone ID: 700097118H1
agcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgctggtgtcaacgagaagga

SEQ ID NO: 1473 - DNA, 300 bp, Zea mays
  Clone ID: 700267631H1
ctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgag

SEQ ID NO: 1474 - DNA, 331 bp, Zea mays
  Clone ID: 700106452H1
tcgacgcgtggcgcgacgcgtgggccctcaaggactccaagacgcttctcttcggcgagaagccggtcaccgtctttggcatcaggactcccgaggagaccccgtggggtgaggctggtggtgagtatgtcgtggagtccaccggtgtcttcactgacaaggacaaggctgctgcacatctgaagggtggtgccaagaaggttgttatctctgtcccaagcaaagatgcacccatgtttgttgttggtgtcaatgaggacaagtacacctccgatgttaacattgtttccaatgctagctgcaccacaaactgccttgctccccttgctaa

SEQ ID NO: 1475 - DNA, 301 bp, Zea mays
  Clone ID: 700349721H1
ggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaa

SEQ ID NO: 1476 - DNA, 302 bp, Zea mays
  unsure (1)...(302): unsure at all n locations
  Clone ID: 700084191H1
cggtattgttgagggtctgatgaccactgttcatgccatcactgctacccagaagactgttgatgggccctcatctaaggactggnggggtggaagggctgctagtttcaacatcattcccagcagcactggagctgctaaggctgttggcaaagtgcttcctgtcctcaatggaaagttgactggaatgtctttccgtgtcccaactgtcgatgtttctgttgttgatctgactgttaggcttgagaagtctgccacctatgatgagatcaaggctgcggtcaaggccgaggcagagggta

SEQ ID NO: 1477 - DNA, 299 bp, Zea mays
  Clone ID: 700265560H1
gccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgtggaagaggatctggtttctaccgacttccttggtgacagcaggtcgagcatcttcgacgccaaggccgggat

SEQ ID NO: 1478 - DNA, 299 bp, Zea mays
  Clone ID: 700083729H1
attgtttccaatgctagctgcaccacaaactgccttgctccccttgctaaggtcattcatgacaacttcggcattgttgagggtttgatgacaactgttcatgccatcactgccacacagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacct

SEQ ID NO: 1479 - DNA, 318 bp, Zea mays
  Clone ID: 700074701H1
ctcgagaactccatttcgatcccatttgaaatcaacccatcctcgtttcctccgtctagcagcctctcaccctcatggccaagatcaagatcgggatcaatgggtttggcacgatcggaacgctggtgggcagggtggtcctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgca

SEQ ID NO: 1480 - DNA, 325 bp, Zea mays
  Clone ID: 700620211H1
gctcccatatccgctcccctacctctccagcatcctcccgtctccgtcgtctcgtctccgctcctcacctcgccatacatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaaccggtcaccgtctttggcatcaggaa

SEQ ID NO: 1481 - DNA, 303 bp, Zea mays
  Clone ID: 700026713H1
gctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttg

SEQ ID NO: 1482 - DNA, 306 bp, Zea mays
  unsure (1)...(306): unsure at all n locations
  Clone ID: 700102767H1
gtctgacatcaacattgtctctaatgctagctgcacaaccaactgccttgctccgcttgctaaggtcatcaatgacaagttcggtattgttganggtctgatgaccactgttcatgccatcactgctacccagaagactgttgatgggccctcatctaaggactggaggggtggaagggctgctagtttcaacatcattcccagcagcactggagctgctaaggctgttggcaaagtgcttcctgtcctcaaatggaaagttgactggaatgtctntccgtgtcccaactgtcgatgtttctgttg

SEQ ID NO: 1483 - DNA, 308 bp, Zea mays
  Clone ID: 700048868H1
ctcgagaactccatttcgatctcatttgaactcaacccatcctcgtttcctccgtctagcagcctctcaccctcatggccaagatcaagatcgggatcaatgggtttggcaggatcggcaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtg

SEQ ID NO: 1484 - DNA, 307 bp, Zea mays
  Clone ID: 700211328H1
ctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagcggtcaccgtctttggcatcaggaaccccgaggagatc

SEQ ID NO: 1485 - DNA, 296 bp, Zea mays
  Clone ID: 700348453H1
cgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactcaaagacccttctcttcggtgacaagccggtcaacgtctttgg

SEQ ID NO: 1486 - DNA, 334 bp, Zea mays
  unsure (1)...(334): unsure at all n locations
  Clone ID: 700622770H1
agcaaagatgcgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgantgaaggcaagctcatggcagtcttccggttcccacgt

SEQ ID NO: 1487 - DNA, 313 bp, Zea mays
  Clone ID: 700213013H1
cactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgttt

SEQ ID NO: 1488 - DNA, 296 bp, Zea mays
  Clone ID: 700093628H1
gctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcacc

SEQ ID NO: 1489 - DNA, 338 bp, Zea mays
  unsure (1)...(338): unsure at all n locations
  Clone ID: 700201306H1
ctcgtttcaaatccatccatcctcgtttcctccgtcncgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctga

SEQ ID NO: 1490 - DNA, 296 bp, Zea mays
  Clone ID: 700083087H1
cgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttgg

SEQ ID NO: 1491 - DNA, 298 bp, Zea mays
  Clone ID: 700085692H1
tccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgt

SEQ ID NO: 1492 - DNA, 292 bp, Zea mays
  Clone ID: 700263282H1
aagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagacgcacccatgtttgttgttggtgtcaatgaggacaagtacacctcggatgttaacattgtttccaatgctagctgcaccacaaactgccttgctccccttgcta

SEQ ID NO: 1493 - DNA, 301 bp, Zea mays
  Clone ID: 700049783H1
cgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttg

SEQ ID NO: 1494 - DNA, 303 bp, Zea mays
  Clone ID: 700446715H1
gaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcac

SEQ ID NO: 1495 - DNA, 305 bp, Zea mays
  Clone ID: 700077235H1
agatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgag

SEQ ID NO: 1496 - DNA, 291 bp, Zea mays
  Clone ID: 700028530H1
ctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcagga

SEQ ID NO: 1497 - DNA, 297 bp, Zea mays
  Clone ID: 700048175H1
gttcatgccatcactgctacccagaagactgttgatgggccctcatctaaggactggtggggtggaagggctgctagtttcaacatcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggttat

SEQ ID NO: 1498 - DNA, 296 bp, Zea mays
  Clone ID: 700343356H1
ctgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctcc

SEQ ID NO: 1499 - DNA, 293 bp, Zea mays
  Clone ID: 700073041H1
gcaaggatgcccccatgttcgttgttggtgtcaacgagaaggagtacaagtctgacatcaacattgtctctaatgctagctgcacaaccaactgccttgctccgcttgctaaggtcatcaatgacaagttcggtattgttgagggtctgatgaccactgttcatgccatcactgctacccagaagactgttgatgggccctcatctaaggactggaggggtggaagggctgctagtttcaacatcattcccagcagcactggagctgctaaggctgttggcaaagtgcttcct

SEQ ID NO: 1500 - DNA, 295 bp, Zea mays
  Clone ID: 700092544H1
actcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgaga

SEQ ID NO: 1501 - DNA, 301 bp, Zea mays
  Clone ID: 700086852H1
cacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaa

SEQ ID NO: 1502 - DNA, 313 bp, Zea mays
  Clone ID: 700357153H1
aaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgagaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgcta

SEQ ID NO: 1503 - DNA, 329 bp, Zea mays
  Clone ID: 700576167H1
gagaagggggcctcttacgaggtgatcaagaaagctattaaggctgcttctgagggcccactcaagggtattatgggctacgtcgatgaggatctggtttccatcgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatatctgcctccctatcgtgggtcgtcaccaatggcctctggtgcagacatctgtgctgc

SEQ ID NO: 1504 - DNA, 300 bp, Zea mays
  Clone ID: 700262594H1
cgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatc

SEQ ID NO: 1505 - DNA, 290 bp, Zea mays
  Clone ID: 700553438H1
ggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctc

SEQ ID NO: 1506 - DNA, 290 bp, Zea mays
  Clone ID: 700053639H1
ctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgagg

SEQ ID NO: 1507 - DNA, 292 bp, Zea mays
  Clone ID: 700093171H1
cgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactgccttgctccccttgctaaggtcattcatgacaac

SEQ ID NO: 1508 - DNA, 299 bp, Zea mays
  Clone ID: 700257051H1
cgcctctcgagtctcgtccacccgtcgtcctcctagctcctctactcgccagtcgccatgggcaagcttaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcat

SEQ ID NO: 1509 - DNA, 303 bp, Zea mays
  Clone ID: 700106505H1
cccacgcgtccggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctg

SEQ ID NO: 1510 - DNA, 295 bp, Zea mays
  unsure (1)...(295): unsure at all n locations
  Clone ID: 700104544H1
tgcacaaccaactgccttgctccgcttgctaaggtcatcaatgacaagttcggtattgttganggtctgatgaccactgttcatgccatcactgctacccagaagactgttgatgggccctcatctaaggactggnggggtggaagggctgctagtttcaacatcattcccagcagcactggagctgctaaggctgttggcaaagtgcttcctgtcctcaatggaaagttgactggaatgtctttccgtgtcccaactgtcgatgtttctgttgttgatctgactgttaggcttg

SEQ ID NO: 1511 - DNA, 291 bp, Zea mays
  Clone ID: 700072406H2
atgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaag

SEQ ID NO: 1512 - DNA, 298 bp, Zea mays
  Clone ID: 700048728H1
gggcgctcatctaaggactggttgggtggaagggctgctagtttcaacatcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggttatgtcgaggaggaccttgtttccaccgatttccagggtg

SEQ ID NO: 1513 - DNA, 293 bp, Zea mays
  Clone ID: 700076367H1
ctgacaaggacaaggctgctgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagg

SEQ ID NO: 1514 - DNA, 313 bp, Zea mays
  Clone ID: 700381774H1
gctgcctccgcctctcgagtctcgtcgacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgctcaagtacgacaccgtccacggccactggaagcacagcgacatcacactcaaggactccaagacgcttctcttcggtgacaagccggtcaccgtctttggcatcaggaa

SEQ ID NO: 1515 - DNA, 297 bp, Zea mays
  Clone ID: 700347358H1
ggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggac

SEQ ID NO: 1516 - DNA, 296 bp, Zea mays
  Clone ID: 700049511H1
ctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttctcctgaattgaatggcaagctcactggcatgtccttccgggttcccaccgtggatgtgtcagttgttgacctcactgtcagaatcga

SEQ ID NO: 1517 - DNA, 301 bp, Zea mays
  unsure (1)...(301): unsure at all n locations
  Clone ID: 700075705H1
tcaatgaggacaagtacacctcggatgttaacattgtttccaatgctagctgcaccacaaactgccttgctccccttgctaaggatcattcatgacaacttcggcattgttgagggtttgatgacaactgttcatgccatcactgccacacagaaaactgttgacggaccctcagccaaggactggagaagtggcagggctgccagctttaacatcattcctagcagcaccggtgctgccaangctgttggtaaagttcttcctgatctgaatggcaagctcactggtatgtccttccgtg

SEQ ID NO: 1518 - DNA, 302 bp, Zea mays
  Clone ID: 700047687H1
ccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgagaggtggtgccaagaaggttgttatctctgccccaagcaaagatgcgcccatgtttgttgttggtgtcaatgaggacaagtacacctccgatgttaacattgtttccaatgctagctgca

SEQ ID NO: 1519 - DNA, 326 bp, Zea mays
  Clone ID: 700206516H1
cttgtttccaccgatttccagggtgacagcaggtctagcatctttgatggaaggctggcattgccttgaacggcaactttgtgaagcttgtgtcctggtacgacaacgagtggggatacagcacccgagtggtcgacctgatccgccacatgaacagcaccaagtaaatgaacaaactgatgaaagcatgcaaagagtgatgaaagcatgcaaagagagttgtgtttcttccccggaagtgcttccgagaataaatttttcttatctgattgtctaaaacctataattggtgtaatggtatcgtagtggttggttgagcatgagtg

SEQ ID NO: 1520 - DNA, 318 bp, Zea mays
  Clone ID: 700210478H1
ctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagcggtcaacgtctttggcat

SEQ ID NO: 1521 - DNA, 302 bp, Zea mays
  Clone ID: 700087443H1
gtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgagg

SEQ ID NO: 1522 - DNA, 301 bp, Zea mays
  Clone ID: 700103213H1
agctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaag

SEQ ID NO: 1523 - DNA, 309 bp, Zea mays
  Clone ID: 700071776H1
cggacgcgtgggctctgaacgaccacttcgtcaagctcgtctcgtggtacgacaacgagtggggctacagcaaccgcgtcgtcgacctgatccgccacatgttcaagacccagtaggggtttttcccccctgcttctcatggatggttgctgcttgtgtatgccgagaataaatgtggatggcgcgtgcctctgggtcgccaggttcatgctgagtctggacatgttttgcacttttgtttcccttcctgctaccatctgtgacagatccgctcgctaatatgggacctgagattagctttttgcaaaa

SEQ ID NO: 1524 - DNA, 292 bp, Zea mays
  Clone ID: 700073331H1
ctccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgatgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactgccttgctcccctt

SEQ ID NO: 1525 - DNA, 316 bp, Zea mays
  Clone ID: 700212530H1
gatcaaggtccgggacgcgtggcagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgacca

SEQ ID NO: 1526 - DNA, 288 bp, Zea mays
  Clone ID: 700346220H1
tcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagt

SEQ ID NO: 1527 - DNA, 307 bp, Zea mays
  Clone ID: 700346201H1
cgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaacc

SEQ ID NO: 1528 - DNA, 294 bp, Zea mays
  Clone ID: 700434507H1
ccgacttccttggtgacagcaggtcgagcatcttcgacgccaaggccgggatcgctctgaacgaccacttcgtcaagcttgtctcgtggtacgacaacgagtggggctacagcaaccgcgtcgtcgacctgatccgccacatgttcaagacccagtagagggttttccccctgcttctcatggatggttgctgcttgtgtatgccgagaataaatgtggatgtcgccaggttcatgctgagtctggacatgttttgcacttttgtttccatttctgccatcatctgtggcagat

SEQ ID NO: 1529 - DNA, 292 bp, Zea mays
  Clone ID: 700077047H1
cccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcggcctcaaggactccaagacgcttctcttcggcg

SEQ ID NO: 1530 - DNA, 285 bp, Zea mays
  Clone ID: 700028536H1
ctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggca

SEQ ID NO: 1531 - DNA, 299 bp, Zea mays
  Clone ID: 700096704H1
cagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgag

SEQ ID NO: 1532 - DNA, 288 bp, Zea mays
  Clone ID: 700263591H1
gtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagta

SEQ ID NO: 1533 - DNA, 287 bp, Zea mays
  Clone ID: 700219528H1
agtacacctcggatgttaacattgtttccaatgctagctgcaccacaaactgccttgctccccttgctaaggtcattcatgacaacttcggcattgttgagggtttgatgacaactgttcatgccatcactgccacccagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgt

SEQ ID NO: 1534 - DNA, 288 bp, Zea mays
  Clone ID: 700094978H1
tgacaacttcggcattgttgagggtttgatgacaactgttcatgccatcactgccacccagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagc

SEQ ID NO: 1535 - DNA, 290 bp, Zea mays
  Clone ID: 700549520H1
agacgcacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgacaactgttcatgccatcactgccacccagaaaactgttgacggaccctcagccaaggactggagaggtggcagggctgccagctttaacatcattcctagcagcaccggtgctgccaaggctgttggtaaagttcttcctg

SEQ ID NO: 1536 - DNA, 289 bp, Zea mays
  Clone ID: 700082071H1
ggctgctagtttcaacatcattcccagcagcactggagctgctaaggctgttggcaaagtgcttcctgtcctcaatggaaagctgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggttatgtcgaggaggaccttgtttccaccgatttccagggtgacagcaggtctagcatctttgat

SEQ ID NO: 1537 - DNA, 321 bp, Zea mays
  Clone ID: 700092419H1
gctctcgtttcacatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccg

SEQ ID NO: 1538 - DNA, 299 bp, Zea mays; identical to SEQ ID NO: 1531
  Clone ID: 700347660H1

SEQ ID NO: 1539 - DNA, 317 bp, Zea mays
  Clone ID: 700100257H1
cccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggc

SEQ ID NO: 1540 - DNA, 292 bp, Zea mays
  Clone ID: 700381813H1
gtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcag

SEQ ID NO: 1541 - DNA, 285 bp, Zea mays
  Clone ID: 700095790H1
gccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttcctt

SEQ ID NO: 1542 - DNA, 289 bp, Zea mays
  Clone ID: 700342267H1
catcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggttatgtcgaggaggaccttgtttccaccgatttccagggtgacagcaggtctagcatctttgatgcgaaggctggcatt

SEQ ID NO: 1543 - DNA, 283 bp, Zea mays
  Clone ID: 700349135H1
cagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacacctccgatgttaacattgtttccaatgct

SEQ ID NO: 1544 - DNA, 301 bp, Zea mays
  Clone ID: 700344742H1
gtctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagca

SEQ ID NO: 1545 - DNA, 301 bp, Zea mays
  unsure (1)...(301): unsure at all n locations
  Clone ID: 700027120H1
ccctcatctaaggactggagncgtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgaaaagtcagcaacctatgatgagatcaaggctgcggtcaaggccgaggcagaaggtagcctcaagggcatcctgggttacgttgaggaggaccttgtttccaccgatttccagggtgacagca

SEQ ID NO: 1546 - DNA, 299 bp, Zea mays
  Clone ID: 700029549H1
tggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagc

SEQ ID NO: 1547 - DNA, 303 bp, Zea mays
  Clone ID: 700051917H1
ccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatggtgttgagtctactggtg

SEQ ID NO: 1548 - DNA, 280 bp, Zea mays
  Clone ID: 700053569H1
agcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagacgcacccatgtttgttgttggtgtcaatgaggacaagtacacctcggatgttaacattgtttc

SEQ ID NO: 1549 - DNA, 281 bp, Zea mays
  Clone ID: 700105941H1
gcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccg

SEQ ID NO: 1550 - DNA, 283 bp, Zea mays
  Clone ID: 700219201H1
gcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggt

SEQ ID NO: 1551 - DNA, 288 bp, Zea mays
  Clone ID: 700050951H1
ctcgagcgccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcac

SEQ ID NO: 1552 - DNA, 291 bp, Zea mays
  Clone ID: 700258792H1
aagggggcctcctatgaggatatcaagaaagctattaaggctgcttccgagggtccactcaagggtatcatgggttatgtggaagaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtaggggtttttcccccctgcttctcatggatggttg

SEQ ID NO: 1553 - DNA, 290 bp, Zea mays
  Clone ID: 700084946H1
cgcctctcgagtctcgtccacccgtcgtcctcctagctcctctactcgccagtcgccatgggcaagattaagatcggaatcaacggcttcggaaggatcggcaggctcgtggccagggtcgccctccagagccgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagtcggtcaccg

SEQ ID NO: 1554 - DNA, 297 bp, Zea mays
  Clone ID: 700571888H1
gtcgagctcgtcgccgtgaacgaccccttcatcagcaccgactacatgacctacatgttcaagtacgacactgtgcacggacagtggaagcaccatgaagtcaatgtgaaggactccaaaacccttctctttggtgagaaggaggttgctgtgtttggctgcaggaaccctgaggagatcccgtggggttcggttggtgctgaatatgttgttgagtctactggtgttttcactgaccaagagaatgctgcagctcacttgaagggtggtgtcaagaaggttgtcatctctgctcct

SEQ ID NO: 1555 - DNA, 278 bp, Zea mays
  Clone ID: 700029725H1
tgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacg

SEQ ID NO: 1556 - DNA, 279 bp, Zea mays
  Clone ID: 700802139H1
gttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcactagaagggtggtgccaagaaggttgtcatttctgctcctagcaaggatgcccccatgttcgttgttggtgtcaacga

SEQ ID NO: 1557 - DNA, 279 bp, Zea mays
  Clone ID: 700030653H1
gctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcg

SEQ ID NO: 1558 - DNA, 277 bp, Zea mays
  Clone ID: 700217462H1
ctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagc

SEQ ID NO: 1559 - DNA, 287 bp, Zea mays
  Clone ID: 700382314H1
cacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagaccctt

SEQ ID NO: 1560 - DNA, 284 bp, Zea mays
  Clone ID: 700263059H1
atgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttagtggtgt

SEQ ID NO: 1561 - DNA, 294 bp, Zea mays
  Clone ID: 700332495H1
ctcgagccgcacacactcgagaactccatttcgatcccatttgagatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactctaagaccc

SEQ ID NO: 1562 - DNA, 286 bp, Zea mays
  unsure (1)...(286): unsure at all n locations
  Clone ID: 700053881H1
ctcgacaactccatttcgatcccatttgaaatcaacccatcctcgtttcctccgtctagcagcctctcaccctcanggccaagatcaagatcgggatcaangggtttggcaggatcggaaggctggtggccagggtggccctgcanagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttcnctt

SEQ ID NO: 1563 - DNA, 277 bp, Zea mays
  Clone ID: 700216184H1
tcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccgg

SEQ ID NO: 1564 - DNA, 277 bp, Zea mays
  Clone ID: 700442583H1
cacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgacaactgttcatgccatcactgccacacagaaaactgttgacggaccctcagccaaggactggagaggtggcagggctgccagctttaacatcattcctagcagcaccggtgctgccaaggctgttggtaaagt

SEQ ID NO: 1565 - DNA, 293 bp, Zea mays
  Clone ID: 700089492H1
ctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctct

SEQ ID NO: 1566 - DNA, 310 bp, Zea mays
  Clone ID: 700211930H1
accacgcgtccgggaccgtggtcgagaactccatttcgatcccatttgaaatcaacccatcctcgtttcctccgtctagacgcctctcacactcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggg

SEQ ID NO: 1567 - DNA, 270 bp, Zea mays
  Clone ID: 700262445H1
cattcctagcagcaccggtgctgccaaggctgttggtaaagtacttcctgatctgaatggcaagctcactggtatgtccttccgtgatcctactgtggatgtctcggttgttgacctcaccgtcagaatcgagaagggggcctcctatgaggatatcaagaaagctattaaggctgcttccgagggtccactcaagggtatcatgggttatgtggaagaggatctggtttctaccgacttccttggtgacagcaggtcgagcatcttcga

SEQ ID NO: 1568 - DNA, 282 bp, Zea mays
  unsure (1)...(282): unsure at all n locations
  Clone ID: 700074068H1
gtacaagtctgacatcaacattgtctctaatgctagctgcacaaccaactgccttgctccgcttgctaaggtcatcaatgacaagttcggtattgttgagggtctgatgaccactgttcatgccatcactgctacccagaagactgttgatgggccctcatctaaggactggnggggtggaagggctgctagtttcaacatcattcccagcagcactggagctgctaaggctgttggcaaagtgcttcctgtcctcaatggaaaattgactggantgtcttt

SEQ ID NO: 1569 - DNA, 286 bp, Zea mays
  Clone ID: 700444054H1
cgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtatgttgttggtgtcaatgaggacaagtacactccg

SEQ ID NO: 1570 - DNA, 321 bp, Zea mays
  Clone ID: 700207212H1
ctcgcatatccgctcgcctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagcggtcaccgtctttggcatc

SEQ ID NO: 1571 - DNA, 295 bp, Zea mays
  Clone ID: 700349424H1
tctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagccgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgcagtgtttggct

SEQ ID NO: 1572 - DNA, 310 bp, Zea mays
  Clone ID: 700348215H1
atccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaaccggtcaccgtctttgg

SEQ ID NO: 1573 - DNA, 292 bp, Zea mays
  Clone ID: 700345971H1
cgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgaga

SEQ ID NO: 1574 - DNA, 296 bp, Zea mays
  Clone ID: 700048167H1
ctcccatatccgctcccctacctctccagcatcctcccgtctccgtcgtctcgtctccgctcctcacctcgccagccatgggcaagatgcagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgag

SEQ ID NO: 1575 - DNA, 299 bp, Zea mays
  Clone ID: 700081996H1
cagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcagg

SEQ ID NO: 1576 - DNA, 311 bp, Zea mays
  Clone ID: 700104353H1
cagctcccatatccgatcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtca

SEQ ID NO: 1577 - DNA, 284 bp, Zea mays
  Clone ID: 700026169H1
ctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgctt

SEQ ID NO: 1578 - DNA, 285 bp, Zea mays
  Clone ID: 700405492H1
ccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcg

SEQ ID NO: 1579 - DNA, 275 bp, Zea mays
  Clone ID: 700354644H1
ctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttc

SEQ ID NO: 1580 - DNA, 272 bp, Zea mays
  Clone ID: 700442572H1
ggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacacctccgatgttaacattgtttccaatgctagctgca

SEQ ID NO: 1581 - DNA, 274 bp, Zea mays
  Clone ID: 700612003H1
ctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtca

SEQ ID NO: 1582 - DNA, 308 bp, Zea mays
  Clone ID: 700082158H1
gggggaaaaacccctactgggtcttgaacatgtggcgacccagaggcacgcgccatccacatttattctcggcatacacaagcagcaaccatccatgagaagcaggggggaaaaacccctactgggtcttgaacatgtggcggatcaggtcgacgacgcggttgctgtagccccactcgttgtcgtaccacgagacgagcttgacgaagtggtcgttcagagcgatcccggccttggcgtcgaagatgctcgacctgctgtcaccaaggaagtcggtagaaaccagatcctcttccacataacccatg

SEQ ID NO: 1583 - DNA, 280 bp, Zea mays
  Clone ID: 700348605H1
ctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagcggtcaccgtctttggcatcaggaaccccgaggag

SEQ ID NO: 1584 - DNA, 275 bp, Zea mays
  Clone ID: 700045650H1
cgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtga

SEQ ID NO: 1585 - DNA, 280 bp, Zea mays
  unsure (1)...(280): unsure at all n locations
  Clone ID: 700053842H1
gggtctgatgaccactgttcatgccatcactgctacccagaagactgttgatgggccctcatctaaggactggnggggtggaagggctgctagtttcaacatcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgag

SEQ ID NO: 1586 - DNA, 275 bp, Zea mays
  Clone ID: 700083488H1
gactgttgatggaccctcagccaaggactggagaggtggcagggctgccagctttaacatcattcccagcagcaccggtgctgccaaggctgtcggtaaggttcttcctcaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtgg

SEQ ID NO: 1587 - DNA, 288 bp, Zea mays
  Clone ID: 700344378H1
ggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagc

SEQ ID NO: 1588 - DNA, 310 bp, Zea mays
  Clone ID: 700102971H1
atccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttg

SEQ ID NO: 1589 - DNA, 283 bp, Zea mays
  Clone ID: 700347294H1
tgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgcccaaggctgtcggtaaggttcttcctgaattgaatggcaagctcatggc

SEQ ID NO: 1590 - DNA, 282 bp, Zea mays
  Clone ID: 700236512H1
ggctgcggtcaaggccgaggcagagggtagcctcaagggcattctgggttatgtcgaggaggaccttgtttccaccgatttccagggtgacagcaggtctagcatctttgatgcgaaggctggcattgccttgaacggcaactttgtgaagcttgtgtcctggtacgacaacgagtggggatacagcacccgagtggtcgacctgatccgccacatgaacagcaccaagtaaatgaacaaatgatgaaagcatgcaaagagtgatgaaagcatgccaagaga

SEQ ID NO: 1591 - DNA, 282 bp, Zea mays
  Clone ID: 700550622H1
gagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggctccaagacccttctctt

SEQ ID NO: 1592 - DNA, 282 bp, Zea mays
  Clone ID: 700550613H1
tgttgagggtctgatgaccactgttcatgccatcactgctacccagaagactgttgatgggccctcatctaaggactggaggggtggaagggctgctagtttcaacatcattcccagcagcactggagctgctaaggctgttggcaaagtgcttcctgtcctcaatggaaagttgactggaatgtctttccgtgtcccaactgtcgatgtttctgttgttgatctgactgttaggcttgagaagtctgccacctatgatgagatcaggctgcggtcaaggcc

SEQ ID NO: 1593 - DNA, 272 bp, Zea mays
  Clone ID: 700241417H1
aactgccttgctcctcttgctaaggtcatcaatgacaagttcggtatcgttgagggtctgatgaccactgtccatgccatcactgctacccagaagactgttgatgggccctcatctaaggactggtggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgattt

SEQ ID NO: 1594 - DNA, 300 bp, Zea mays
  Clone ID: 700050635H1
cctacctctccagcgtcctcccgtctccgtcgtctcgtctccgctcctcacatcgccatccatgggcaatatcaagatgcggaatcaacggtttctgaaggatcggcaggctcgtggccagggtcgccctgcatagcgaggatgtcgagctcgtcggcgtcaacgaccccttcatcgccacggattacgtgacgtacatgttcaagtacgacaccgtgcacgcgccaatggtagcacagcgacatcgccctcaaggactccaagacgcttctcttcggcgataagccggtcaccgtcttt

SEQ ID NO: 1595 - DNA, 271 bp, Zea mays
  Clone ID: 700045260H1
cctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctc

SEQ ID NO: 1596 - DNA, 285 bp, Zea mays
  Clone ID: 700343844H1
cagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgc

SEQ ID NO: 1597 - DNA, 276 bp, Zea mays
  Clone ID: 700347975H1
atctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtca

SEQ ID NO: 1598 - DNA, 279 bp, Zea mays
  Clone ID: 700345348H1
cacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactcca

SEQ ID NO: 1599 - DNA, 277 bp, Zea mays
  unsure (1)...(277): unsure at all n locations
  Clone ID: 700345878H1
actgacaaggacaaggctgctgcacatctcaagggtggtgccaagaaggttgttatctctgccccaagcaaagacgcacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgacaactgttcatgccatcactgccacccagaaaactgttganggaccctcagccaagg

SEQ ID NO: 1600 - DNA, 274 bp, Zea mays
  Clone ID: 700469928H1
cttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactgccttgctccc

SEQ ID NO: 1601 - DNA, 296 bp, Zea mays
  Clone ID: 700093631H1
cggacgcgtgggctgctacccagaagactgttgatgggccctcatctaaggactggaggggtggaagggctgctagtttcaacatcattcccagcagcactggagctgctaaggctgttggcaaagtgcttcctgtcctcaatggaaagttgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggttat

SEQ ID NO: 1602 - DNA, 279 bp, Zea mays
  Clone ID: 700427662H1
aattgattcttttaataaccactcaatttatttctaaaccaatgtctgaaggtaataagcactccttgttggattaatcgccactaccacatgttcagtgtctatgtttggtaatgcttgctgttgattacagggctgcttccgagggtccactcaagggtatcatgggttatgtggaggaggatctggtttctaccgacttccttggtgacagcaggtcgagcatcttcgacgccaaggccgggatcgctctgaacgaccacttcgtcaagcttgtct

SEQ ID NO: 1603 - DNA, 305 bp, Zea mays
  Clone ID: 700099528H1
cagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaagactccaagacgcttctcttcggcgagaagc

SEQ ID NO: 1604 - DNA, 281 bp, Zea mays
  Clone ID: 700347950H1
acacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaaga

SEQ ID NO: 1605 - DNA, 295 bp, Zea mays
  Clone ID: 700267976H1
gcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagcggtcaccgtctttggcatcagga

SEQ ID NO: 1606 - DNA, 284 bp, Zea mays
  Clone ID: 700224847H1
cgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggt

SEQ ID NO: 1607 - DNA, 280 bp, Zea mays
  unsure (1)...(280): unsure at all n locations
  Clone ID: 700465854H1
ggctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctccgnctgctaaggtcatcaatgacaagttcggtattgttgagggtctgatgaccactgttcatgccatcactgctacccagaagactgttgatgggccctcatctaagactggaggggtggaaggg

SEQ ID NO: 1608 - DNA, 305 bp, Zea mays
  Clone ID: 700257309H1
ctcagctcccatatccgctcccctacctctccagcatcctcccgtctccgtcgtctcgtctccgctcctcacctcgccagccatgggcaagatcaagatcggaatcaacggtttcggaaggatcggcaggctcgtagccagggtcgccctgcagagcgaggatgtcgagctcgtcgccgtcaactgacccttcatcaccacggattacatgacgtacatgttcaagtacgacaccgtgcacggccaatggaagcacagcgacatcgccctcaaggactacaagacgcttctcttcggcgagaagc

SEQ ID NO: 1609 - DNA, 271 bp, Zea mays
  unsure (1)...(271): unsure at all n locations
  Clone ID: 700577862H1
cacaaactgccttgctccccttgctanggtcattcatgacaacttcggnattgttgagggtttgatgacaactgttcatgccatcactgccacacagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgtt

SEQ ID NO: 1610 - DNA, 279 bp, Zea mays
  Clone ID: 700550007H1
cacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactc

SEQ ID NO: 1611 - DNA, 272 bp, Zea mays
  Clone ID: 700573448H2
gctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgtgggtcgtccccaatggcctttggtcg

SEQ ID NO: 1612 - DNA, 269 bp, Zea mays
  Clone ID: 700217477H1
gttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcc

SEQ ID NO: 1613 - DNA, 314 bp, Zea mays
  Clone ID: 700381851H1
ctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtaaacgaccccttcatcaccacggattacatgacgtacatgttcaattacgacaccgtacagggccaatggacgcacagcgatatcgctctaaaggactccaagacgcttctcttcggcgagaagccggtcaccgtctttggcatcaggaaccccgaggagatcccgtggggt

SEQ ID NO: 1614 - DNA, 289 bp, Zea mays
  Clone ID: 700095091H1
atccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcg

SEQ ID NO: 1615 - DNA, 295 bp, Zea mays
  Clone ID: 700444008H1
ctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcga

SEQ ID NO: 1616 - DNA, 280 bp, Zea mays
  unsure (1)...(280): unsure at all n locations
  Clone ID: 700470785H1
gacaactgttcatgccatcactgccacccagaaaactgttgacggacccnccagccaaggactggagaggtggcagggctgccagctttaacatcattcctagcagcaccggtgctgccaaggctgttggtaaagttcttcctgatctgnatggcaagctcactggtatgtccttccgtgttcctactgtggatgtctcggttgttgacctcaccgtcagaatcgagaagggggcctcctatgaggatatcaagaaagctattaaggctgcttccgaggg

SEQ ID NO: 1617 - DNA, 283 bp, Zea mays
  Clone ID: 700551739H1
acggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgt

SEQ ID NO: 1618 - DNA, 271 bp, Zea mays
  Clone ID: 700237938H1
ctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcag

SEQ ID NO: 1619 - DNA, 286 bp, Zea mays
  Clone ID: 700215507H1
gatccgctgcctccgcctctcgagtctcgtccacccgtcatcctcctagctcctctactacccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagatcttctcttcggga

SEQ ID NO: 1620 - DNA, 279 bp, Zea mays
  Clone ID: 700350778H1
ggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgct

SEQ ID NO: 1621 - DNA, 277 bp, Zea mays
  unsure (1)...(277): unsure at all n locations
  Clone ID: 700029783H1
tgacaacttcggcattgttgagggtctgatgacaactgttcatgccatcactgccacccagaaaactgttgacggaccctcagccaaggactggagaggtggcagggctgccagctttaacatcattccgagcagcaccggtgctgccaaggctgttggtaaagttctccctgatctgaatggcaagctcactggtatgtccttccgcgttcctactgtggatgtctcggttgttgacctcaccgtcagaatcgagaagggggcctcctatgaggna

SEQ ID NO: 1622 - DNA, 266 bp, Zea mays
  Clone ID: 701161421H1
attgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaa

SEQ ID NO: 1623 - DNA, 268 bp, Zea mays
  Clone ID: 700209510H1
cgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtga

SEQ ID NO: 1624 - DNA, 272 bp, Zea mays
  Clone ID: 700552375H1
ttcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaaggggctctta

SEQ ID NO: 1625 - DNA, 272 bp, Zea mays
  Clone ID: 701183327H1
attgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcctatgaggaaattaagaaagc

SEQ ID NO: 1626 - DNA, 266 bp, Zea mays
  Clone ID: 700611372H1
ggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgcta

SEQ ID NO: 1627 - DNA, 278 bp, Zea mays
  Clone ID: 700243589H1
ctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaag

SEQ ID NO: 1628 - DNA, 283 bp, Zea mays
  Clone ID: 700805727H1
ttcggctcgatctcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactcc

SEQ ID NO: 1629 - DNA, 277 bp, Zea mays
  Clone ID: 700051631H1
cgacaccgtgcacggccaatggaagcacagcgacatcgccctcaaggactccaagacgcttctcttcggcgagaacccggtcaccgtctttggcatcaggaaccccgaggagatcccgtggggtgaggctggtgctgagtatgtcgtggagtccaccggtgtcttcactgacaaggacaaggctgctgcacatctgacgggtggtgccaagacggttgttatctctgctccaagcaaagatgcgcccatgtttgttgttggtgtcaatgaggacaag

SEQ ID NO: 1630 - DNA, 290 bp, Zea mays
  unsure (1)...(290): unsure at all n locations
  Clone ID: 700465454H1
gctgcagctcacttgaagggtggtgccaagaaggttgtcatttctgctcctagcaaggatgcccccatgttcgttgttggtgtcaacgagaaggagtacaagtctgacatcaacattgtctctaatgctagctgcacaaccaactgccttgctccgtgatgctaaggtcatcaatgacaagttcggtattgttgagggtctgatgaccactgttcatgccatcactgctacccagaagactgttgatgggccctcatctaaggactggaggggtggagngctgctagttt

SEQ ID NO: 1631 - DNA, 296 bp, Zea mays
  Clone ID: 700348239H1
acacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctacgcgccgtgaacgaccccttcatcagcaccgattacatgacctacatgttcaagtatgacactgtgcacggacagtggaagcaccatgaggtcaaggtgaaggactccaagacgcttctctttggtg

SEQ ID NO: 1632 - DNA, 291 bp, Zea mays
  Clone ID: 700353680H1
cacagatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggcctccaaga

SEQ ID NO: 1633 - DNA, 286 bp, Zea mays
  Clone ID: 700265106H1
gcaggtctagcatctttgatggaagggctggcattgccttgaacggcaactttgtgaagcttgtgtcctggtacgacaacgagtggggatacagcacccgagtggtcgacctgatccgccacatgaacagcaccaagtaaatgaacaaactgatgaaagcatgcaaagagtgatgaaagcatgcaaagagagttgtgtttcttccccggaagtgcttccgagaataaatttttcttatctgattgtctaaaacctataattggtgtaatggtatcgtagtggttgg

SEQ ID NO: 1634 - DNA, 266 bp, Zea mays
  Clone ID: 700053220H1
ctgctacccagaagactgttgatgggccctcgtctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgagaagtcagcaacctatgatgagatcaaggctgcggtcaaggccgaggcagaaggtagcctc

SEQ ID NO: 1635 - DNA, 267 bp, Zea mays
  Clone ID: 700052903H1
tgccaagaaggttgttatctctgccccaagcaaagatgcgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagacgtggcagggctgccagctt

SEQ ID NO: 1636 - DNA, 274 bp, Zea mays
  unsure (1)...(274): unsure at all n locations
  Clone ID: 700053069H1
caactgccttgctccgcttgctaaggtcatcaatgacaagttcggtattgtnganggtctggtgaccactgttcatgccatcactgctacccagaagactgttgatgggccctcatctaaggactggaggggtggaagggctgctagtntcaacatcattcccagcagcactggagctgctaaggctgttggcaaagtgcttcctgtcctcaatggaaaattgactggaatgtctttccgtgtcccaactgtcgatgtttctgtngttgatctg

SEQ ID NO: 1637 - DNA, 298 bp, Zea mays
  Clone ID: 700352222H1
ctcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactcaaacacccttctctgtggtgagagggg

SEQ ID NO: 1638 - DNA, 266 bp, Zea mays
  unsure (1)...(266): unsure at all n locations
  Clone ID: 700458334H1
caacgagaaggagtacaagtctgacatcaacattgtctctaatgctagctgcacaaccaactgccttgctccgcttgctaaggtcatcaatgacaagttcggtattgttgagggtntgatgaccactgttcatgccatcactgctacccagaagactgttgatgggccctcatctaaggactggaggggtggaagggctgctagtttcaacatcattcccagcagcactggagctgctaaggctgttggcaaagtgcttcctgtcc

SEQ ID NO: 1639 - DNA, 285 bp, Zea mays
  Clone ID: 700072219H1
ggacgtggcgacgacgtcgagctcgtcgccgtgaacgaccccttcatcagcaccgattacatgacctacatgttcaagtaagtgcctgtgcacggacagtggaagcaccatgaggtcaaagtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggt

SEQ ID NO: 1640 - DNA, 267 bp, Zea mays
  Clone ID: 700082679H1
gctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaaga

SEQ ID NO: 1641 - DNA, 269 bp, Zea mays
  Clone ID: 700219959H1
agaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatc

SEQ ID NO: 1642 - DNA, 277 bp, Zea mays
  Clone ID: 700216192H1
cacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatc

SEQ ID NO: 1643 - DNA, 267 bp, Zea mays
  Clone ID: 700453649H1
ccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaa

SEQ ID NO: 1644 - DNA, 267 bp, Zea mays
  Clone ID: 700611371H1
ggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctag

SEQ ID NO: 1645 - DNA, 294 bp, Zea mays
  unsure (1)...(294): unsure at all n locations
  Clone ID: 700261174H1
ctcccgtctccgtcgtctcgtctctgctcctcacctcgtcgccagccatgggcaagatccagatccgaatcaacgcgttccgaaggatcggcangctcgtgagcagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaacacgcttctcttcggcgagaagccggtcaccgtctttggcatcagga

SEQ ID NO: 1646 - DNA, 301 bp, Zea mays
  Clone ID: 700378143H1
ccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaccgaccccttcatcaccacggattacatgacctacatgttcaagtacgacaccgtgcacggccaatggaagcacagcgacatcaccctcaaggactccaagacgcttctcttcggcgagaagcggtcacgt

SEQ ID NO: 1647 - DNA, 278 bp, Zea mays
  Clone ID: 700345693H1
acacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactcca

SEQ ID NO: 1648 - DNA, 283 bp, Zea mays
  Clone ID: 700075095H1
acacacactcgagaactccatttcgatctcatttgaaatcaacccatcctcgtttcctccgtctagcagcctctcaccctcatggccaagatcaagatcgggatcaatgggtttggcaggatcggaaggctggtggccagggtagccctgcagagcgacgacgtcgagctcgtcgccgtgaacgaccccttcatcagcaccgattacatgacctacatgttcaagtatgacagcctgtgcacggacagtggaagcaccatgaggtcaaggtgaaggactccaa

SEQ ID NO: 1649 - DNA, 292 bp, Zea mays
  unsure (1)...(292): unsure at all n locations
  Clone ID: 700549026H1
aatgaggacaagtacacctccgatgttaacattgnttccaatgctagctgcaccacaaactgccttgctccccttgctaaggtcattcatgacaactttggcattattgagggcttgatgacaactgttcatgccatcactgccacccagaagactactgatggncccncagccaaggactggagaggtggcagggctgccagctttaacatcattcccagcagcaccggtgctgccaaggctgtggtaaggttcttcctgaattgaatggcaagctcatggcagtccttcg

SEQ ID NO: 1650 - DNA, 253 bp, Zea mays
  Clone ID: 700333933H1
cgcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtaca

SEQ ID NO: 1651 - DNA, 269 bp, Zea mays
  unsure (1)...(269): unsure at all n locations
  Clone ID: 700027389H1
ctggatgaccactgttcatgccatcactgctacccagaagactgttgatgggccctcatctaaggactggnggggtggaagggctgctagtttcaacatcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtca

SEQ ID NO: 1652 - DNA, 262 bp, Zea mays
  Clone ID: 700798802H1
atttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaa

SEQ ID NO: 1653 - DNA, 267 bp, Zea mays
  Clone ID: 700045878H1
acccttctcttcggtgacaagccggtcaccgtctttggcatcaggaaccctgaggaaatcccgtggggtgaggctggcgctgagtacgtcgtggagtccaccggcgtcttcactgacaaggacaaggctgctgcacatctcaagggtggtgccaagaaggttgttatctctgccccaagcaaagacgcacccatgtttgttgttggtgtcaatgaggacaagtacacctcggatgttaacattgtttccaatgctagctgcaccaca

SEQ ID NO: 1654 - DNA, 300 bp, Zea mays
  Clone ID: 700087030H1
accccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctg

SEQ ID NO: 1655 - DNA, 264 bp, Zea mays
  Clone ID: 700221038H1
ggacaaggctgctgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagc

SEQ ID NO: 1656 - DNA, 291 bp, Zea mays
  Clone ID: 700333822H1
aaggactggagaggtggcagggctgccagctttaacatcattcgcagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaggaaagctattaaggctgcttctgagggcccactcaagggtattatgggctacgtggatgaggatctagtttccagcgacttcaacggtgacagc

SEQ ID NO: 1657 - DNA, 271 bp, Zea mays
  Clone ID: 700085206H1
cacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaa

SEQ ID NO: 1658 - DNA, 264 bp, Zea mays
  Clone ID: 700161303H1
caagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggt

SEQ ID NO: 1659 - DNA, 277 bp, Zea mays
  Clone ID: 700087502H1
ctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgt

SEQ ID NO: 1660 - DNA, 281 bp, Zea mays
  Clone ID: 700105477H1
cccacgcgtccgcatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgccccca

SEQ ID NO: 1661 - DNA, 262 bp, Zea mays
  Clone ID: 700441823H1
ccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctc

SEQ ID NO: 1662 - DNA, 262 bp, Zea mays
  Clone ID: 700196854H1
accgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcg

SEQ ID NO: 1663 - DNA, 278 bp, Zea mays
  Clone ID: 700457283H1
cctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggac

SEQ ID NO: 1664 - DNA, 280 bp, Zea mays
  Clone ID: 700223356H1
cagatcacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaagg

SEQ ID NO: 1665 - DNA, 275 bp, Zea mays
  Clone ID: 700550323H1
aatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgattgaatggcaag

SEQ ID NO: 1666 - DNA, 297 bp, Zea mays
  Clone ID: 700212296H1
cggacgcgtggctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccgg

SEQ ID NO: 1667 - DNA, 295 bp, Zea mays
  Clone ID: 700073907H1
cggacgcgtggccagcatctcccgtctccgtcgtctcgtctctgctcctcacctcgccgccagccatgggcaagatcaagatcggaatcaaaggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcac

SEQ ID NO: 1668 - DNA, 269 bp, Zea mays
  Clone ID: 700550683H1
agtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgattgaatggcaagctca

SEQ ID NO: 1669 - DNA, 270 bp, Zea mays
  Clone ID: 700041553H1
tgcctttttcccactcaggtcgagcatcttcgacgccaaggccgggatcgctctgaacgaccacttcgtcaagcttgtctcgtggtacgacaacgagtggggctacagcaaccgcgtcgtcgacctgatccgccacatgttcaagacccagtagagggttttccccctgcttctcatggatggttgctgcttgtgtatgccgagaataaatgtggatgtcgccaggttcatgctgagtctggacatgttttgcacttttgtttccatttc

SEQ ID NO: 1670 - DNA, 264 bp, Zea mays
  Clone ID: 700197418H1
tcggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctca

SEQ ID NO: 1671 - DNA, 265 bp, Zea mays
  unsure (1)...(265): unsure at all n locations
  Clone ID: 700083704H1
gttcatgccatcactgccacacagaaaactgttgacggaccctcagccaaggactggagaggtggcanggctgccagctngaacatcattactagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgaggatatcaagaaagctattaaggctgctt

SEQ ID NO: 1672 - DNA, 259 bp, Zea mays
  Clone ID: 700218362H1
ctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgc

SEQ ID NO: 1673 - DNA, 325 bp, Zea mays
  Clone ID: 700082314H1
cggacgcgtgggcggacgcgtggggaacccgtcatcgatctcgtttcaaatccatccatcctcgtttcctccgtcccgcagcatctcaaccccatggccacgatcaagatcgcgatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctg

SEQ ID NO: 1674 - DNA, 264 bp, Zea mays
  Clone ID: 700045668H1
cccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgtgggtcgtccccaatggcctttggtcgcagaca

SEQ ID NO: 1675 - DNA, 260 bp, Zea mays
  Clone ID: 700158619H1
gggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagag

SEQ ID NO: 1676 - DNA, 263 bp, Zea mays
  Clone ID: 700611967H1
cacactcgagaactccatttcgatctcatttgaaatcaacccatcctcgtttcctccgtctagccgcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaa

SEQ ID NO: 1677 - DNA, 264 bp, Zea mays
  Clone ID: 700336112H1
cctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtct

SEQ ID NO: 1678 - DNA, 289 bp, Zea mays
  Clone ID: 700444055H1
ctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctctt

SEQ ID NO: 1679 - DNA, 254 bp, Zea mays
  Clone ID: 700236678H1
attacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgcc

SEQ ID NO: 1680 - DNA, 301 bp, Zea mays
  Clone ID: 700214048H1
gccatgagggtgagaggctgctagacggaggaaacgaggatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaata

SEQ ID NO: 1681 - DNA, 295 bp, Zea mays
  Clone ID: 700351262H1
cgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgttgccgtgaacgaccccttcatcagcaccgactacatgacctacatgttcaagtacgacactgtgcacggacagtggaagcaccatgaagtcaaggtgaaggactccaaaacccttctctttggtgagaaggaggttgct

SEQ ID NO: 1682 - DNA, 287 bp, Zea mays
  Clone ID: 700583372H1
cctcttactaggaaatcaagaaagctattaaggctgcttctgagggcccactcaagggtattatgggctacgtggaggaggatctggtttccaccgacttcaccggccacagcaggtcgagcatcttcgacgccaaggccgggattgccctgaacgaccacttcatcaatctcgtctcttggtacgacaacgagtggggctacagcaaccgcgtcgtcgacctgatccgccacatgttcaagacccagtagggagagatatttctgcctccctatcgtgggtcgtcc

SEQ ID NO: 1683 - DNA, 301 bp, Zea mays
  Clone ID: 700339709H1
ggaggatctggtttctaccgacttccttggtgacagcaggtcgagcatcttcgacgccaaggccgggatcgctctgaacgaccacttcgtcaagctcgtctcgtggtacgacaacgagtggggctagagcaaccgtgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgttttgcacttttgct

SEQ ID NO: 1684 - DNA, 307 bp, Zea mays
  Clone ID: 700211842H1
gcgagcgtggcgcgacgcgtggggcacaagcagcaaaaagctaatctcaggtcccatattagcgagcggtactgtcacagatactagcaggaacggaagcaaaagtgcaaaacatgtccagactcagcatgaacctggcgacccagaggcacgcgccatccacatttattctcggcatacacaagcagcaaccatccatgagaagcagggggaaaaaacccctctactggcgtttgaacatgtggcggatcaggtcgacgacgcggttgctgtagccccactcgttgtcgtaccacgagacgagctt

SEQ ID NO: 1685 - DNA, 287 bp, Zea mays
  unsure (1)...(287): unsure at all n locations
  Clone ID: 700355436H1
caaggctgctgcacatctgaagggtggtgccaagaaggttgtnatctctgccccaagcaaagatgcacccatgtttgttgttggtgtcaatgaggacaagtacacctccgatgttaacattgtttccaatgctagctgcaccacaaactgccttgctccccttgctaaggtcattcatgacaactttggcatattgagggctgatgacaactgttcatgccatcactgccacccagaagactgttgatggaccctcagccaaggatggagaggtggcaaggcngcca

SEQ ID NO: 1686 - DNA, 287 bp, Zea mays
  Clone ID: 700221763H1
cggacgcgtggtcggaatcaacggcttcggaaggatcggcaggctcgtggccagggtcgccctccagaacgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggcttgcgctgagtatgtcg

SEQ ID NO: 1687 - DNA, 302 bp, Zea mays
  unsure (1)...(302): unsure at all n locations
  Clone ID: 700619245H1
acgacaacgagtggggctacagcaaccgcgtcgtcgacctgatccgccacatgttcaagacccagtagagagagatatttctgcctccctatcgtgaggtcgtcnccaatggcctttggtcgcagacatctttgctgcttgtctatgctgagaataaatgtgaacggtgcccctggacgctggatccatgctggttttggacacgttgtctttttgtgtttaacttatctgctaccgtcctgtaacgaattcactaagttctagttcttttgtgctttgttaagaataaacaatgaggtttc

SEQ ID NO: 1688 - DNA, 300 bp, Zea mays
  Clone ID: 700262781H1
ctcccatatccgctcccctacctctccagcatcctcccgtcaccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagc

SEQ ID NO: 1689 - DNA, 268 bp, Zea mays
  unsure (1)...(268): unsure at all n locations
  Clone ID: 700243153H1
gacaactgttcatgccatcactgccacacagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcacgtcagaatcgagaagggggcctcctatgaggatatcaagaaagctattaaggcng

SEQ ID NO: 1690 - DNA, 288 bp, Zea mays
  Clone ID: 700344173H1
ctcgagccgactccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaag

SEQ ID NO: 1691 - DNA, 286 bp, Zea mays
  Clone ID: 700349565H1
gctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagcggtc

SEQ ID NO: 1692 - DNA, 258 bp, Zea mays
  Clone ID: 700157320H1
aaccaactgccttgctccgcttgctaaggtcatcaatgacaagttcggtattgttgagggtctgatgaccactgttcatgccatcactgctacccagaagactgttgatgggccctcatctaaggactggaggggtggaagggctgctagtttcaacatcattcccagcagcactggagctgctaaggctgttggcaaagtgcttcctgtcctcaatggaaaattgactggaatgtctttccgtgtcccaactgtcga

SEQ ID NO: 1693 - DNA, 260 bp, Zea mays
  Clone ID: 700611471H1
ggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgtcggtgtcaatgaggacaagtacacctcggatgttaacattgtttcca

SEQ ID NO: 1694 - DNA, 282 bp, Zea mays
  unsure (1)...(282): unsure at all n locations
  Clone ID: 700550503H1
agtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaangctgtcggtaaggttcttcctgaattgatggcaagtcatggcatgtcctccg

SEQ ID NO: 1695 - DNA, 257 bp, Zea mays
  Clone ID: 700222893H1
ctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtca

SEQ ID NO: 1696 - DNA, 266 bp, Zea mays
  Clone ID: 700242404H1
cccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaa

SEQ ID NO: 1697 - DNA, 257 bp, Zea mays
  Clone ID: 700218820H1
cactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctg

SEQ ID NO: 1698 - DNA, 259 bp, Zea mays
  Clone ID: 700220021H1
cgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttct

SEQ ID NO: 1699 - DNA, 259 bp, Zea mays
  Clone ID: 700243542H1
aagatgcccccatgttcgttgttggtgtcaacgagaaggagtacaagtctgacatcaacattgtctctaatgctagctgcacaaccaactgccttgctccgcttgctaaggtcatcaatgacaagttcggtattgttgagggtctgatgaccactgttcatgccatcactgctacccagaagactgttgatgggccctcatctaaggactggaggggtggaagggctgctagtttcaacatcattcccagcagcactgg

SEQ ID NO: 1700 - DNA, 292 bp, Zea mays
  Clone ID: 700354379H1
cagtcgtatcgtatccgctcctcacctcgccatccatgggcaagatcaagatcggaatcaacggtttaggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgcactcaaggactccaagacgcttctcttcggcgagaagccggtcaccgtctttggcatcaggaacccgaggag

SEQ ID NO: 1701 - DNA, 270 bp, Zea mays
  Clone ID: 700799328H1
ctcgagccgttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaga

SEQ ID NO: 1702 - DNA, 259 bp, Zea mays
  Clone ID: 700452454H1
cctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccaa

SEQ ID NO: 1703 - DNA, 260 bp, Zea mays
  Clone ID: 700085246H1
atccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctca

SEQ ID NO: 1704 - DNA, 258 bp, Zea mays
  Clone ID: 700218590H1
gagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctg

SEQ ID NO: 1705 - DNA, 260 bp, Zea mays
  Clone ID: 700456377H1
gtcgtggagtccaccggtgtcttcactgacaaggacaaggctgctgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccat

SEQ ID NO: 1706 - DNA, 285 bp, Zea mays
  Clone ID: 700050750H1
agctcccatatccgctcccctacctctccagcatcctcccgtctccgtcgtctcgtctccgctcctcacctcgccagccatgggcaagatcaagatcggaatcaacggtgagtctgtacccccaacacaaactcgttcttcctgctcggttcgttgggtctggactctggagtgatctgagtggggtccctgggcgctgcgtgctcaggtttcggaaggatcggcaggctcgtggccagggtcgccctgcagagcgaggatgtcgagctcgtcgccgtcaacgac

SEQ ID NO: 1707 - DNA, 269 bp, Zea mays
  Clone ID: 700351952H1
gccctgaacgaccacttcatcaagctcgtctcttggtacgacaacgagtggggctacagcaaccgcgtcgtcgacctgatccgccacatgttcaagacccagtagagagagatatttctgcctccctatcgtgggtcgtccccaatggcctttggtcgcagacatctttgctgcttgtctatgctgagaataaatgtgaacggtgcccctggacgctggatccatgctggttttggacacgttgtctttttgtgttaaacttatctgct

SEQ ID NO: 1708 - DNA, 274 bp, Zea mays
  Clone ID: 700345594H1
aatgacaagttcggtattgttgagggtctgatgaccactgttcatgccatcactgctacccagaagactgttgatgggccctcatctaaggactggaggggtggaagggctgctagtttcaacatcattcccagcagcactggagctgctaaggctgttggcaaagtgctcctgtcctcaatggaaagttgactggaatgtcttccgtgtcccaactgtcgatgtttctgttgttgatctgactgttaggctgagaagtctgccacctatgatg

SEQ ID NO: 1709 - DNA, 317 bp, Zea mays
  Clone ID: 700267853H1
cagctcccatatccgctcccctacctctccagcatctcccgtctccgtcgtctcgtctctgctcctcacatcgccgccagccatgggcaagatcaagatcggaatcaacggtttcggaaggatcggcaggctcgttgccagggatcgcctgcagagcgaggatgtcgagctcgtcgccgtcaacgaccccttcatcaccacggattacatgacctacatgttcaagtacgacaccgtgcacggccaatggaagcacagcgacatcaccctcaaggactacaagacgcttctcttcggcgagaagcggtcaacgtctt

SEQ ID NO: 1710 - DNA, 300 bp, Zea mays
  unsure (1)...(300): unsure at all n locations
  Clone ID: 700350105H1
gttgatctgactgttaggcttgagaagtctgccacctatgatgagatcaaggctgcggtcaaggccgaggcagagggtagcctcaagggcattctgggttatgtcgaggaggaccttgtttccaccgatttccagggtgacagcaggtctagcatctttgatgcgaaggctggcattgccttgaacggcaactttgtgaagctgtgtcctggtacgacaacgagtggggatacagcacccgagtggtcgacctgatccgccacagaacagcaccagtaaatgaacaaangatgaaagcng

SEQ ID NO: 1711 - DNA, 300 bp, Zea mays
  Clone ID: 700334557H1
accgagcacacactcgagaactccatttcgatcccatttgaaatcaacccatcatcgtttcctacgtctagaagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcaaggacagtggaagcaccatgaggtcaaggtgaaggactccaagactcttctctttg

SEQ ID NO: 1712 - DNA, 265 bp, Zea mays
  Clone ID: 700457542H1
cacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaa

SEQ ID NO: 1713 - DNA, 276 bp, Zea mays
  Clone ID: 700352772H1
cgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagactttcttcggtgacaagccggtca

SEQ ID NO: 1714 - DNA, 278 bp, Zea mays
  Clone ID: 700550657H1
actagttctagatccgcatccgctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaag

SEQ ID NO: 1715 - DNA, 257 bp, Zea mays
  Clone ID: 700224772H1
aactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagcta

SEQ ID NO: 1716 - DNA, 267 bp, Zea mays
  Clone ID: 700618874H1
aagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtcctggtacgacaacgagtggggatacagcacccgcgtggtcgacctgatccgccacatgaacagcaccaataagattatgaag

SEQ ID NO: 1717 - DNA, 254 bp, Zea mays
  Clone ID: 700162968H1
ggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgacaactgttcatgccatcactgccacacagaaaactgttgacggaccct

SEQ ID NO: 1718 - DNA, 254 bp, Zea mays
  Clone ID: 700025839H1
ggcttgaaaagtcagcaacctatgatgagatcaaggctgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtcctggtacgacaacgagtggggatacagcacccgcgtggtcgacctgatccgccacatgaac

SEQ ID NO: 1719 - DNA, 310 bp, Zea mays
  Clone ID: 700075210H1
cggaccgtggccgaaccccgtcatcgatctcgtttcaaatccatccatcctcgtttcctccgtcccgcagcatctcaaccccatggccaagatcacagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggt

SEQ ID NO: 1720 - DNA, 264 bp, Zea mays
  Clone ID: 700025602H1
ccacaaactgccttgctccccttgctaaggtcattcatgacaacttcggcattgttgagggtctgatgacaactgttcatgccatcactgccacccagaaaactgttgacggaccctcagccaaggactggagaggtggcagggctgccagctttaacatcattccgagcagcaccggtgctgccaaggctgttggtaaagttctccctgatctgaatggcaagctcactggtatgtccttccgcgttcctactgtggatgtct

SEQ ID NO: 1721 - DNA, 265 bp, Zea mays
  Clone ID: 700573453H2
gctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgtgggtcgtccccaatggcct

SEQ ID NO: 1722 - DNA, 304 bp, Zea mays
  unsure (1)...(304): unsure at all n locations
  Clone ID: 700268153H1
ccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccanaacccttctctttggtgagaaggaggttgctgtgttt

SEQ ID NO: 1723 - DNA, 275 bp, Zea mays
  Clone ID: 700085062H1
cacagatcacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaag

SEQ ID NO: 1724 - DNA, 262 bp, Zea mays
  Clone ID: 700197210H1
atagggtggaagggctgctagtttcaacatcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggttatgtcgaggaggaccttgtttcc

SEQ ID NO: 1725 - DNA, 256 bp, Zea mays
  Clone ID: 700053187H1
cgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactcca

SEQ ID NO: 1726 - DNA, 256 bp, Zea mays
  Clone ID: 700239541H1
attcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggt

SEQ ID NO: 1727 - DNA, 305 bp, Zea mays
  Clone ID: 700381789H1
atcgatctcgtttcaaatccatccatcctcgtttcctccgtcccgcagcatctcaaccccatggccaagatcaagatcgggatccatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcag

SEQ ID NO: 1728 - DNA, 291 bp, Zea mays
  Clone ID: 700382074H1
gtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggtt

SEQ ID NO: 1729 - DNA, 318 bp, Zea mays
  unsure (1)...(318): unsure at all n locations
  Clone ID: 700615886H1
gccctcaaggactccaagatgcttctcttcggcgagaagccggtcaccgtctttggcatcaggnaccccgaggagatcccgtggggtgaggctggtgctgagtatgtcgtggagtccaccggtgtcttcactgacaaggacaaggctgctgcacatctgaagggtgtgccaagaaggttgttatctctgccccaagcaaagatgcgcccatgtttgttgttggtgtcaatgaggacaagtacacctcngatgttnacattntttccaatgtagctgnaccacaactgccttgtccccttgctaaaggtcattcngana

SEQ ID NO: 1730 - DNA, 281 bp, Zea mays
  unsure (1)...(281): unsure at all n locations
  Clone ID: 700203271H1
cccatatccgctcncctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacg

SEQ ID NO: 1731 - DNA, 285 bp, Zea mays
  Clone ID: 700090047H1
cagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagac

SEQ ID NO: 1732 - DNA, 295 bp, Zea mays
  Clone ID: 700345983H1
agctcccatatccgctcccctacctctccagcatctcccgtctccgtggtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcacctctcaggactccaagacgcttctcttcg

SEQ ID NO: 1733 - DNA, 289 bp, Zea mays
  Clone ID: 700580224H1
cttcatcaagctcgtctcttggtacgacaacgagtggggctacagtaaccgcgtcgtcgtcctgatccgccacatgttcaagacccagtagagagagatatttctgcctccctatcgtgggtcgtcaccaatggcctttggtcgcagacatctttgctgcttgtctatgctgagaataaatgtgaacggtgcccctggacgctggatccatgctggttttggacacgttgtctttttgtgtttagacttatctgctaccgtcctgtaacgaattcactaagttctagtt

SEQ ID NO: 1734 - DNA, 252 bp, Zea mays
  Clone ID: 700163304H1
gacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatc

SEQ ID NO: 1735 - DNA, 252 bp, Zea mays
  Clone ID: 700218377H1
gttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggct

SEQ ID NO: 1736 - DNA, 257 bp, Zea mays
  unsure (1)...(257): unsure at all n locations
  Clone ID: 700090628H1
tnacaacttcggcattgttgagggtttgatgacaactgttcatgccatcactgccacccagaaaactgttgacggaccctcagccaaggactggagaggtggcagggctgcnagctttaacatcattcctagcagcaccggtgctgccaaggctgttggtaaagttcttcctgatctgaatggcaagctcactggtatgtccttccgtgttcctactgtggatgtctcggttgttgacctcaccgtcagaatcgaga

SEQ ID NO: 1737 - DNA, 303 bp, Zea mays
  Clone ID: 700205936H1
ccgtcatcgatctcgtttcaaatccatccatcctcgtttcctccgtctcgcagcatctcaaccccatggccaagatcaagatcgggatcaatgggttcggcaggatcggaaggctggtggccatggtggctctgcagagtgacgatgtcgagctcgtcgccgtgaacgaccccttcatcagcaccgactacatgacctacatgttcaagtacgacactgtacacggacagtggaagcaccatgaagtcaatgtgaaggactccaaaacccttctctttggtgagaatgatgttgctgtgtttg

SEQ ID NO: 1738 - DNA, 253 bp, Zea mays
  Clone ID: 700087928H1
atcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcgg

SEQ ID NO: 1739 - DNA, 261 bp, Zea mays
  Clone ID: 700195069H1
caagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaagggctgctat

SEQ ID NO: 1740 - DNA, 273 bp, Zea mays
  Clone ID: 700552795H1
gaaggaggttgctgtgtttggctgcaggaaccctgaggagatcccatggggttcggttggcgctgaagatgttgttgagtctgactggtgttttcactgaccaggagaaggctgcagctcacttgaagggtggtgccaagaggttgtcatttctgctcctagcaaggatgctgccatgttcgttgttggtgtcaacgagaaggagtacaagtctgacatcaagagtgtctctaatgctagctgcacaagcaactgccttgctccgcttgctaa

SEQ ID NO: 1741 - DNA, 299 bp, Zea mays
  Clone ID: 700093666H1
cggaccgtggtcgcccacgcgtccggctgcctccgcctctcgagtctcgtccaaccgtcatcctcctagctcctctactcgccagtcgccatgggcatgattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacgcttct

SEQ ID NO: 1742 - DNA, 262 bp, Zea mays
  Clone ID: 700196963H1
cagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggttatgtcgaggaggaccttgtttccaccgatttccagggtgacagcaggtctagcatcttt

SEQ ID NO: 1743 - DNA, 310 bp, Zea mays
  Clone ID: 700083992H1
agcttgtgtcctggtacgacaacgagtggggatacagcacccgagtggtcgacctgatccgccacatgaacagcaccaagtaaatgaacaaactgatgaaagcatgcaaagagtgatgaaagcatgcaaagagagttgtgtttcttccccggaagtgcttccgagaataaatttttcttatctgattgtctaaaacctataattggtgtaatggtatcgtagtggttggttgagcattgagtgactcatattttgtcaggtctatgtgttatcgttaaacttttaacggtcattctatttcaaaagtttt

SEQ ID NO: 1744 - DNA, 284 bp, Zea mays
  unsure (1)...(284): unsure at all n locations
  Clone ID: 700334351H1
catctttgatgcgaaggctgagcattgccttgaacggcaactttgtgaagcttgtgtcctggtacgacaacgagtggggatacagcacccgagtggtcgacctgatccgccacatgaacagcaccaagtaaatgaacaaactgatgaaagcatgcaaagagtgatgaaagcatgcaaagagagttgtgtttcttccccggaagtgcttccgagaataaatttttcttatctgattgtctanaacctataattggtgtaatggtatcgtagtggttggttgagca

SEQ ID NO: 1745 - DNA, 266 bp, Zea mays
  Clone ID: 700165979H1
ccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttc

SEQ ID NO: 1746 - DNA, 270 bp, Zea mays
  Clone ID: 700612175H1
ctcgaccgagatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcacca

SEQ ID NO: 1747 - DNA, 249 bp, Zea mays
  Clone ID: 700157886H1
agggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtt

SEQ ID NO: 1748 - DNA, 251 bp, Zea mays
  Clone ID: 700218843H1
gctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcaca

SEQ ID NO: 1749 - DNA, 252 bp, Zea mays
  unsure (1)...(252): unsure at all n locations
  Clone ID: 700223241H1
gacaacttcggcattgttgagggtttgatgacaactgttcatgccatcactgccacacagaaaactgttgacggaccctcagccaaggactggagaggtggcagggctgccagctttaacatcattcctagcagcaccggtgctgccaaggctgttggtaaagttcttcctgatcngaatggcaagctcactggtatgtccttccgtgttcctactgtggatgtctcggttgttgacctcaccgtcagaatc

SEQ ID NO: 1750 - DNA, 281 bp, Zea mays
  Clone ID: 700382157H1
cgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaagg

SEQ ID NO: 1751 - DNA, 251 bp, Zea mays
  Clone ID: 700163655H1
gcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgag

SEQ ID NO: 1752 - DNA, 259 bp, Zea mays
  Clone ID: 700219734H1
acacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgag

SEQ ID NO: 1753 - DNA, 293 bp, Zea mays
  unsure (1)...(293): unsure at all n locations
  Clone ID: 700258401H1
gacaagtacacctcggatgttaacattgtttccaatgctagctgcaccacaaactgccttgctccccttgctaaggtcattcatgacnacttcggcattgttgagggttgatgacaactgttcatgccatcactgcnacacagaaaactgttgacggaccctnagcnaaggactggagagntggnagggctgcnagcttnannatcatnccnagnagnaccgntgctgcnaaggctgttggnaaagtccttcctgatctgaatggcaanctcactggaatgncttccgtgtnc

SEQ ID NO: 1754 - DNA, 254 bp, Zea mays
  Clone ID: 700569409H2
ggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtaga

SEQ ID NO: 1755 - DNA, 254 bp, Zea mays
  Clone ID: 700449985H1
ctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaaga

SEQ ID NO: 1756 - DNA, 322 bp, Zea mays
  unsure (1)...(322): unsure at all n locations
  Clone ID: 700209417H1
cggacgctnggggcatcttcgacgccaaggccgggatcgctctgaacgaccacttcgtcaagctcgtctactggtacgacaacgagtggggctacagcaaccgcgtcgtcgacctgatccgccacatgttcaagacccagtaggggtttttcccccctgcttctcatggatggttgctgcntgtntatgccgagaataaatgtggatggcgcgtgcctctgggtcgccaggttcatgctgagtctggacatgttttgcnttntgttnncntcctgctancatctgtnacaatncgtcctaatatgggacctgagatagcttt

SEQ ID NO: 1757 - DNA, 276 bp, Zea mays
  unsure (1)...(276): unsure at all n locations
  Clone ID: 700218233H1
agatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacantggaagcnccntgggnaaggtgaag

SEQ ID NO: 1758 - DNA, 250 bp, Zea mays
  Clone ID: 700023172H1
gacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgt

SEQ ID NO: 1759 - DNA, 275 bp, Zea mays
  Clone ID: 700165002H1
atccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgc

SEQ ID NO: 1760 - DNA, 279 bp, Zea mays
  Clone ID: 700240575H1
cggacgcgtgggcggtttcggaaggatcggcaggctcgtggccagggtcgccctgcagagcgaggatgacgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgt

SEQ ID NO: 1761 - DNA, 254 bp, Zea mays
  Clone ID: 700193127H1
cgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaagggctgctagtttcaacatcattcccagcagcactggagctgctaaggctgttggcaaagtgc

SEQ ID NO: 1762 - DNA, 281 bp, Zea mays
  Clone ID: 700202138H1
cttggtacgacaacgagtggggctacagcaaccgcgtcgtcgacatgatccgccacatgttcaagacccagtagagagagatatttctgcctccctatcgtgggtcgccccaatggccttggtcgagacatctttgctgcttgtctatgctgagaataaatgtgaacggtgcccctggacgctggatccatgctggttttggacacgttgtctttttgtgtttaacttatctgctaccgtcctgtaacgaattcactaagttctagttcttttgtgctttg

SEQ ID NO: 1763 - DNA, 316 bp, Zea mays
  Clone ID: 700619314H1
tcagctcacatatccgctcacctacctctccagcatctcacgtctccgtcgtctcgtctctgctcctcacctcgccgccagccatgggcaagatcaagatcggaatcaacggtttcggaaggatcggcaggctcgtggccagggtcgcactgcagagcgaggatgtcgaactcgtcgccgtcaacgaccccttcatcaccacggattacatgacctacatgttcaagtacgacaccgtgcacggccaatggcagcacagcgacatcaccctcaaggactccaagacgcttctcttcggcgagaagcaggtcacgtc

SEQ ID NO: 1764 - DNA, 262 bp, Zea mays
  Clone ID: 700611272H1
ggactccaagacccttctcttcggtgacaagccggtcaccgtctttggcatcaggaaccctgaggaaatcccgtggggtgaggctggcgctgaatatgtcgtggagtcaccggcgtcttcactgacaaggacaaggctgctgcacatctcaagggtggtgccaagaaggttgttatctctgccccaagtacagatgcacccatgtttgttgttggtgtcaatgaggacaagtacacctcggatgttaacattgtttccaatg

SEQ ID NO: 1765 - DNA, 271 bp, Zea mays
  Clone ID: 700235577H1
ctcagctcccatatccgctcccctacctctccagcatcggcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctc

SEQ ID NO: 1766 - DNA, 289 bp, Zea mays
  Clone ID: 700048739H1
gcccactcaagggtattatgggctacgtggaggaggatctggtttccaccgacttcaccggtgacatcaggtcgagcatcttcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgagggtcgtcccaatggcctttggtcgcagacaactttgctgcttgtcta

SEQ ID NO: 1767 - DNA, 272 bp, Zea mays
  Clone ID: 700337602H1
acgagaagggggcctcctatgaggatatcaagaaagctattaaggctgcttccgagggtccactcaagggtatcatgggttatgcggaggaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgcacatgtccagacccatagagggtttttccc

SEQ ID NO: 1768 - DNA, 260 bp, Zea mays
  Clone ID: 700457423H1
cgcctctcgagtctcgtccacccgtcatcctcctagctcctctactcgccagtcgccatgggcacagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaaga

SEQ ID NO: 1769 - DNA, 307 bp, Zea mays
  unsure (1)...(307): unsure at all n locations
  Clone ID: 700048682H1
cncgtcatcgatctcgtttcaaatccatccatcctcgtttcctccgtcccgcagcatctcaaccccatggccaagatcaagatcgggatcaatgggttcggcaggatcggaaggctggtggccagggtggctctgcagagtgacgatgtcgagctcgtcgccgtgaacgaccccttcatcagcaccgactacatgacctacatgttcaagtacgacactgtacacggacagtggaagcaccatgaagtcaaggtgaaggactccaaaacgcttctctttggtgagaaggaggttgctgtgtatggct

SEQ ID NO: 1770 - DNA, 275 bp, Zea mays
  Clone ID: 700456449H1
catcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttg

SEQ ID NO: 1771 - DNA, 266 bp, Zea mays
  unsure (1)...(266): unsure at all n locations
  Clone ID: 700239518H1
cggacgntggcanttgtttccaatgctagctgcaccacaaactgccttgctccccttgctaaggncattcatgacaactttggcattattgagggcttgatgacaactgttcatgccatcactgccacccagaagactgttgatggaccctcagccaaggactggagaggtggcagggctgccagctttaacatcattcccagcagcaccggtgcngcnaangctgtcggtaacgttcttcctgaattgaatggcaagctcactgg

SEQ ID NO: 1772 - DNA, 260 bp, Zea mays
  Clone ID: 700457982H1
tgacaagccggtcaccgtctttggcatcaggaaccctgaggaaatcccgttgggtgatgctggcgctgagtatgtcgtggagtccaccggcgtcttcactgacaaggacaaggctgctgcacatctcaagggtggtgccaagaaggttgttatctctgccccaagcaaagatgcacccatgtccattgttggtgtcaatgaggacaatacacctcggatgttaacattgtttccaatgctagctgcaccacaaactgcct

SEQ ID NO: 1773 - DNA, 271 bp, Zea mays
  Clone ID: 700103576H1
gacgcgtggagctcccatatccgctcccctacctctccagcatcctcccgtctccgtcgtctcgtctccgctcctcacctcgccagccatgggcaaactcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatc

SEQ ID NO: 1774 - DNA, 277 bp, Zea mays
  Clone ID: 700454265H1
ctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgtaaccttcatcaccacggattacatgacctacatgttcaagtacgacaccgtgcacggccaatggaagcacagcgacatcaccctcaaggactcc

SEQ ID NO: 1775 - DNA, 280 bp, Zea mays
  Clone ID: 700340854H1
gacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgttttgcacttttgcttcccttcctg

SEQ ID NO: 1776 - DNA, 250 bp, Zea mays
  Clone ID: 700458888H1
gtggaaaccagatcctcctccacgtagcccataatacccttgagtgggccctcagaagcagccttaatagctttcttgatttcctcgtaagaggcccccttctcgattctgacagtgaggtcaacaactgacacatccacggtgggaacccggaaggacatgccagtgagcttgccattcaattcaggcagaaccttaccgacagccttggcagcaccggtgctgctgggaatgatgttaaagctggcag

SEQ ID NO: 1777 - DNA, 249 bp, Zea mays
  Clone ID: 700581403H1
atgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtctacctgatccgccacatgttcaagacccagtagagcaagatatttctgcctccctatcgagggtcgtccccgatggcctttggtccagcatca

SEQ ID NO: 1778 - DNA, 260 bp, Zea mays
  Clone ID: 700224722H1
gtcgtcctcctagctcctctactcgccagtcgccatgggcaatattaagatcggaatcaacggcttcggaaggatcggcaggctcgtggccagggtcgccctccagagcgaggatgtcgagctcgtcgccgtcaacgaccccttcatcagcacggactacatgacctatatgttcaagtacgacaccgtccacggccactggaagcacagcgacatcacactcaaggactccaagacccttctcttcggttacaagccgg

SEQ ID NO: 1779 - DNA, 264 bp, Zea mays
  Clone ID: 700217644H1
tccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttct

SEQ ID NO: 1780 - DNA, 249 bp, Zea mays
  Clone ID: 700454195H1
cgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagctcagcgacatcacactcaaggactccaagacccttctcttcg

SEQ ID NO: 1781 - DNA, 280 bp, Zea mays
  unsure (1)...(280): unsure at all n locations
  Clone ID: 700215504H1
gcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggtgctagtttnaacatcattccnagnagcatggagctncnagggtgnngaccc

SEQ ID NO: 1782 - DNA, 262 bp, Zea mays
  Clone ID: 700214190H1
agctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatc

SEQ ID NO: 1783 - DNA, 267 bp, Zea mays
  Clone ID: 700456941H1
caactgttcatgccatcactgccacccagaagactgttgatggactctcagtcaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggctccttacgaggaaatcaagaaagctattaaaggct

SEQ ID NO: 1784 - DNA, 247 bp, Zea mays
  Clone ID: 700193816H1
actggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgcca

SEQ ID NO: 1785 - DNA, 249 bp, Zea mays
  Clone ID: 700241930H1
ggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagt

SEQ ID NO: 1786 - DNA, 248 bp, Zea mays
  Clone ID: 700160162H1
aacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaagggctgctagtttcaacatcattcccagcagcactggagctgctaaggctgttgg

SEQ ID NO: 1787 - DNA, 244 bp, Zea mays
  Clone ID: 700171289H1
agccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcac

SEQ ID NO: 1788 - DNA, 250 bp, Zea mays
  Clone ID: 700549474H1
caagatcgggatcaatgggtttggcaggatcggaaggctggtggccagggtggccctgcagagcgacgacgtcgagctcgtcgccgtgaacgaccccttcatcagcaccgattacatgtggaagcaccatgaggtcaaggtgaaggactccaagacccttctctttggtgagaaggaggttgctgtgtttggctgcaggaaccctgaggagatcccatggggttcggttggcgctgaatatgttgttgag

SEQ ID NO: 1789 - DNA, 276 bp, Zea mays
  Clone ID: 700422573H1
aacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgtgttgcacttttgcttccctt

SEQ ID NO: 1790 - DNA, 271 bp, Zea mays
  Clone ID: 700377664H1
tcggaatcaacggtttcggaaggatcggcaggctcgtggccaggatcgccctgcagagcgaggatgtcgagctcgtcgccgtcaacgaccccttcatcacatgacctacatgttcaagtacgacaccgtgcacggccaatggaagcacagcgacatcaccctcaaggactccaagacgcttctattcggcgagaagccggtaaccgtctttggcatcaggaaccccgaggagatcccgtggggtgaggctggtgctgagtatgtcgtggag

SEQ ID NO: 1791 - DNA, 251 bp, Zea mays
  Clone ID: 700193034H1
caaccgtcgatgtttctgttgttgatttgactgttaggcttgagaagtcagcaacctatgatgagatcaaggctgcggtcaaggccgaggcagaaggtagcctcaagggcatcctgggttacgttgaggaggaccttgtttccaccgatttccagggtgacagcaggtctagcatcttgatgctaaggctggcattgccttgaacggcaacttcgtgaagctcgtgtcctggtacgacaacgagtggggga

SEQ ID NO: 1792 - DNA, 251 bp, Zea mays
  Clone ID: 700163652H1
gcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgagggtcgtccccgatggcctttggtcgcagccatgctttgctgcttgtctatgctgagaataaatgtgaacggtgcccctggacg

SEQ ID NO: 1793 - DNA, 288 bp, Zea mays
  Clone ID: 700212649H1
cggacgcgtggcggacgcgtgggccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagacgcacccatgtttgttgttggtgtcaatgaggacaagtacacctcggatgttaacattgtttccaatgctagctgcaccacaaactgccttgctccccttg

SEQ ID NO: 1794 - DNA, 239 bp, Zea mays
  Clone ID: 700165066H1
ggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtgga

SEQ ID NO: 1795 - DNA, 244 bp, Zea mays
  Clone ID: 700152004H1
ctatgatgagatcaaggctgcggtcaaggccgaggcagagggtagcctcaagggcattctgggttatgtcgaggaggaccttgtttccaccgatttccagggtgacagcaggtctagcatctttgatgcgaaggctggcattgctttgaacggcaactttgtgaagcttgtgtcctggtacgacaacgagtggggatacagcacccgagtggtcgacctgatccgccacatgaacatcaccaag

SEQ ID NO: 1796 - DNA, 254 bp, Zea mays
  Clone ID: 700243428H1
cggacctggtgtaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggact

SEQ ID NO: 1797 - DNA, 243 bp, Zea mays
  Clone ID: 700167249H1
gccaagaaggttgttatctctgccccaagcaaagatgcgcccatgtttgttgttggtgtcaatgaggacaagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactgg

SEQ ID NO: 1798 - DNA, 244 bp, Zea mays
  Clone ID: 700150450H1
ctcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaa

SEQ ID NO: 1799 - DNA, 238 bp, Zea mays
  Clone ID: 700089949H1
gctcccatatccgctcccctacctctccagcatctcccgtctccgtcgtctcgtctctgctcctcacctcgccgccagccatgggcaagatcaagatcggaatcaacggtttcggaaagatcggcaggctcgtggccagggatcgcctgcagagcgaggatgtcgagctcgtccgcgtcaacgaccccttcaataacaaggaataacatgactacaatgttccagtacgacaacgtgc

SEQ ID NO: 1800 - DNA, 265 bp, Zea mays
  unsure (1)...(265): unsure at all n locations
  Clone ID: 700443495H1
cgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgcncagaaggttgttatctctgcaccaaacaaagatgcacccatgtttgttgttggtgtc

SEQ ID NO: 1801 - DNA, 250 bp, Zea mays
  Clone ID: 700469283H1
gttcttcctgaattgaatggcaagctcactggcatgtccttccgggttcccaccgtggatgtgtcagttgttgacctcactgtcagaatcgagaagggggcctcctacgaggaaatcaagaaagctattaaggctgttctgagggcccactcaagggtatcatgggctacgtggaggaggatctggtttccaccgacttcaccggtgacagcaggtcgagcatcttcgacgccaaggccgggattgccct

SEQ ID NO: 1802 - DNA, 276 bp, Zea mays
  Clone ID: 700072276H1
agctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggac

SEQ ID NO: 1803 - DNA, 268 bp, Zea mays
  Clone ID: 700457552H1
gttcaagtacgacaccgtgcacggccaatggaggcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgcgccaagcaaagatgcgcccatgtttgttgtt

SEQ ID NO: 1804 - DNA, 271 bp, Zea mays
  Clone ID: 700351671H1
ctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctc

SEQ ID NO: 1805 - DNA, 327 bp, Zea mays
  unsure (1)...(327): unsure at all n locations
  Clone ID: 700571583H1
tgctgcctccggctctcgagtctcgtccacccgtcgtcctcctagctcctctactcgccagtcgncatgggcaagactaagatcggaatcaacgggcttcggaaggatcggcaggctcgtggccatggtcgccctccagagcgaggatgtcgaactcgtcgccgtcaacgaccccttcatcaccacggactacatgacctacatgttcaagtacgacaccgtccacggccactggaagcacagcgacatcacactcgaggactccaagaccttctcttcggtgacaagcggtcacgtctttgcatcggaacctgagaaatccgtggg

SEQ ID NO: 1806 - DNA, 274 bp, Zea mays
  Clone ID: 700803969H1
ccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaaccctt

SEQ ID NO: 1807 - DNA, 268 bp, Zea mays
  Clone ID: 700150936H1
cgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctc

SEQ ID NO: 1808 - DNA, 251 bp, Zea mays
  Clone ID: 700570929H1
gtttccaccgatttccagggtgacagcaggtctagcatctttgatgcgaaggctggcattgccttgaacggcaactttgtgaagcttgtgtctggtacgacaacgagtggggatacagcacccgagtggtcgacctgatccgccacatgaacagcaccaagtaaatgaacaaactgatgaaagcatgcaagagtgatgaaagcatgcaaagagagttgtgtttcttccccggaagtgcttccgagaataaa

SEQ ID NO: 1809 - DNA, 312 bp, Zea mays
  unsure (1)...(312): unsure at all n locations
  Clone ID: 700338407H1
gggaccttgtttccaccgatttccagggtgacagcaggtctagcatctttgatgcgaaggctggcattgccttgaacggcaactttgtgaagcttgtgtcctggtacgacaacgagtggggatacagcacccgagtggtcgacctgatccgccacatgaacagcaccaagtaaatgaacaaactgatgaaagcatgcaaagagtgatgaaagcagcaaagagagttgtgtttctccccggaatgcttccgagaataanttttctatctgntgtctaaaacctatattggtgtanggtatcgtatggtggttg

SEQ ID NO: 1810 - DNA, 242 bp, Zea mays
  Clone ID: 700021640H1
gcacgaggaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcga

SEQ ID NO: 1811 - DNA, 235 bp, Zea mays
  Clone ID: 700151914H1
aaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtg

SEQ ID NO: 1812 - DNA, 264 bp, Zea mays
  Clone ID: 700167480H1
cggacggtgggcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagac

SEQ ID NO: 1813 - DNA, 250 bp, Zea mays
  Clone ID: 700236453H1
ctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgatgatgtcgagctcgtcgccgtcaacgaccccttcatcaccacggattacatgacgtacatgttcaagtacgacaccgtgcacggccaatgg

SEQ ID NO: 1814 - DNA, 274 bp, Zea mays
  Clone ID: 700238168H1
gctatgatgagaaacaatatagtgtgcctcggtagctcactggcatgtccttccgggttcccaccgtggatgtgtcagttgttgacctcactgtcagaatcgagaagggggcctcttacgaggaaatcaagaaagctattaaggctgcttctgagggcctactcaagggtattatgggctacgtggaggaggatctggtttccaccgacttcaccggtgacagcaggtcgagcatcttcgacgccaaggccgggattgccctgaacgaccactt

SEQ ID NO: 1815 - DNA, 332 bp, Zea mays
  unsure (1)...(332): unsure at all n locations
  Clone ID: 700613413H1
caagtacacctccgatgttaacattgtttccaatgctagctgcaccacaaactgccttgctccccttgctaaggtcattccatgacaactttgggcattattgagggcttgatgacaactgttcatgccatcactgccacccagaagactgttgatggaccctcagccaaggactggagangtggcagggtgccagctttaacatcattcccagcagcacggtgctgccaaggctgtcggtaaggttctttcctgaattnaatggcagctccatggcatgtccttcgggttcccaacgtggatgtgtcagtgttgacctcaatgtcagaatc

SEQ ID NO: 1816 - DNA, 284 bp, Zea mays
  Clone ID: 700357450H1
cacagatcacacacactcgagaactccatttcgatcccatttgaaatcaacccatcctcgtttcctccgtctagcagcctctcaccctcatggcaaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcacatgaggtcaaggtgaaggact

SEQ ID NO: 1817 - DNA, 273 bp, Zea mays
  Clone ID: 700450090H2
gaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgccccatgtttgttgttggtcaatgaggacaagtacacctccgatgttaacattgtttccaatgctagctgcaccacaaactgccttgctcccccttgctagggtcatcctggacaactttggcattattgagggctt

SEQ ID NO: 1818 - DNA, 270 bp, Zea mays
  Clone ID: 700801459H1
ctcgagccacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggcagtggaagcaccatgaggt

SEQ ID NO: 1819 - DNA, 260 bp, Zea mays
  Clone ID: 700457313H1
cgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctc

SEQ ID NO: 1820 - DNA, 269 bp, Zea mays
  Clone ID: 700382823H1
cacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtgaaacccccatgaggtcaaggtg

SEQ ID NO: 1821 - DNA, 277 bp, Zea mays
  Clone ID: 700085440H1
cccacgcgtccgcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggtagcacagcgacatc

SEQ ID NO: 1822 - DNA, 262 bp, Zea mays
  Clone ID: 700216971H1
ctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatc

SEQ ID NO: 1823 - DNA, 265 bp, Zea mays
  Clone ID: 700239980H1
cccacgcgtccgctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacag

SEQ ID NO: 1824 - DNA, 269 bp, Zea mays
  Clone ID: 700801083H1
ccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacc

SEQ ID NO: 1825 - DNA, 240 bp, Zea mays
  Clone ID: 700202393H1
ctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggcggggtggaagggctgctagtttcaacatcattcccagcagcactggagctgctaaggctgttggcaaagtgcttcctgtccttaacggaaa

SEQ ID NO: 1826 - DNA, 273 bp, Zea mays
  Clone ID: 700105153H1
cccacgcgtccgcccacgcgtccgcccacgcgtccgcagcatcctcccgtctccgtcgtctcgtctccgctcctcaccacgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgcc

SEQ ID NO: 1827 - DNA, 245 bp, Zea mays
  unsure (1)...(245): unsure at all n locations
  Clone ID: 700087788H1
caactttggcattattgagggcttgatgacaactgttcatgccatcactgccacccagaanactgttgatggaccctcagccaangactggagangtggcagggctgncagctttaacatcattcccagcannaccggtgctgccaaggctgtcggtaaggttcttcctnaattgaatggcaagctcactggcatgtccttccgggttcccaccgtggatgngtcagttgttgacctcactgtca

SEQ ID NO: 1828 - DNA, 236 bp, Zea mays
  Clone ID: 700152166H1
cgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaag

SEQ ID NO: 1829 - DNA, 278 bp, Zea mays
  Clone ID: 700332968H1
gctgcctccgcctctcgagtctcgtccacccgtcatcctcctagctcctctactcgccagtcgccatggggaagattgagatcggaatcaacggcttcggaaggatcggcatgctcgtggccagggtcgccctccatagcgaggatggcgagctcgtcgccgtcagtgaccccttcatcaccacggactacatggcctacatgttcaagtacgacaccgtccacggccactggaagcacagcgacatcacactcaaggactccaagacccttctcttc

SEQ ID NO: 1830 - DNA, 293 bp, Zea mays
  Clone ID: 700204350H1
tcgacgccaaggccgggattgccctgaacgaccacttcatcaagctcgtctcgtggtacgacaacgagtggggctacagcaaccgcgtcgtcgacctgatccgccacatgttcaagacccagtaggctagtagagagatagatttctgcctccctatcgagggtcgtcccaatggcctttggtcgcagacaactttgctgcttgtctatgctgagaataaatgtgaacggtgcccctggacgctggatccatgctggttttggaaaaaaaaaaaaaaagggcggccgccgact

SEQ ID NO: 1831 - DNA, 224 bp, Zea mays
  Clone ID: 700150168H1
ctgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgct

SEQ ID NO: 1832 - DNA, 253 bp, Zea mays
  Clone ID: 700449984H1
ctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacagtacctacatgttcagtacgacaccgtccacggccactggaagcacagcgacatcacactcaaggactccaaga

SEQ ID NO: 1833 - DNA, 242 bp, Zea mays
  Clone ID: 700156642H1
gcaggtctagcatctttgatgcgaaggctggcattgctttgaacggcaactttgtgaagcttgtgtcctggtacgacaacgagtggggatacagcacccgagtggtcgacctgatccgccacatgaacatcaccaagtaaatgaacaaactgatgaaaacatgcaaagagtgatgaaagcatgcagagagagttgtgtttcttccccggaagtgcttccgagaataaatttttcttactgat

SEQ ID NO: 1834 - DNA, 237 bp, Zea mays
  Clone ID: 700152779H1
cacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgc

SEQ ID NO: 1835 - DNA, 232 bp, Zea mays
  Clone ID: 700160261H1
cactgctacccagaagactgttgatgggccctcatctaaggactggaggggtggaagggctgctagtttcaacatcattcccagcagcactggagctgctaaggctgttggcaaagtgcttcctgtccttaacggaaagttgactggaatgtctttccgtgtcccaaccgtcgatgtttctgttgttgatttgactgttaggcttgaaaagtcagcaacctatgatgagatc

SEQ ID NO: 1836 - DNA, 259 bp, Zea mays
  unsure (1)...(259): unsure at all n locations
  Clone ID: 700804718H1
tgcggtcaaggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagcnnnngtcctggtacgacaacgagtggggatacagcacccgcgtggtcgacctgatccgccacatgaacagcaccaattaagatgaagaanagttcttgggtngataaacg

SEQ ID NO: 1837 - DNA, 228 bp, Zea mays
  Clone ID: 700356233H1
caacatcattcccagcagcactggagctgctaaggctgttggcaaagtgcttcctgtccttaacggaaagttgactggactgtctttccgtgtcccaaccgtcgatgtttctgttgttgatttgactgttaggcttgagaagtcagcaacctatgatgagatcaaggctgcggtcaaggccgaggcagaaggtagcctcaagggcatcctgggttacgttgaggagga

SEQ ID NO: 1838 - DNA, 264 bp, Zea mays
  Clone ID: 700043272H1
cgccacctatgggcaagatcaagatcggcatcaacggattcggaaggatcggcaggctcgtggccagggtcgccctgcagagcgaggatgtcgagctcgtcgccgtcgacgaccccttcatcaccacggattagatgacgtacatgttcaagtacgacaccgtgcacggccaatggaagcacagcgacatcgcactcaaggactccaagacgcttctcttcggcgagaagccggtcaccgtctttggcatcaggaaccccgaag

SEQ ID NO: 1839 - DNA, 269 bp, Zea mays
  Clone ID: 700456666H1
tcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgttcgagctcgtcgccgtccacgaccccttcatcaccacggattacatgacctacatgttcaagtacgacaccgtgcacggccaatggaagcacagcgacatcaccctca

SEQ ID NO: 1840 - DNA, 305 bp, Zea mays
  unsure (1)...(305): unsure at all n locations
  Clone ID: 700205926H1
ctcagctcncatatccgctcncctacctctccagcatcctcncgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgctcctcttcggcgagaagc

SEQ ID NO: 1841 - DNA, 268 bp, Zea mays
  unsure (1)...(268): unsure at all n locations
  Clone ID: 700454102H1
caaggctgctgcacatctgaagggtggtgccaagaaggttgttatctctgccccaagcaaagatgcacccatgtttgttgttggtgtcaatgaggacaagtacactccgatgttaacattgtttccaatgctagctgcaccacaaactgccttgctccccttgctaaggtcattcatgacaactttggcattattgagggcttgatgacantgttcangccatccactgccacccagaaagatgttgatggaccctcagccagggatg

SEQ ID NO: 1842 - DNA, 318 bp, Zea mays
  Clone ID: 700207045H1
atcagctcccatatccgctcgcctacctctccagcatctgccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgagctacatgttcaagtacgacaccgtgcacgtgcaatggaaggacagcgacatcacgctcaacgactccaagacgcttctcttcggcgagaagcggtcaccgtct

SEQ ID NO: 1843 - DNA, 292 bp, Zea mays
  Clone ID: 700377244H1
cgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacacctccgatgttaacattgtttcaaatgctagctgcaccacaaactgacttgctccacttgctaaggtcattcatgacaactctggcattattgagggcttgatgaaactgtacatg

SEQ ID NO: 1844 - DNA, 255 bp, Zea mays
  Clone ID: 700549440H1
acagatcacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtg

SEQ ID NO: 1845 - DNA, 237 bp, Zea mays
  unsure (1)...(237): unsure at all n locations
  Clone ID: 700166882H1
cttcggcattgttgagggtttgatgacaactgttcatgccatnactgccacccagaaaactgttgacggaccctcagccaaggactggagaggtggcagggctgccagctttaacatcattcctagcagcaccggtgctgccaangctgttggtaaagttcttccngatctgaatggcnagctcactggtatgtccttccgngttcctactgtggatgtctcggttgttgacctcac

SEQ ID NO: 1846 - DNA, 234 bp, Zea mays
  Clone ID: 700167140H1
cctgaattgaatggcaagctcactggcatgtccttccgggttcccaccgtggatgtgtcacttgttgacctcactgtcagaatcgagaagggggcctcttacgaggaaatcaagaaagctattaaggctgcttctgagggcccactcaagggtattatgggctacgtggacgatgatctggtttccaccgacttcaccggtgacagcaggtcgagcatcttcgacgtcaaggcc

SEQ ID NO: 1847 - DNA, 229 bp, Zea mays
  Clone ID: 700152640H1
atcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttg

SEQ ID NO: 1848 - DNA, 231 bp, Zea mays
  Clone ID: 700020603H1
acaacttcggcattgttgagggtttgatgacaactgttcatgccatcactgccacccagaaaactgttgacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttg

SEQ ID NO: 1849 - DNA, 230 bp, Zea mays
  Clone ID: 700152109H1
agggctgctagtttcaacatcattcccagcagcactggagctgctaaggctgttggcaaagtgcttcctgtcctcaatggaaaattgactggaatgtctttccgtgtcccaactgtcgatgtttctgttgttgatctgactgttaggcttgagaagtctgccacctatgatgagatcaaggctgcggtcaaggccgaggcagagggtagcctcaagggcattctgggtta

SEQ ID NO: 1850 - DNA, 271 bp, Zea mays
  Clone ID: 700442690H1
cagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctc

SEQ ID NO: 1851 - DNA, 242 bp, Zea mays
  Clone ID: 700156713H1
cattcccagcagcactggagctgctaaggctgttggcaaagtgcttcctgtccttaacggaaagttgactggaatgtctttccgtgtccaaccgttcgatgtttctgttgttgatttgactgttaggcttgaaaagtcagcaacctatgatgagatcaaggctgcggtcaaggccgaggcagaaggtagcctcaagggcatcctgggttacgttgaggaggaccttgtttccaccgatttcc

SEQ ID NO: 1852 - DNA, 236 bp, Zea mays
  Clone ID: 700239313H1
ctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaggtacgacaccgtgc

SEQ ID NO: 1853 - DNA, 259 bp, Zea mays
  Clone ID: 700102871H1
ctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcaca

SEQ ID NO: 1854 - DNA, 263 bp, Zea mays
  Clone ID: 700224872H1
ctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcga

SEQ ID NO: 1855 - DNA, 284 bp, Zea mays
  Clone ID: 700448596H1
ctcgagccgctcgagccgctcagctcccatatccgctcccctacctctccagcatctcccgtctccgtcgtatcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacat

SEQ ID NO: 1856 - DNA, 250 bp, Zea mays
  Clone ID: 700218841H1
tccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggac

SEQ ID NO: 1857 - DNA, 315 bp, Zea mays
  Clone ID: 700258654H1
gccggctttaaaaacgcacacaagcgctaaaaccctctccaccgtccacctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcg

SEQ ID NO: 1858 - DNA, 246 bp, Zea mays
  Clone ID: 700798771H1
ccgtggtgatgaaggggtcgttgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtg

SEQ ID NO: 1859 - DNA, 228 bp, Zea mays
  Clone ID: 700152891H1
aatcaacggcttcggaaggatcggcaggctcgtggccatgatcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaa

SEQ ID NO: 1860 - DNA, 264 bp, Zea mays
  Clone ID: 700805450H1
ccgtcatcgatctcgtttcaaatccatccatcctcgtttcctccgtcccgcagcatctcaaccccatgccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaa

SEQ ID NO: 1861 - DNA, 228 bp, Zea mays
  Clone ID: 700152783H1
gggtttgatgacaactgttcatgccatcactgccacacagaaaactgtagacggaccctcagccaaggactggagaggtggcagggctgccagctttaacatcattcctagcagcaccggtgctgccaaggctgttggtaaagttcttcctgatctgaatggcaagctcactggtatgtccttccgtgttcctactgtggatgtctcggttgttgacctcaccgtcag

SEQ ID NO: 1862 - DNA, 239 bp, Zea mays
  Clone ID: 700085765H1
cccacgcgtccgctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaagaaagctattaaggctgcttctg

SEQ ID NO: 1863 - DNA, 241 bp, Zea mays
  Clone ID: 700263179H1
ctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgaca

SEQ ID NO: 1864 - DNA, 230 bp, Zea mays
  unsure (1)...(230): unsure at all n locations
  Clone ID: 700163973H1
cttcggcattgttgagggtttgatgacaactgttcatgccatcactgccacccagaaaactgttgacggaccctcagccaaggactggagaggtggcagggctgccagctttaacatcattcctagcagcacngnngcngccaaggctgttggtaaagttcttcctgatctgaatggcaagctcactggtatgtccttccgtgttcctactgtggatgtctcggttgttg

SEQ ID NO: 1865 - DNA, 235 bp, Zea mays
  Clone ID: 700152630H1
gatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgac

SEQ ID NO: 1866 - DNA, 224 bp, Zea mays
  Clone ID: 700152546H1
cgctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtcca

SEQ ID NO: 1867 - DNA, 270 bp, Zea mays
  Clone ID: 700217728H1
gaggtcttggagtccttcaccttgacctcatggtgcttccactgtccgtgcacagtgtcatacttgaacatgtaggtcatgtaatcggtgctgatgaaggggtcgttcacggcgacgagctcgacgtcgtcgctctgcagggccaccctggccaccagccttccgatcctgccaaacccattgatcccgatcttgatcttggccatgagggtgagaggctgctagacccttctctttggtgagaaggaggttgctgtgtttggctgcagg

SEQ ID NO: 1868 - DNA, 260 bp, Zea mays
  unsure (1)...(260): unsure at all n locations
  Clone ID: 700336157H1
ctcatcgatctcgtttcagatccatccatcctcgtttcctccgtcccgcagcatctcaaccccatggccaagatcaagatcgggatcaatgggttcggcaggatcggaaggctngtggccagggtcgccctgcagagtgacgatgtcgagctcgtcgccgtgaacgaccccttcatcagcaccgactacatgacctacatgttcaagtacgacactgtgcacggacagtggaagcaccatgaagtcaaggtgaaggactc

SEQ ID NO: 1869 - DNA, 287 bp, Zea mays
  Clone ID: 700332651H1
cgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtggcacggacagtggaagcaccatgaagtcaaggtgaaggactccaaaacccttctctttggtgagaaggaggtt

SEQ ID NO: 1870 - DNA, 271 bp, Zea mays
  Clone ID: 700348702H1
tcagcatcctcccgtctccatcgtctcgtctccgctcctcacctcgccagccatgggcaagatcaagatcggaatcaacggtttcggaaggatcggcaggctcgtggccagggtcgccctgcagagcgatgatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgag

SEQ ID NO: 1871 - DNA, 272 bp, Zea mays
  Clone ID: 700611336H1
caagcacactggtatgtccttccgtgttcctactgtggatgtctcggttgtagacctcaccgtcagaatcgagaagggggcctcctatgcggatatcaagaaagctattaaggctgcttccgagggtccactcaaaggtatcatgggttatgcggaggaggatctggtttgctaccgacttccttggtgacagcaggtcgagcatcttcgacgccaaggccgggatcgctctgaacgaccacttcgtcaagctcgtctcgtggtacgacaac

SEQ ID NO: 1872 - DNA, 224 bp, Zea mays
  Clone ID: 700151934H1
acactcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtat

SEQ ID NO: 1873 - DNA, 229 bp, Zea mays
  Clone ID: 700150270H1
cacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatga

SEQ ID NO: 1874 - DNA, 245 bp, Zea mays
  Clone ID: 700021115H1
gcacgagggatctggtttccaccgacttcaccggtgacagcaggtcgagcatcttcgacgccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgtgggtcgtccccaatggcctttggtcgcagacagtctttg

SEQ ID NO: 1875 - DNA, 271 bp, Zea mays
  Clone ID: 700213761H1
ggtcacctcgcagagaacgagcgcgacggggaggggtcgagctcgtcgccgtgaacgaccccttcatcagcacggattagctgacctacatgttcaagtatgacactgtgcacggacagtggaagcaccatgaggtcaaggtgaaggactccaagacccttctctttggtgagaaggaggttgctgtgtttggctgcaggaaccctgaggagattccatggggttcggttggcgctgaatatgttgttgagtctactggtgttttcactga

SEQ ID NO: 1876 - DNA, 228 bp, Zea mays
  Clone ID: 700083759H1
actcgagaactccatttcgatctcatttgaaatcaacccatcctcgtttcctccgtctagcagcctctcaccctcatggccaagatcaagatcgggatcaatgggtttggcaggatcggaaggctggtggctagggtggccctgcagagcgacgacgtcgagctcgtcgccgtgaacgaccccttcaatcagcacgattaaatgacctacatgttccagtaatgcact

SEQ ID NO: 1877 - DNA, 246 bp, Zea mays
  Clone ID: 700263853H1
ctcccatatccgctcccctacctctccagcatcctcccgtctcagtcgtctcgtctccgctcctcacatcgccagccatgggcaagatcaagatcggaatcaacggtttcggaaggatcggcaggctcgtggccagggtcgccctgcagagcgaggatgtcgagctcgtcgccgtcaacgaccccttcatcaccacgggatacatgacgtacatgttcaagtacgacaccgtgcacggccaatgga

SEQ ID NO: 1878 - DNA, 288 bp, Zea mays
  Clone ID: 700347719H1
atcatcgatctcgtttcaaatccatccatcctcgtttcctccgtcccgcagcatctcaaccccatggccaagatcaagatcgggatcaatgggttcggcaggatcggaaggctggtggccacggtagccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggag

SEQ ID NO: 1879 - DNA, 296 bp, Zea mays
  Clone ID: 700048938H1
gtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgatgtcaaggtgaaggactccaaaacccttctctttggtgagaaggaggttgctgt

SEQ ID NO: 1880 - DNA, 221 bp, Zea mays
  unsure (1)...(221): unsure at all n locations
  Clone ID: 700150141H1
tntaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcagggctgccagctttaacatcattcccagcagcaccggtgctgccaaggctgt

SEQ ID NO: 1881 - DNA, 219 bp, Zea mays
  Clone ID: 700019545H1
gtctgccacctatgatgagatcaaggctgcggtcaaggccgaggcagagggtagcctcaagggcattctgggttatgtcgaggaggaccttgtttccaccgatttccagggtgacagcaggtctagcatctttgatgcgaaggctggcattgccttgaacggcaactttgtgaagcttgtgtcctggtacgacaacgagtggggatacagcacccgagt

SEQ ID NO: 1882 - DNA, 228 bp, Zea mays
  unsure (1)...(228): unsure at all n locations
  Clone ID: 700019463H1
gagaagtctgccacctatgatgagatcaaggctgcggtcaangccgaggcagagggtagcctcaagggcattctgggttatgtcgaggaggaccttgtttccaccgatttccagggtgacagcaggtctagcatctttgatgcgaaggctgnnattgccttgaacggcaactttgtgaagcttgtgtcctggnacgacaacgagtggggatacagcacccgattngtc

SEQ ID NO: 1883 - DNA, 272 bp, Zea mays
  Clone ID: 700455246H1
ctggcatgtccttccgggttcccaccgtggatgtgtcagttgttgacctcactgtcagaatcgagaagggggcctcttacgaggaaatcaagaaagctattaaggctgcttctgagggcccactcaagggtattatgggctacgtggaggaggatctggtttccaccgacttcaccggtgacagcaggtcgagcatcttcgacgccaaggccgggattgccctgaacgaccacttcatcaagctcgtctcttggtacgacaacgagtggggc

SEQ ID NO: 1884 - DNA, 277 bp, Zea mays
  Clone ID: 700382892H1
cgatctcgtttcaaatccatccatcctcgtttccaccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccattctctcaaggtgaaggactccaaaacccttctctttggtgag

SEQ ID NO: 1885 - DNA, 240 bp, Zea mays
  Clone ID: 700346309H1
ctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacgg

SEQ ID NO: 1886 - DNA, 232 bp, Zea mays
  Clone ID: 700257372H1
cccagcagagcgaggatgtcgagctcgtcgccgtcaacgaccccttcatcaccacggattacatgacctacatgttcaagtacgacaccgtgcacggccaatggaagcacagcgacatcaccctcaaggacaccaagacgcttctcttcggcgagaagccggtcaccgtctttggcatcaggaacaccgaggagatcccgtggggtgaggctggtgctgagtatgtcgtgga

SEQ ID NO: 1887 - DNA, 301 bp, Zea mays
  unsure (1)...(301): unsure at all n locations
  Clone ID: 700802008H1
ctcgagccgctcgagccgattcggctcgagccaagatcaagatcgggatcaatgggttcgagtngatcgagtangtgttggcaagggtggcctgcagattgacgttgtcgagttcgtcgccgtgaacgaccccttcatcagcacggactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggtt

SEQ ID NO: 1888 - DNA, 230 bp, Zea mays
  unsure (1)...(230): unsure at all n locations
  Clone ID: 700083602H1
gttcatgccatcactgccacacagaaaactgttgacggaccctcagccaaggactggagaggtggcagggctgccagctttaacatcaancctagcagcaccggtgctgccaaggctgttggtaaagttcttcctgatctgaatggcaagctcactggtatgtccttccgtgttcctactgtggatgtctcggttgttgacttaacggtnagaatcgagaaggggggcct

SEQ ID NO: 1889 - DNA, 222 bp, Zea mays
  Clone ID: 700266939H1
cgctgcctccgcctctcgagtctcgtccacccgtcatcctcctagctcctctactcgccagtcgccatgggcaagattacgatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtc

SEQ ID NO: 1890 - DNA, 258 bp, Zea mays
  Clone ID: 700431491H1
ctgaatggcaagctcactgggatgtccttccgcgttcctactgtggctgtctcggttgttgacgtcaccgtcagaatcgggagaggggcctcctattaggatatcaagaaggctattaaggctgcttccgatggtcgcactcaatggtatcatgggttatgtggaggagggtctagtttctaccgacttccgtggtgacagcaggtcgagcatcttcgacgccaaggccgggatcgctctgaacgaccacttcgtcaa

SEQ ID NO: 1891 - DNA, 247 bp, Zea mays
  Clone ID: 700611180H1
ggactccctgacccttctcatcggtgacaagccggtcaccgtctttggcatcaggaaccctgacgaaatcccgtggggtgaggctggcgctgagtctgtcgtggagtccaccggcgtcttcactgacgaggacaaggctactcacatctcaagggtagtgccaagaaggttgttatctctaccccaagtaaagatgcacccatcttcgttgttcgtgtcaatgaagaccagtgcacctcgggtgtta

SEQ ID NO: 1892 - DNA, 332 bp, Zea mays
  Clone ID: 700348016H1
ttctgtgtacggaacgtagactccattcgactcgagcgaattctgctcgacacacactcgagaactccattacgatcccatttgaaacgaacccatcctcgtttcctccgtctagcagcctctcaccctcatggccaagatcaagatcgggatcaatgggtttggcaggatcggaaggctggtggccagggtttccctgtagagcgacgacgtcgatctcgtcgtcgtgaacgtgccactcatcagcactgattacatgacgtacttgtacaagtatgacactgtgcacggacagtggaagcaccatgaggtcaaggtgaaggactccaaga

SEQ ID NO: 1893 - DNA, 267 bp, Zea mays
  Clone ID: 700577294H1
ataggctacgtggaggatgatctggtttccaccgacttcaccggtgacagcaggtcgagcatcttcgtcgccaaggccgtgattgccctgaacgaccacttcatcaagctcgtctctgggtacgacaacgagtggggctacagcaaccgcgtcgtcgactcgatccgccacatgttcaagacccagtagagagagatatttctgcctccctatcgagggtcgtccccgatggcctttggtcgcagacagcgtggctgcttgtctatg

SEQ ID NO: 1894 - DNA, 265 bp, Zea mays
  Clone ID: 700457970H1
tcagctcccatatccgctcgcctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacat

SEQ ID NO: 1895 - DNA, 272 bp, Zea mays
  Clone ID: 700239677H1
cccacgcgtccgcggacgcgtgggccgtcatcgatctcgtttcaaatccatccatcctcgtttcctccgtcccgcagcatctcagccccatggcgcagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtc

SEQ ID NO: 1896 - DNA, 221 bp, Zea mays
  Clone ID: 700242889H1
ctcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtat

SEQ ID NO: 1897 - DNA, 218 bp, Zea mays
  Clone ID: 700016313H1
gtggtgccaagaaggttgttatctctgccccaagcaaagacgcacccatgtttgttgttggtgtcaatgaggacaagtacacctcggatgttaacattgtttccaatgctagctgcaccacaaactgccttgctccccttgctaaggtcattcatgacaacttcggcattgttgagggtttgatgacaactgttcatgccatcactgccacccagaaa

SEQ ID NO: 1898 - DNA, 227 bp, Zea mays
  Clone ID: 700155241H1
cccacgcgtccgcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcgcccatgt

SEQ ID NO: 1899 - DNA, 263 bp, Zea mays
  Clone ID: 700223882H1
cagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgatgatgtcgagctcgtcgccgtcaacgtacgcttcatcagcacggattacatgacgtacatggtcaagtacgacatcgtgcacgggtcatggaaacacagcgacatc

SEQ ID NO: 1900 - DNA, 243 bp, Zea mays
  Clone ID: 700047915H1
gggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtcca

SEQ ID NO: 1901 - DNA, 268 bp, Zea mays
  Clone ID: 700449818H2
gcggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcgcccatgtttgttgttggtcaatgaggacaagtacacctccgatgttaacattgtttccaatgctagctgcaccacaaactgccttagctcccttgcttaggtcattcatgacaactttggcattattgag

SEQ ID NO: 1902 - DNA, 239 bp, Zea mays
  Clone ID: 700804993H1
cggctcgagcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagc

SEQ ID NO: 1903 - DNA, 242 bp, Zea mays
  Clone ID: 700570972H1
cacacactcgagaactccatttcgatctcatttgaaatcaacccatcctcgtttcctccgtctagcagcctctcaccctcatggccaagatcaagatcgggatcaatgggtttggcaggatctgaaggctggtggccagggtggccctgcagagcgacgacgtcgagctcgtcgccgtgaagaccccttcatcagcaccgattacatgacctacatgttcaagtatgacactgtgcacggac

SEQ ID NO: 1904 - DNA, 231 bp, Zea mays
  Clone ID: 700016664H1
gcacgagccaaggccgggattgccctgaacgaccacttcatcaagctcgtctcttggtacgacaacgagtggggctacagcaaccgcgtcgtcgacctgatccgccacatgttcaagacccagtagagagagatatttctgcctccctatcgtgggtcgtccccaatggcctttggtcgcagacatgctttgctgcttgtctatgctgagaataaatgtgaacggtgcccc

SEQ ID NO: 1905 - DNA, 258 bp, Zea mays
  Clone ID: 700213557H1
cggacgcgtgggccgtcatcgatctcgtttcaaatccatccatcctcgtttcctccgtcccgcagcatctacaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaag

SEQ ID NO: 1906 - DNA, 282 bp, Zea mays
  Clone ID: 700613214H1
tgccactcaagggtattatgggctacgtggaggaggatctggtttccaccgacttcaccggtgacagcaggtcgagcatcttcgacgccaaggccgggattgccctgaacgaccacttcatcaagctcgtctcttggacgacaacgagtgtggctacaataaccgcgtcgacgacgtgatccgccacatgttcaagagccagtagagagagatatctctgcctccctatcgaaggtcgtcaccgatggcctttggtcgcagacatctttgctgctagtctat

SEQ ID NO: 1907 - DNA, 293 bp, Zea mays
  Clone ID: 700343710H1
ccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggtt

SEQ ID NO: 1908 - DNA, 261 bp, Zea mays
  Clone ID: 700442421H1
gctgcctccgcctctcgagtctcgtccacccgtcgtcctaatagctcctctactcgccagtcgccatgggcaagactaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggact

SEQ ID NO: 1909 - DNA, 244 bp, Zea mays
  Clone ID: 700265008H1
accagacctccatttcgatcccatttgacatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaag

SEQ ID NO: 1910 - DNA, 243 bp, Zea mays
  Clone ID: 700218525H1
ccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcccagcggcatcaccctc

SEQ ID NO: 1911 - DNA, 259 bp, Zea mays
  Clone ID: 700551922H1
agcatcttcgacgccaaggctgtcggtagaaaccagatcctcttccgagggtccactcaagggtatcatgggttatgcggaggacgatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtagagg

SEQ ID NO: 1912 - DNA, 220 bp, Zea mays
  unsure (1)...(220): unsure at all n locations
  Clone ID: 700017612H1
tcaanaaagctatnaangctgcttccganggtccactcaagggtatcatgggttatgcggatgaggatntggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacat

SEQ ID NO: 1913 - DNA, 272 bp, Zea mays
  unsure (1)...(272): unsure at all n locations
  Clone ID: 700579349H1
cttcggcattgttgagggtttgatgacaactgttcatgccatcactgccacccagaaaactgttgacggaccctcagccaaggactggagaggtggcagggctgccagctttaacatcattccnagcagcaccggtgctgccaaggctgttggnnaagttctcctgatctgaatgggcaagctccactggtatgtccttaccgtgttcctactgtggatgtctcggttnnggncctcaccgtcagantcgagnagggtgnncctaancagga

SEQ ID NO: 1914 - DNA, 240 bp, Zea mays
  Clone ID: 700197914H1
acctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccg

SEQ ID NO: 1915 - DNA, 285 bp, Zea mays
  Clone ID: 700083456H1
ccgtcatcgatctcgtttcaaatccatccatcctcgtttcctccgtcccgcagcatctcaaccccatggccaagatcaagatcgggatcaatgggttcggcaagatcggaaggctggtggcccagggtggccctgcagagtgacgatgtcgagctcgtcgccgtgaacgaccccttcatcagcaccgactacatgacctacatgttcaagtacgacactgtgcacggacaatggaagcacccatgaagtcaaggtgaagactcaaaaaccctctcctttgtgaga

SEQ ID NO: 1916 - DNA, 214 bp, Zea mays
  Clone ID: 700018387H1
gcacgagcctcagccaaggactggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgttgacctcactgtcagaatcgagaagggggcctcttacgaggaaatcaaga

SEQ ID NO: 1917 - DNA, 260 bp, Zea mays
  Clone ID: 700611470H1
ggactccaagacccgtctcttcggtgacaaaccggtcaccgcctttggcatcaggaaccctgaggaaatcccgtggggtgaggctggcgctgagtcatgtcgtggagtccaccggcgtcttcactgacaaggacaaggctgctgcacatctcaagggtggtcccaagaaggctgttatctctacgccaagcaaagatgcacccatgtttgttgtcggtgtcaatgaggactagtacacctcggatgttaacattgtatcc

SEQ ID NO: 1918 - DNA, 256 bp, Zea mays
  unsure (1)...(256): unsure at all n locations
  Clone ID: 700074067H1
antggcgggnacgcgtggncggcaacccatgtttgttgttggtgtcaatgaggacaagtntacctcggantttaacatatntntccaatgacngctgcaccacaaactgccttgctccccttgctaaggtcattcatgacaacttcggcattgttgagggtttgatgacaactgttcatgccatcactgccacccagaaaactgttgacggaccctcagccaaggactggagaggtggcagggctgccagctttaa

SEQ ID NO: 1919 - DNA, 174 bp, Zea mays
  Clone ID: 700237659H1
acgccagctccgcgacggcgcggaacggtttcggaaggatcggcaggctcgtgagcaggagcccctgcagacgaggatgtcgagctcgtcgcgtcaacgaccctcacaccacgatactgactactgttcatacgacacgtgcacgccatggaaccacgcatcacctcaagatcc

SEQ ID NO: 1920 - DNA, 205 bp, Zea mays
  Clone ID: 700018236H1
gagaagtctgccacctatgatgagatcaaggctgcggtcaaggccgaggcagagggtagcctcaagggcattctgggttatgtcgaggaggaccttgtttccaccgatttccagggtgacagcaggtctagcatctttgatgcgaaggctggcattgccttgaacggcaactttgtgaagcttgtgtcctggtacgacaacgagt

SEQ ID NO: 1921 - DNA, 262 bp, Zea mays
  Clone ID: 700240687H1
acgcaccaaacgagcgggacctgcgagcggcggacgcgtggcgctcccctacctctccagcatcctcccgtcaccgtcgtcacgtctccgctcatcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccg

SEQ ID NO: 1922 - DNA, 232 bp, Zea mays
  Clone ID: 700152594H1
cgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtgg

SEQ ID NO: 1923 - DNA, 210 bp, Zea mays
  Clone ID: 700050944H1
gcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacacggtgaaggg

SEQ ID NO: 1924 - DNA, 226 bp, Zea mays
  Clone ID: 700016175H1
ttcggcacgagcccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcatctaaggactggaggggtggaag

SEQ ID NO: 1925 - DNA, 221 bp, Zea mays
  Clone ID: 700238172H1
gaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcgcccatgtttgttgttggtgtcaatgaggacaagtacacctccgatgttaacattgtttccaatgctagctgcaccacaaactg

SEQ ID NO: 1926 - DNA, 285 bp, Zea mays
  Clone ID: 700349862H1
ctcgctcccggattcagcgtcgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagaccttctcttcggtgacaagcggtcacgtctttggcatcaggaccctgaggaaatccgtggggtg

SEQ ID NO: 1927 - DNA, 268 bp, Zea mays
  Clone ID: 700336123H1
ccatatccgctcgcctacctctccagcatctcccgcctccgccgtctcgtctctgctcctcacctcgccgcgatccatgggcaatatcaagatcggaatcaacggtttcggaatgatcggcaggctcgtggcgagggtcgccctggagagcgaggatgtcgagctcgtcgccgtcaacgaccccttcatcaccacggattacatgacctacatgttcaagtacgacaccgtgcacggccaatggaagcagagcgagatcagcctcaag

SEQ ID NO: 1928 - DNA, 264 bp, Zea mays
  Clone ID: 700151243H1
cccacgcgtccgcccacgcgtccgcccacgcgtccgcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactgggacacaggga

SEQ ID NO: 1929 - DNA, 229 bp, Zea mays
  Clone ID: 700164181H1
cggacgcgtggcggacgcgtgggcgagaactccatttcgatcccatttgaaatcaacccatcctcgttacctccgtctagaggcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgaccta

SEQ ID NO: 1930 - DNA, 228 bp, Zea mays
  Clone ID: 700149684H1
tcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagt

SEQ ID NO: 1931 - DNA, 303 bp, Zea mays
  unsure (1)...(303): unsure at all n locations
  Clone ID: 700615060H1
tagacccgtcatcgatctcgtttcaaatccatccatcctcgtttcctccgtcccgcagcatctcaaccccatggccaagatcaagatcgggatcaatgggttcggcaggatcggaaggctggtcggcaaggtggccctgcagagtgacgatgtcgagctcgtcgccgtgaacgaccccttcatcagcaccgactacatgacctacatgttcaagtacgacactgtgcacggacagtggaagcaccatgaagtcaaggctgaagactccanaacgcttctctgtggtgagaaggaggtgctgtg

SEQ ID NO: 1932 - DNA, 267 bp, Zea mays
  Clone ID: 700456658H1
tcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctc

SEQ ID NO: 1933 - DNA, 227 bp, Zea mays
  unsure (1)...(227): unsure at all n locations
  Clone ID: 700151426H1
tgtacttgtcctcattgacacctccgatgttaacattgtttccaatgctagctgcaccacaaactgcctngctccccttgctaaggtcattcatgacaactttggcattattgagggcttgatgacaactgttcatgccatcnnctgccacccagaagactgttgatggaccctcagccaaggactggagaggtggcagggctgccagctttaacatcattcccagc

SEQ ID NO: 1934 - DNA, 278 bp, Zea mays
  Clone ID: 700261414H1
cagcgctaaaaccctctccaccgtccacatcagctcccatatccgctcccctacctctccagcatcctcccgtctccgtcgtctcgtctccgctcctcacatcgccagccatgggcaacatcaagatcggaatcaacggtttcggaacgatcggcaggctcgtggccagggatcccctgcagagcgaggatgtcgagctcgtcgccgtcaacgaccccttcatcaccacggattacatgacgtacatgttcaagtacgacaccgtgcacggccaatgg

SEQ ID NO: 1935 - DNA, 282 bp, Zea mays
  Clone ID: 700353168H1
atcgatctcgtttcaaatccatccatcctcgtttcctccgtcccgcagcatctcaaccccatggccaagatcaagatcgggatcaatgggttcggcaggatcggacagctggtggccagggtggccctgcagagtgacgatgtcgagctcgtcgccgtgaacgaccccttcatcagcaccgactacatgacctacatgttccagtacgacactgtgcacggacagtggaagcaccatgagtcaaggtgaaagactccaaacccttctcctttgtgagaagga

SEQ ID NO: 1936 - DNA, 276 bp, Zea mays
  Clone ID: 700350156H1
catatccgctcccctacctctccagcatcctcccgtctccgtcgtctgcgtctccgctcctcacctcgccagccatgggcaagatcaagatcggaatcaacggtttcggaaggatcggcaggctcgtggccagggtcgcctggagagcgaggatgtcgagctcgtcgccgtcaacgaccccttcatcaccacggattacatgacgtccatgttcaagtacgacaccgtgcacggccaatggaagcacagcgacatcgccctcaaggactccaagac

SEQ ID NO: 1937 - DNA, 220 bp, Zea mays
  Clone ID: 700171133H1
cgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagaccgaggatgtcgagctcgtcgccgtcaacgaccccttcatcaccacggattacatgacctacatgttcaagtacgaca

SEQ ID NO: 1938 - DNA, 229 bp, Zea mays
  Clone ID: 700150636H1
cagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtac

SEQ ID NO: 1939 - DNA, 200 bp, Zea mays
  Clone ID: 700354231H1
ctccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgaccta

SEQ ID NO: 1940 - DNA, 272 bp, Zea mays
  unsure (1)...(272): unsure at all n locations
  Clone ID: 700454489H1
gttgacggaccctcagcnaacnnttttcnnggtggcagtgatggcatgancagttgtcatcactgccacccannaaactgtatacggaccctcagccaaggactggagaggtggcagggctgccagctttaacatcattcctagcagcaccggtgcnntccaaggctgttggtaaagttcttcctgatctgaatggcaagctcactggtatgtccttccgtgttcctactgtggatgtctcggttgttgacctcaccgtcagaatcgagaag

SEQ ID NO: 1941 - DNA, 230 bp, Zea mays
  Clone ID: 700241567H1
gatatttctgcctccctatcgtgggtcgtccccaatggcctttggtcgcagacatctttgctgcttgtctatgctgagaataaatgtgaacggtgcccctggacgctggatccatgctggttttggacacgttgtctttttgtgtttaacttatctgctaccgtcctgtaacgaattcactaagttctagttcttttgtgctttgttaagaatataaacaatgaggtttc

SEQ ID NO: 1942 - DNA, 206 bp, Zea mays
  Clone ID: 700171506H1
gctcactggtatgtccttccgtgttcctactgtggatgtctcggttgttgacctcaccgtcagaatcgagaagggggcctcctatgaggatatcaagaaagctattaaggctgcttccgagggtccactcaagggtatcatgggttatgcggaggaggatctggtttctaccgacttccttggtgacagcaggtcgagcatcttcg

SEQ ID NO: 1943 - DNA, 223 bp, Zea mays
  Clone ID: 700354944H1
gtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacg

SEQ ID NO: 1944 - DNA, 220 bp, Zea mays
  Clone ID: 700160388H1
cgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacgga

SEQ ID NO: 1945 - DNA, 262 bp, Zea mays
  unsure (1)...(262): unsure at all n locations
  Clone ID: 700806125H1
ctcgagccgttcgatcccatttgaaatcaacccatcctcgtatnctccgtctagcagcctctcaccctcatggccaagatcaagatcgggatcaatgggtttggtcggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaagg

SEQ ID NO: 1946 - DNA, 275 bp, Zea mays
  Clone ID: 700072347H2
caaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcgcggatagtggatgcaccgatcttgctgtttcatcgattgaactaatattgaaaggatctgtaccttctaa

SEQ ID NO: 1947 - DNA, 282 bp, Zea mays
  Clone ID: 700264638H1
aaaccctctccaccgtccacctcagctcccatatccgctcccctacctctccagcatctcccgtctccgtcgtctcgtctctgctcctcacctcgccgccagccatgggtaactcctcgctcccggccagccccccgcgtcggggttttccatttactactactcgctgctccctcctgctccgtgctcagactcagatccgaccaaagctgtttcgctgactaaattctccttcgttttttctttttatggacggattcccggacgcaggcaagatcaaga

SEQ ID NO: 1948 - DNA, 240 bp, Zea mays
  Clone ID: 701181725H1
cggctcgagtcgagaactccatttcgatctcatttgaaatcaacccatcctcgtttcctccgtctagcagcctctcaccctcatggccaagatcaagatcgggatcaatgggtttggcaggatcggaaggctggtggccacggtggccctgcagagcgacgacgtcgagatcgtcgccgtgaacgaccccttcatcagcaccgattacatgacctacatgttcaagtatgacactgtgca

SEQ ID NO: 1949 - DNA, 287 bp, Zea mays
  Clone ID: 700439643H1
acccatatccgctcccctacctcgcgagcatctcccgtctccttcgtctcgtctctgctcctcacctctccgcgagccatgggcgagatcaagatcggaatcaacggtttcggaaggatcggcaggctcgttgccagggtcgccctgcagagcgaggatgtcgagctcgtcgccgtcaacgaccccgtcatcaccacggattacatgacctacatgttcaagtacgacaccgtgcacggccaattgaagcacagcgacatcaccctcagaggactcaagacgcttct

SEQ ID NO: 1950 - DNA, 231 bp, Zea mays
  Clone ID: 700473276H1
gagtggggctacagcaaccgcgtcgtcgacctgatccgccacatgttcaagacccagtagagagagatatttctgcctccctatcgagggtcgtccccgatggcctttggtcgcagacatctttgctgcttgtctatgctgagaataaatgtgatcggtgcccctggacgctggatccatgctggttttggaaaaaaaaaaaaaaaaaaaaaaaaaaaaaggggggccccc

SEQ ID NO: 1951 - DNA, 284 bp, Zea mays
  Clone ID: 700335504H1
cacacactcgagaactccatttcgatctcatttgacatcaacccatcctcgtttcctccgtctagcagcctctcaccctcatggccaagatcaagatcgggatcaatgggtttggcaggatcggcaggctggtggccagggtggccctgcagagcgacgacgtcgagatcgtcgccgtgaacgaccccttcatcagcaccgattacatgagctacatgttcaagtatgacactgtgcacggacagtggaagcaccatgaggtacaggtgcaggactccaagacc

SEQ ID NO: 1952 - DNA, 201 bp, Zea mays
  Clone ID: 700439983H1
gtttccaatgctagctgcaccacaaactgccttgctccccttgctaaggtcattcatgacaactttggcattattgagggcttgatgacaactgttcatgccatcactgccacccagaagactgttgatggaccctcagccaaggactggagaggtggcaggctgccagctttaacatcattcccagcagcaacgggtggt

SEQ ID NO: 1953 - DNA, 254 bp, Zea mays
  Clone ID: 700803685H1
cccgagtggtcgacctgatccgccacatgaacatcaccaagtaaatgaacaaactgatgaaaacatgcaaagagtgatgaaagcatgcagagagagttgtgtttcttccccggaagtgcttccgagaataaatttttcttatctgattgtctaaaacctataacgggtgtaatggtatcgtagtggttggttgagcatcaagtgactcatattttgtcaggtctatgtgtcatcgttaaacttttaacggtcat

SEQ ID NO: 1954 - DNA, 190 bp, Zea mays
  Clone ID: 700089572H1
caatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctcttt

SEQ ID NO: 1955 - DNA, 218 bp, Zea mays
  Clone ID: 700620191H1
ctcagctcccatatccgctcccctacctctccagcatcctcccgtccacgtcgtctcgtctccgctcctcacctcgccagccatgggcaagatcaagatcggaatcaacggtttcggaaggatcggcaggctcttggcaagggtcgccctgcagagcgaggatgtcgagctcgtcgccgtcaacgaccccttcatcaccacggattacatgacgtaca

SEQ ID NO: 1956 - DNA, 187 bp, Zea mays
  Clone ID: 700336318H1
gcaccacaaactgccttgctccccttgctaaggtcattcatgacaacttcggcattgttgagggtttgatgacaactgttcatgccatcactgccacacagaaaactgttgacggaccctcagccaaggactggagaggtggcagggctgccagctttaacatcattcctagcagcaccggtgctgt

SEQ ID NO: 1957 - DNA, 227 bp, Zea mays
  unsure (1)...(227): unsure at all n locations
  Clone ID: 700218257H1
cagaacgctggacggtacgcgtnggcgccaaggccgggntcgctctgaacgaccacttcgtcaggctcgtctcgtggnacganaacgagtggggctacagcaaccgcgtcgtcgacctganccgccacatgttcaagacccagtagaggggttttttccccctgcttctcatggatggttgctgcttgtgtatgcnnagaataaatgtggatngcgcgtgcctctgg

SEQ ID NO: 1958 - DNA, 191 bp, Zea mays
  Clone ID: 700471821H1
gagtggggctacagcaaccgcgtcgtcgacctgatccgccacatgttcaagacccagtagagagagatatttctgcctccctatcgagggtcgtccccgatggcctttggtcgcagacatctttgctgcttgtctatgctgagaataaatgtgaacggtgcccctggacgctggatccatgctggttttgg

SEQ ID NO: 1959 - DNA, 287 bp, Zea mays
  Clone ID: 700335407H1
cgtccacccgtcgtcctcctagctcctctactcgccagtcgccatgggcaagattaagatcggaatcaacggcttcggaaggatcggcagagctcgtgagccagtcgtcgccctccagagcgacgatgtcgagctcgtggccgtcaacgaccccttcatcaccacggactttatgacctacatgttcaagtacgacaccgtccacggccactggaagcacagcgacatcacactcaaggactccaagacccttctcttcggtgacaagccggtcaccgtctttggca

SEQ ID NO: 1960 - DNA, 283 bp, Zea mays
  Clone ID: 700242905H1
cacacacatacgaacacgcgtccgcggacgcgtgggcgaccgtgggtttttttgaaacctcattgtttacattcttaacaaagcacaaaagaactagaactacagtgaattcattacaggacggtagcagataagttaaacacaaaaagacaacgtgtccaaaaccagcatggatccagcgtccaggggcaccgttcacatttattctcagcatagacaagcagcaaagatggtctgcgaccaaaggccattggggacgaccacgatagggaggcagaaatat

SEQ ID NO: 1961 - DNA, 266 bp, Zea mays
  Clone ID: 700333089H1
ctgatccgccacatgaacatcaccaagtaaatgaacaaactgatgaaaacatgcaaagagtgatgaaagcatgcagagagagttgtgtttcttccccggaagtgcttccgagaataaatttttcttatctgattgtctaaaacctataacgggtgtaatggtatcgtagtggttggttgagcatcaagtgactcatattttgtcaggtctatgtgtcatcgttaaacttttaacggtcattatatttcaaaagttttgcattttcc

SEQ ID NO: 1962 - DNA, 236 bp, Zea mays
  Clone ID: 700615210H1
agatcacacacactcgagaactccatttcgatcccatttgaaatcaacccatcctcgtttcctccgtctagcagcctctcaccctcatggccaaagatcaagatcgggatcaatgggtttggcaggatcggaaggctggtggccagggtggccctgcagagcgacgacgtcgagctcgtcgccgtgaacgaccccttcatagcaccgattacatgacctagatgtagaagtatgac

SEQ ID NO: 1963 - DNA, 219 bp, Zea mays
  Clone ID: 700197701H1
gtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgactccttcatcagcaccgactacatgacctacatgttccagtacgacactgtg

SEQ ID NO: 1964 - DNA, 224 bp, Zea mays
  Clone ID: 700017877H1
tttctgcctccctatcgtgggtcgtccccaatggcctttggtcgcagacgatctttgctgcttgtctatgctgagaataaatgtgaacggtgcccctggacgctggatccatgctggttttggacacgttgtctttttgtgtttaacttatctgctaccgtcctgtaacgaattcactaagttctagttcttttgtgctttgttaagaatataaacaatgaggt

SEQ ID NO: 1965 - DNA, 298 bp, Zea mays
  unsure (1)...(298): unsure at all n locations
  Clone ID: 700467503H1
gttcttcctgaattgaatggcaagctcactggcatgtccttccgggttcccaccgtggatgtgtcagttgttgacctcactgttagaatcgagaagggggcctcctacgagganatccaagaaagctattaaaggctgcttctgaggggcccattcaagggtaatcattgggctaacgtggaggaggatctggtttccaccgacttcaccggtgacaagcaggtcgagcatcttcgaggccaaggcggggattgccctgacgaccattcatcaagctcgtctcgtggtacgacaacga

SEQ ID NO: 1966 - DNA, 254 bp, Zea mays
  Clone ID: 700457187H1
atctcgcatatccgctcccctacctctccagcatctaccgtctccgttgtatccgtctctgctcgtcacatcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacataacctacatgttcaagtacgacaccgtgaacggcccatggaacc

SEQ ID NO: 1967 - DNA, 177 bp, Zea mays
  Clone ID: 700381477H1
atttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatca

SEQ ID NO: 1968 - DNA, 179 bp, Zea mays
  Clone ID: 700614350H1
gtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagt

SEQ ID NO: 1969 - DNA, 284 bp, Zea mays
  Clone ID: 700092925H1
ccacgcgtccggattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagaccctttcttcggtgaaaccggtcacgctttggcataggaacctgaggaaatccgtgggtgaggtgcgctgagtatgtcg

SEQ ID NO: 1970 - DNA, 183 bp, Zea mays
  Clone ID: 700016350H1
gcacgaggtatgccgagaataaatgtggatggcgcgtgcctctgggtcgccaggttcatgctgagtctggacatgttttgcacttttgcttcccttcctgctaccatctgtgacagaaccgctcgctaatatgggacctgagattagctttttgctgcttgtggtgaggttgcagttttgttc

SEQ ID NO: 1971 - DNA, 223 bp, Zea mays
  Clone ID: 700019729H1
gcacgaggtatgccgagaataaatgtggatggcgcgtgcctctgggtcgccaggttcatgctgagtctggacatgttttgcacttttgcttcccttcctgctaccatctgtgacagaaccgctcgctaatatgggacctgagattagctttttgctgcttgtggtgaggttgcagttttgttcaaaaaaaaaaaaaaaaaactcgagggggggcccggtaccc

SEQ ID NO: 1972 - DNA, 245 bp, Zea mays
  unsure (1)...(245): unsure at all n locations
  Clone ID: 700167419H1
ggacgctggcggacgcgtgggcgcgacgcgtgngctgctcccatatccactcccctaccagtccagcatccactcgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgac

SEQ ID NO: 1973 - DNA, 172 bp, Zea mays
  Clone ID: 700152703H1
ctagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacgga

SEQ ID NO: 1974 - DNA, 172 bp, Zea mays
  Clone ID: 700449337H1
aagtacacctccgatgttaacattgtttccaatgctagctgcaccacaaactgccttgctccccttgctaaggtcattcatgacaactttggcattattgagggcttgatgacaactgttcatgccatcactgccacccagaagactgttgatggaccctcagccaaggact

SEQ ID NO: 1975 - DNA, 231 bp, Zea mays
  Clone ID: 700151887H1
cggacgcgtgggcggacgcgtgggcggacgcgtgggcggacgcgtgggcggacgcgtgggtgatgagatcaaggctgcggtcatggccgaggcagaaggtagcctcaagggcatcctgggttacgttgaggaggaccttgtttccaccgatttccagggtgacagcaggtctagcatctttgatgctaaggctggcattgccttgaacggcaacttcgtgaagctcgtgtc

SEQ ID NO: 1976 - DNA, 226 bp, Zea mays
  Clone ID: 700578028H1
gctaaaaccctctccaccgtccacctcagctcccatcaccgctcccctacgtctccagcatctcccgcctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcacac

SEQ ID NO: 1977 - DNA, 180 bp, Zea mays
  Clone ID: 700440305H1
agctgagtatgtcgtggagtccaccggtgtcttcactgacaaggacaaggctgctgcatatctgaagggtggtgccaagaaggttgttatctctgccccaagcaaagatgcacccatgtttgttgctggtgtcaatgaggacaagtacacctccgatgttaacattgtttccaatgctag

SEQ ID NO: 1978 - DNA, 236 bp, Zea mays
  Clone ID: 700354945H1
ccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaag

SEQ ID NO: 1979 - DNA, 283 bp, Zea mays
  Clone ID: 700341302H1
ggaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggac

SEQ ID NO: 1980 - DNA, 192 bp, Zea mays
  unsure (1)...(192): unsure at all n locations
  Clone ID: 700026117H1
gcaccacaaactgccttgatccccttnnctaaggtcattcatgacaactttggcattattgagggctgatgacaactgttcatgccatcactgccacccagaagactgttgatggaccctcagccaaggactggagaggtggcagggctgccagctttaacatcattcccagcagcaccggtgctgccaagg

SEQ ID NO: 1981 - DNA, 183 bp, Zea mays
  Clone ID: 700150218H1
gccgggattgccctgaacgacagccttggcagcaccggtgctgccaaggtgtcgtaaggttcttcctgaattgaatggcaagctcactggcatgtccttccgggttcccaccgtggatgtgtcagttgttgacctcactgtcagaatcgagaagggggcctcttacgaggaaatcaagaaagc

SEQ ID NO: 1982 - DNA, 166 bp, Zea mays
  unsure (1)...(166): unsure at all n locations
  Clone ID: 700446832H1
cttgatgacaactgttcatgccatcactgccacccagaagactgttgatggaccctcagccaaggactggagangtggcagggctgncagctttaacatcattcccagcagcaccggtgctgccaaggctgtcggtaaggttcttcctgaattgaatggcangcnc

SEQ ID NO: 1983 - DNA, 169 bp, Zea mays
  Clone ID: 700171562H1
cccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcg

SEQ ID NO: 1984 - DNA, 226 bp, Zea mays
  Clone ID: 700156216H1
ccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcacggactacagaacctacatgttcagtacgacactgtgcacgga

SEQ ID NO: 1985 - DNA, 317 bp, Zea mays
  Clone ID: 700095551H1
gtggatggcgcgtgcctctgggtcgccaggatcatgctgagtctggacatgttttgcacttttgtttcccttcctgctaccatctgtgacagatccgctcgctaatatgggacctgagattagctttttgctgcttgtggtgaggttgcagttttgttctgtgtttctgtgttgttagtactcctatgatttaggccttgttccaatctcgcgagataaactttagcagctattttttagctacttttagccatttataatctaaacatgagagctaatggtgataaaaaaaaaaaaaaaaaaaaagggcggccgct

SEQ ID NO: 1986 - DNA, 159 bp, Zea mays
  Clone ID: 701165479H1
gacaactgttcatgccatcactgccacccagaagactgttgatggaccctcagccaaggactggagaggtggcagggctgccagctttaacatcattcccagcagcaccggtgctgccaaggctgtcggtaaggttcttcctgaattgaatggcaagct

SEQ ID NO: 1987 - DNA, 224 bp, Zea mays
  unsure (1)...(224): unsure at all n locations
  Clone ID: 700151917H1
cggacgcgtggccgtcatcgatctcgtttcaaatccatccatcctcgtttcctccgtcccgcagcatcacaaccccatggccaagatcaagatcgggatcaatgggttcggcaggatcggaaggctggtggccagggtggccctgcagagtgacgatgtcgagctcgtcgccgtgaacgacnccttcatcagcaccgactacatgacctacatgtccagtacga

SEQ ID NO: 1988 - DNA, 153 bp, Zea mays
  Clone ID: 700153313H1
ccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcga

SEQ ID NO: 1989 - DNA, 178 bp, Zea mays
  unsure (1)...(178): unsure at all n locations
  Clone ID: 700204963H1
atcctatcgagggtcgtcncaatggcctttggtcgcagacaactttgctgcttgtctatgctgagaataaatgtgaacggtgcccctggacgctggatccatgctggttttggacacggttgtctttttgtgttttaacttatatgctgccgtcctgtaacgaattcgcaagttttag

SEQ ID NO: 1990 - DNA, 187 bp, Zea mays
  Clone ID: 700450961H1
cgcctctcgagtctcgtccacccgtcgtcctcctagctcctctactcgccagtcgccatgggcaagattaagatcggaatcaacgcttcggaaggatcggcaggctcgtggccagggtcgccctccagagcgaggatgtcgagctcgtcgccgtcaacgaccccttcatcaccacggactacatgac

SEQ ID NO: 1991 - DNA, 280 bp, Zea mays
  unsure (1)...(280): unsure at all n locations
  Clone ID: 700434230H1
agggcttgatgacaacngttcatgccatcactgccanccagaatactgttgatgnaccctcagccaaggactggagaggttgcagggctgccagcannaacatcattcccagcagcaccggtgctgccaaggctgtcggtaaggttcttcctgaattgaatggnatgntcntggttgttncttngggtctncnacngttgatgtntcagtngttgacctcanngtcnaggtcgggnggntcgtntttgggtgtaaganatngattatggctgcttcnttg

SEQ ID NO: 1992 - DNA, 215 bp, Zea mays
  Clone ID: 700265994H1
ctctcgagtctcgtccacccgtcatcctcctagctcctctactcgccagtcgccatgggcaagattaagatcggaatcaacggcttcggaaggatcggcaggctcgtggcaagggtcgccttcaagagcgaggatgtcgagctcgtggcggtcaaggaccccttcatcacaagggactacatgacctaaatgttcaggtaggaaacggtcaaggg

SEQ ID NO: 1993 - DNA, 150 bp, Zea mays
  unsure (1)...(150): unsure at all n locations
  Clone ID: 700090231H1
atttcgatctcatttgaaatcaacccatcctcgtttcctccgtctagcagcctctcaccctcatggccaagatcaagatcgggatcaatgggtttggcaggatcggaaggctggtggccagggagngcctgcagagcgacgacgtcgagc

SEQ ID NO: 1994 - DNA, 287 bp, Zea mays
  Clone ID: 700073935H1
cccacgcgtccgaacaaaactaggttccgtggcgtcgggtgggaccagcaagcagccgccgcagccggcccccaggcgcctctatatacggcactccgactccgatacattggcgacatcacagatcacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacg

SEQ ID NO: 1995 - DNA, 153 bp, Zea mays
  Clone ID: 700084392H1
cattcctagcagcaccggtgctgccaaggctgttggtaaagttcttcctgatctgaatggcaagctcactggtatgtccttccgtgttcctactgtggatgtctcggttgttgacctcaccgtcagaatcgagaagggggcctcctatgagga

SEQ ID NO: 1996 - DNA, 250 bp, Zea mays
  Clone ID: 700382560H1
ccgtcatcgatctcgtttcacatccatccatcctcgtttcactccgtcccgcaacatctcaaccccatggcaaagatcaagatcgggatcaatgggtatcagcaggatcttaaggctgcttgccatcatagccctgcagtctgacgatgtctagctcgtcaccgtgaacgagcccttcatcagcaccgactacatgacctacatgttcaagtacgacactgtgcacggacaatagacagaccatgtagtc

SEQ ID NO: 1997 - DNA, 215 bp, Zea mays
  unsure (1)...(215): unsure at all n locations
  Clone ID: 700257449H2
cctcagctcccatatccgctcccctanctctccagcatctcccgtctccgtcgtctcgtctctgntcctcacctcgccgccagccatgggcaagatcaagatcggaatcaacggtttcggaaggatcggcaggctcgtagccagggtcgccctgcagagcgaggatgtcgagctcgtcgccgtcaacgancccttcatcaccacggattacatga

SEQ ID NO: 1998 - DNA, 145 bp, Zea mays
  Clone ID: 700210766H1
gctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgagga

SEQ ID NO: 1999 - DNA, 158 bp, Zea mays
  Clone ID: 700427913H1
cgcgtgcctctgggtcgccaggttcatgctgagtctggacatgttttgcacttttgcttcccttcctgctaccatctgtgacagaaccgctcgctaatatgggacctgagattagctttttgctgcttgtggtgaggttgcagttttgttctgtgttt

SEQ ID NO: 2000 - DNA, 328 bp, Zea mays
  Clone ID: 700351216H1
cttacgagtctgcaacttcggctccagctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgag

SEQ ID NO: 2001 - DNA, 258 bp, Zea mays
  Clone ID: 700806073H1
ctcgagccgttcgatcccatttgaaatcaacccatcctcgtttcctccgtctagcagcctctcaccctcatggccaagatcaagatcgggatcaatgggtttggcaggatcggaacgctggtggccagggtggccctgcagatcgacgacgtcgagctcgtcgccgtgaacgaccccttcatcagcaccgattacatgacctacatgttcaagtatgacactgtgcacggacagtggaagcaccatgaggtcaaggtg

SEQ ID NO: 2002 - DNA, 164 bp, Zea mays
  unsure (1)...(164): unsure at all n locations
  Clone ID: 700207249H1
ctcatatccgctcncctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgag

SEQ ID NO: 2003 - DNA, 180 bp, Zea mays
  Clone ID: 700261719H1
ggccaatggaagcacagcgacatcgccctcaaggacaccaagacgcttctcttcggcgagaagccggtcaccgtctttggcatcaggaacaccgaggagatcccgtggggtgaggctggtgctgagtatgtcgtggagtccaccggtgtcttcactgacaaggacaaggctgctgcacat

SEQ ID NO: 2004 - DNA, 171 bp, Zea mays
  unsure (1)...(171): unsure at all n locations
  Clone ID: 700430989H1
cactgccacccagaaaactgttgancggacccttcagccaaggacggagaggtggcagggctgccagctttaacatcattcctagcagcaccggtgctgccaaggctgttggtaaagttcttcctgatctgcacggcaagctcactggtatgtccttccgtgttcctactg

SEQ ID NO: 2005 - DNA, 183 bp, Zea mays
  Clone ID: 700807308H1
ccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgacgccgtcatcagca

SEQ ID NO: 2006 - DNA, 144 bp, Zea mays
  Clone ID: 700334327H1
gcaaagatgcacccatgtttgttgttggtgtcaatgaggacaagtacacctccgatgttaacattgtttccaatgctagctgcaccacaaactgccttgctccccttgctaaggtcattcatgacaactttggcattattgagg

SEQ ID NO: 2007 - DNA, 221 bp, Zea mays
  Clone ID: 700172805H1
ggagctgcggacgctggcggaccgtggcagctcccatatactctcccctaactctccagcaagttcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtaaacgaccctttaata

SEQ ID NO: 2008 - DNA, 177 bp, Zea mays
  Clone ID: 700422633H1
caccggtgacagcaggtcgagcatcttcgacgccaaggccgggattgccctgaacgaccacttcatcaagctcgtctctggtacgacaacgagtggggctacagcaaccgcgtcgtcgacctgatccgccacatgttcaagacccagtagagagagatatttctgcctccctatcgt

SEQ ID NO: 2009 - DNA, 182 bp, Zea mays
  Clone ID: 700353962H1
ctcgagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagctacgacgtctagctcgtcgccgtgaagagcccg

SEQ ID NO: 2010 - DNA, 130 bp, Zea mays
  Clone ID: 701161133H1
gtcgtccccgatggcctttggtcgcagaccatctttgctgcttgtctatgctgagaataaatgtgaacggtgcccctggacgctggatccatgctggttttggacacggttgtctttttgtgtttaactt

SEQ ID NO: 2011 - DNA, 222 bp, Zea mays
  Clone ID: 700802550H1
gcatgctttcatcactctttgcatgcagagagagttgtgtttcttccccggaagtgcttccgagaataaatttttcttatctgattgtctaaaacctataacgggtgtaatggtatcgtagtggttggttgagcatcaagtgactcatattttgtcaggtctatgtgtcatcgttaaacttttaacggtcattatatttcaaaagttttgcattttccactc

SEQ ID NO: 2012 - DNA, 139 bp, Zea mays
  Clone ID: 700440239H1
ctagctcctctactcgccagtcgccatgggcaagattaagatcggaatcaacggcttcggaaggatcggcaggctcgtggccagggtcgtcctccagagcgaggatgtcgagctcgtcgccgtcaacgaccccttcatc

SEQ ID NO: 2013 - DNA, 181 bp, Zea mays
  Clone ID: 700454565H1
ccacgccgccagccatgggcaagatcaagatcggaatcaacggtttcggaaggatcggcaggctcgtggccaaggtcgccctgcagagcgaggatgtcgagctcgtcgccgtcaacgaccccttcatcaccacggattccatgacctacatgttcaagtacgacaccgagcacggccatgg

SEQ ID NO: 2014 - DNA, 127 bp, Zea mays
  Clone ID: 700053528H1
gaaggttgttatctctgccccaagcaaagatgcacccatgtttgttgttggtgtcaatgaggacaagtacacctcggatgttaacattgtttccaatgctagctgcaccacaaactgccttgctccc

SEQ ID NO: 2015 - DNA, 163 bp, Zea mays
  Clone ID: 700257743H1
acgacgccttcatcacgacggattacatgatctacatgttcaagtacgacaccgtgcacggccaatggaagcacagcgacatcattctcaaggactccaagacgcttctcttcggcgagaagccggtcaccgtctttggcatcaggaacttcgaggagatccc

SEQ ID NO: 2016 - DNA, 134 bp, Zea mays
  Clone ID: 700072283H1
cacacactcgagaactccatttcgatcccatttgaaatcaacccatcctcgtttcctccgtctagcagcctctcaccctcatggccaagatcaagatcgggatcaatgggtttggcaggatcggaaggctggtg

SEQ ID NO: 2017 - DNA, 116 bp, Zea mays
  Clone ID: 700260796H1
tacatgttcaagtacgacaccgtccacagccactggaagcacagcgacatcacactcaaggactccaagacccttctcttcggtgacaagccggtcaccgtctttggcatcaggaa

SEQ ID NO: 2018 - DNA, 160 bp, Zea mays
  Clone ID: 700262496H1
ctcccatatccgctcccctacctctccagcatctcccgtctccgacgtctcgtctctgctcctcacctcgccgccagccatgggcaagatcaagatcggaatcaacggtttcggaaggatcggcaggctcgtggccagggtcgccctgcagagcgaggat

SEQ ID NO: 2019 - DNA, 121 bp, Zea mays
  Clone ID: 700155358H1
gatcggaatcaacggtttcggaaggatcggcaggctcgtggccagggtcgccctgcagagcgaggatgtcgagctcgtcgccgtcaacgaccccttcatcaccacggattacatgacgtac

SEQ ID NO: 2020 - DNA, 120 bp, Zea mays
  Clone ID: 700196762H1
caagaaggttgtcatttctgctcctagcaaggatgcccccatgttcgttgttggtgtcaacgagaaggagtacaagtctgacatcaacattgtctctaatgctagctgcacaaccaactg

SEQ ID NO: 2021 - DNA, 131 bp, Zea mays
  Clone ID: 700450601H1
caagaaagctattaaggctgcttccgagggtccactcaagggtatcatgggttatgtggaagaggatctggtttctaccgacttccttggtgacagcaggtcgagcatcttcgacgccaaggccgggatct

SEQ ID NO: 2022 - DNA, 126 bp, Zea mays
  Clone ID: 700581050H1
tggaagaggatctggtttctaccgacttccttggtgacagcaggtcgagcatcttcgacgccaaggccgggatcgctctgaacgaccacttcgtcaagctcgtctcgtggtacgacaacgagtggg

SEQ ID NO: 2023 - DNA, 209 bp, Zea mays
  Clone ID: 700072316H2
caaatccatccatcctcgtttcctccgtcccgcagcatctcaaccccatggccaagatcaagatcgggatcaatgggttcggcaggatcggaaggctggtggccagggtggcctgcagagtgacgatgtcgagctcacgccgtgaacgacccttcatcagaccgactacatgcctacattacaagtacgacactgtgcaggatagggag

SEQ ID NO: 2024 - DNA, 138 bp, Zea mays
  Clone ID: 700427659H1
aattgattcttttaataaccactcaatttatttctaaaccaatgtctgaaggttataagcactccttgttcgattaatcgccactaccacatgttcagtgtctatgtttggtaatgcttgccgttgattacaggactg

SEQ ID NO: 2025 - DNA, 180 bp, Zea mays
  Clone ID: 700356507H1
aaccccgtcatcgatctcgtttcaaatccatccatcctcgtttcctccgtcccgcagcatctcaaacccatggccaagatcaagatcgggatcaatgggttcggcaggatcggaaggctggtggccagggtggccctgcagagtgacgatgtcgacctcgtcgccgtgaacgacccttca

SEQ ID NO: 2026 - DNA, 206 bp, Zea mays
  unsure (1)...(206): unsure at all n locations
  Clone ID: 700169472H1
gtttcttccccggaagtgcttccgagaataaatttttcttatctgattgtctaaaacctataattggtgtaatggtatcgtagtggttggttgagcattgagtgactcatattttgtcaggtctatgtgttatcgttaaacttttaacggtcattctatttcaaaagttttgcattttgcanaaaaaaaaaaaaagggcggccgct

SEQ ID NO: 2027 - DNA, 115 bp, Zea mays
  unsure (1)...(115): unsure at all n locations
  Clone ID: 700377362H1
gtgaagcttgtgtcctggtacgacaacgagtggggatacagcacccgagtggtcgacctgatccgccacatgaacatcaccaagtaaatgaacaaactgatgaaaacatgcaang

SEQ ID NO: 2028 - DNA, 129 bp, Zea mays
  Clone ID: 700378460H1
accggtgacagcaggtcgagcatcttcgacgccaaggccgggattgccctgaacgaccacttcatcaagctcgtctcttggtacgacaacgagtggggctacagcaaccgcgtcgtcgacctgatccgc

SEQ ID NO: 2029 - DNA, 122 bp, Zea mays
  Clone ID: 700440218H1
ccgcctctcgagtctcgtccacccgtcgtcctcctagctcctctactcgccagtcgccatgggcaagattaagatcggaatcaacggcttcggaaggatcggcaggctcgtggcaagggtcg

SEQ ID NO: 2030 - DNA, 117 bp, Zea mays
  Clone ID: 700440230H1
ctcgagtctcgtccacccgtcgtcctcctagctcctctattcgccagtcgccatgggcaagattaagatcggaatcaacggcttcggaaggatcggcaggctcgtggccacggtcgc

SEQ ID NO: 2031 - DNA, 116 bp, Zea mays
  Clone ID: 700072350H1
cacacactcgagaactccatttcgatctcatttgaaatcaacccatcctcgtttcctccgtctagcagcctctcaccctcatggccaagatcaagatcgggatcaatgggtttggc

SEQ ID NO: 2032 - DNA, 119 bp, Zea mays
  Clone ID: 700241920H1
cggacgcgtgggcaagaaggttgttatctctgccccaagcaaagacgcacccatgtttgttgttggtgtcatatgaggacaagtacacctcggatgttaacattgtttccaatgctagc

SEQ ID NO: 2033 - DNA, 163 bp, Zea mays
  Clone ID: 700347048H1
cccgtcatcgatctcgtttcaaatccatccatcctcgtttcctccgtcccgcagcatctcaaccccatggccaagatcaagatcgggatcaatgggttcggcaggatcggaaagctggtggccagggtggccctgcagagtgacgatgtcgaactcgtcgccg

SEQ ID NO: 2034 - DNA, 222 bp, Zea mays; identical to SEQ ID NO: 2011
  Clone ID: 700802555H1

SEQ ID NO: 2035 - DNA, 204 bp, Zea mays
  Clone ID: 700615893H1
tgtgtttcttccccggaagtgcttccgagaataaatttttcttatctgattgtctaaaacctataacgggtgtaatggtatcgtagtggttggttgagcatcaagtgactcatattttgtcaggtctatgtgtcatcgttaaacttttaacggtcattatatttcaaaagtttgcattttccaaaaaaaaaaaaaagggcggcc

SEQ ID NO: 2036 - DNA, 135 bp, Zea mays
  Clone ID: 700257073H1
ctcgagccgagcacagcgacatcaccctcaaggactccaagacgctattctatcggcgagacccggtcaccgtctttggcatcaggaactccgaggagatcccgtggggtgaggctggtgctgagtatgtcgtgg

SEQ ID NO: 2037 - DNA, 246 bp, Zea mays
  Clone ID: 700220433H1
ccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgacgccttcatcagcagcggctacatgacctagatgttcaagtacgacactgtgcacggacaatggagacaccatgaag

SEQ ID NO: 2038 - DNA, 92 bp, Zea mays
  Clone ID: 700073453H1
ccacgcgtccgcgagaactccatttcgatctcatttgaaatcaacccatcctcgtttcctccgtctagcagcctctcaccctcatggccaag

SEQ ID NO: 2039 - DNA, 102 bp, Zea mays
  unsure (1)...(102): unsure at all n locations
  Clone ID: 700086779H1
tgctccccttgctaaggtcattcatgacaactttggcattattganggcntgatgacaactgttcatgccatcactgccacccagaagactgangatggacc

SEQ ID NO: 2040 - DNA, 195 bp, Zea mays
  Clone ID: 700621224H1
caacgagtggggctacagcgaccgcgtcgtcgacctgatccgccacatgttcaagactctcttagctacagatatgtctgcctccctatcgtgggtcgtccccaatgctctttggtcgcttgcatctttgctgcttgtctatgctgtgactaaatgtgaacggtgcccctggacgctggatccatgctggttttg

SEQ ID NO: 2041 - DNA, 95 bp, Zea mays
  Clone ID: 700344636H1
gttcatgctgagtctggacatgttttgcacttttgtttcccttcctgctaccatctgtgacagatccgctcgctaatatgggacctgagattagc

SEQ ID NO: 2042 - DNA, 132 bp, Zea mays
  Clone ID: 700240570H1
cccacgcgtccgcacacgcgtccgctcccatatccgctcccctacctctccagcatcctcccgtctccgtagtctcgtctccgctcctcacctcgccagccatgggcaagatcaagatcggaatcaacggtt

SEQ ID NO: 2043 - DNA, 123 bp, Zea mays
  unsure (1)...(123): unsure at all n locations
  Clone ID: 700349592H1
gttgatctgacngttaggcttgagaagnctgccacctaatgatnagatcaaggctgcggtcaaggccgaggcananggnagcctcaagggcanncngggttatgtcgagcnggaccangnnnc

SEQ ID NO: 2044 - DNA, 147 bp, Zea mays
  unsure (1)...(147): unsure at all n locations
  Clone ID: 700454979H1
gttgacggaccctcagccaacnnttttcnngntggcagtgatgggcatgaacagtgnnatcactgccacccancnaacngttgacggaccctcagccaaggactggagaggtggcagggctgccagctttaacatcattcctagcag

SEQ ID NO: 2045 - DNA, 141 bp, Zea mays
  Clone ID: 700206008H1
gcctctcgagtctcgtccacccgtcatcctcctagctcctctactcgacagtcgccatgggcaagattaagatcggaatcaacggcttcggaaggatcggcaggctcgtggccagggtcgccctccagagcgaggatgtcg

SEQ ID NO: 2046 - DNA, 93 bp, Zea mays
  Clone ID: 700263545H1
ggatggcgctgagtatatcgtggagaccaccggcgtcttcactgacaaggacaaggctgctgcacatctcaagggtggtgccaagaaggttgt

SEQ ID NO: 2047 - DNA, 117 bp, Zea mays
  Clone ID: 700802094H1
ctcgagaactccatttcgatcccatttgaaatcaacccatcctcgtttcctccgtctagcagctctcaccctcatgggccagatcaagatcggggatcaatggggttggcaggatcg

SEQ ID NO: 2048 - DNA, 105 bp, Zea mays
  Clone ID: 700206976H1
gtcatcgatctcgtttcaaatccatccatcctcgtttcctccgtcccgcagcatctcaaccccatggacaagatcaagatcgggatcaatgggttcggcaggatc

SEQ ID NO: 2049 - DNA, 172 bp, Zea mays
  Clone ID: 700799153H1
cggtcgaaccgagcgaaatttttcttatctgattgtctaagacctataacgggtgtaatggtatcacagtggttggttgagcatcaagtgactcatattttgtcaggtctatgtgtcatcgttaaacttttaacggtcattatatttcaaaagttttgcatttccactaaaa

SEQ ID NO: 2050 - DNA, 177 bp, Zea mays
  Clone ID: 700456230H1
ttcccatatccgctcccctacctctccagccatctcccgtactaccgtacgactcgtctctagcacctacacctacgccgccagccatggcccgcatcaagctcggacatcacggtttcggaaggatcggcaggctcgtggccagggtcgccctgcagagcgaggatgtcgagctcg

SEQ ID NO: 2051 - DNA, 97 bp, Zea mays
  Clone ID: 700354919H1
agcaagctcactggcatgtccttccgggttcccaccgtggatgtgtcagttgttgacctcactgtcagaatcgagaagggggcctcttacgaggaaa

SEQ ID NO: 2052 - DNA, 104 bp, Zea mays
  Clone ID: 700614147H1
ctccgcctctcgagtctcgtccacacgtcatcctcctagctcctctactcgccagtcgccatgggcaagattaagatcggaatcaacggcttcggaaggatcgg

SEQ ID NO: 2053 - DNA, 153 bp, Zea mays
  Clone ID: 701181137H1
cacctcaccacaagcagcaaaaagctaatctcaggtcccatattagcgagcggttctgtcacagatggtagaaaaaaaaaaaaaaaaaaaaaaaaaaaaaaaaaaaaaaaaaaaaaaaaaaaaaaaaaaaaaaaaaaaaaaaagaaaaggggg

SEQ ID NO: 2054 - DNA, 55 bp, Zea mays
  Clone ID: 700458047H1
gccagggtcgccctgcagagcgaggatgtcgagctcgtcgccgtcaacgacccct

SEQ ID NO: 2055 - DNA, 91 bp, Zea mays
  Clone ID: 700807468H1
cacagatcacacacactcgagaactccatttcgatctcatttgagatcaacccatcctcgtttcctccgtctagcagcgtctcaccctcat

SEQ ID NO: 2056 - DNA, 322 bp, Zea mays
  Clone ID: 700212510H1
gccgccgcgctcaacatcgtgcccacgtccaccggcgccgccaaggccgtctcgctggtgctccccaacctcaagggcaagctcaacgggatcgcgctccgggtgcccaccccgaacgtctccgtcgtcgacctcgtcgtgcaggtctccaagaagaccctcgccgaggaggtgaaccaggcgttccgcgacgccgcggccaacgagctcacgggcatcctcgaggtctgcgacgtgccgctcgtgtccgtcgacttcaggtgctccgacgtctcctccaccatcgacgcctccctcaccatggtcatgggcgacgacatgg

SEQ ID NO: 2057 - DNA, 332 bp, Zea mays
  unsure (1)...(332): unsure at all n locations
  Clone ID: 700097780H1
cgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgnaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctc

SEQ ID NO: 2058 - DNA, 310 bp, Zea mays
  Clone ID: 700101968H1
ggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgtaaggtggccatcaatgggttcggccgcatcgggcgcaacttcctgcggtgctggcacgggcgcggcgacgcctcggccctcgacgtcatcgccatcaacgaa

SEQ ID NO: 2059 - DNA, 308 bp, Zea mays
  Clone ID: 700099736H1
ctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgtaaggtggccatcaatgggttcggccgcatcgggcgcaacttcctgcggtgctggcacgggcgcggcgacgcctcgcccctcgacgtcatcg

SEQ ID NO: 2060 - DNA, 315 bp, Zea mays
  unsure (1)...(315): unsure at all n locations
  Clone ID: 700096850H1
cgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgnaaggtggccatcaacgggttcggccgcatcgggcgcaacttcctgcggtgctggcacgggcgcggcgacgctcgcccctcgacgtcatcgccatcaacgacaccggcggtgtcaagca

SEQ ID NO: 2061 - DNA, 307 bp, Zea mays
  Clone ID: 700101454H1
tggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagctgcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaa

SEQ ID NO: 2062 - DNA, 302 bp, Zea mays
  Clone ID: 700092378H1
atggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgaaggtggccatcaatgggttcggccgcatcgggcgcaacttcctgcggtgctggcacgggcgcggcgaccctcgcccctcgacgtcatcgccatcaacg

SEQ ID NO: 2063 - DNA, 301 bp, Zea mays
  Clone ID: 700099257H1
cggcgtcttcgtcgaccgcgagggcgcggggaagcacatccaggcgggggccaagaaggtgctcatcacggcgcccggcaagggcgacatccccacctacgtcgtcggcgttaatgccgaccagtacaaccccgacgagcccatcatcagcaacgcctcctgcaccaccaactgcctcgcgccattcgtcaaggtcctcgaccaaaagttcggcatcatcaagggcaccatgaccaccacccactcctacaccggcgaccagaggctgctggacgcgagccaccgcgacctgcgccgcgcc

SEQ ID NO: 2064 - DNA, 297 bp, Zea mays
  Clone ID: 700209837H1
gtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgctcgcccctcgacgtca

SEQ ID NO: 2065 - DNA, 311 bp, Zea mays
  Clone ID: 700097148H1
tgatcctctggtccgtcgccatggcgtcgtccatgctctccgctaccaccgtgccactccagcaggggggcggcctgtccgagttctccgggctcaggagctccgcctcgctgcccatgcgccggactgccacctccgacgacttcatgtccgccgtctccttcaggacccacgcggtcggcacgagccgcgggccgcggcgggcgccgacggaggcgaacgtgaaggtggccatcaatgggttcggccgcatcgggcgcaacttcctgcggtgctggcacgggcgcggcgacgcctcgccactcgacgtc

SEQ ID NO: 2066 - DNA, 300 bp, Zea mays
  Clone ID: 700100043H1
ccatgctctccgctaccaccgtgccactccagcgggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgcaaggtggccatcaacgggttcggccgcatcgggcgcaacttcctgcggtgctggcacgggcgcggcgacgcctcgcccctcgacgtcatcgccatcaacgacaccg

SEQ ID NO: 2067 - DNA, 308 bp, Zea mays
  Clone ID: 700099516H1
ctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgaaggtggccatcaacgggttcggccgcatcgggcggaagttcctgcggtgctggcacggtcgcagcgacgcctcggccctcgacgtcatc

SEQ ID NO: 2068 - DNA, 305 bp, Zea mays
  unsure (1)...(305): unsure at all n locations
  Clone ID: 700097454H1
cccacgcgtccgctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgnaaggtggccatcaacgggttcggccgcatcgggcgcaacttcctgcggtgctggcacgggcgcggcgaccctcg

SEQ ID NO: 2069 - DNA, 307 bp, Zea mays
  unsure (1)...(307): unsure at all n locations
  Clone ID: 700099582H1
cgctaccaccgtgccactccagcaggggggcggcctgtccgagttctccgggctcaggagctccgcgtcgctgcccatgcgccggaatgccacctccgacgacttcatgtccgccgtctccttcaggacccacgctgtcggcacgagcggcgggccgcggcgggcgccgacggaggcgaactgnaaggtggccatcaatgggttcggccgcatcgggcgcaacttcctgcggtgctggcacgggcgcggcgacgcctcgcccctcgacgtcatcgccatcaacgacaccggatgcgtcaagcaggcg

SEQ ID NO: 2070 - DNA, 292 bp, Zea mays
  Clone ID: 700101028H1
tggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgctgcgggcgccgacggaggcgaactcgaaggtggccatcaatgggttcggccgcatcgggcgcaacttcctgcggtgctggcacgggcgcggcgacgctcgcccctcgacgtcatc

SEQ ID NO: 2071 - DNA, 286 bp, Zea mays
  Clone ID: 700101288H1
gcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgaaggtggccatcaatgggttcggccgcatcgggcgcaacttcctgcggtgctggcacgggcgcggcgacgcctcgcccctcgacgt

SEQ ID NO: 2072 - DNA, 301 bp, Zea mays
  Clone ID: 700098981H1
cccacgcgtccggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgtaaggtggccatcaacgggttcggccgcatcgggcgcaacttcctgcggtgctggcacgggcgcggcgacgcctcg

SEQ ID NO: 2073 - DNA, 284 bp, Zea mays
  Clone ID: 700053377H1
ggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatcaaggtcgtgtccgaccgcaaccccagcaacctgccgtggggcgagctcggcatcgacctcgtcatcgagggcaccggcgtcttcgtcgaccgcgagggcgcggggaagcacatccag

SEQ ID NO: 2074 - DNA, 298 bp, Zea mays
  unsure (1)...(298): unsure at all n locations
  Clone ID: 700101538H1
cccacgcgtccggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgnaaggtggccatcaacgggttcggccgcatcgggcgcaacttcctgcggtgctggcacgggcgcggcgacgcctcgccctcgacgt

SEQ ID NO: 2075 - DNA, 303 bp, Zea mays
  Clone ID: 700093413H1
ctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgaccctcgcccctcgacg

SEQ ID NO: 2076 - DNA, 305 bp, Zea mays
  Clone ID: 700098960H1
gtcaagcaggcgtcccacctgctcaagtacgactccacgctcggcatcttcgatgcgacgtcaagcccgtcggcgacaacgccatctccgtcgacggcaaggtcatcaaggtcgtgtccgaccgcaaccccagcaacctgccgtggggcgagctcggcatcgacctcgtcatcgagggcaccggcgtcttcgtcgaccgcgcaggcgcggggaagcacatccaggcgggggccaagaaggtgctcatcacggcgcccggcaaggggacatccccacctacgtcgtcggcgttaatgccgaccagt

SEQ ID NO: 2077 - DNA, 277 bp, Zea mays
  unsure (1)...(277): unsure at all n locations
  Clone ID: 700212674H1
tggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgnaaggtggccatcaatgggttcggccgcatcgggcgcaacttcctgcggtgctggcacgggcgcggcgacgctcg

SEQ ID NO: 2078 - DNA, 299 bp, Zea mays
  Clone ID: 700098986H1
tcgccatcaacgacaccggaggcgtcaagcaggcgtcccacctgctcaagtacgactccacgctcggcatcttcgatgcgacgtcaagcccgtcggcgacaacgccatctccgtcgacggcaaggtcatcaaggtcgtgtccgaccgcaaccccagcaacctgccgtggggcgagctcggcatcgacctcgtcatcgagggcaccggcgtcttcgtcgaacgcgagggcgcggggaagcacatccagtcgggggccaagaaggtgctcatcacggcgcccggcaagggcgacatcccca

SEQ ID NO: 2079 - DNA, 299 bp, Zea mays
  Clone ID: 700099244H1
cccacgcgtccgcccacgcgtccgccatggcgtcgtccatgctctccgctaccaccgtgccactccagcaggggggcggcctgtccgagttctccgggctcaagagctccgcgtcgctgcccatgctccggaatgccacctccgacgacttcatgtccgccgtctccttcaggacccacgcggtcggcacgagcggcgggtcgcggcgggcgccgacggaggcgaactgtaaggtggccatcaacgggttcggccgcatcgggcgcaacttcctgcggtgctggcacgggcgcggcgac

SEQ ID NO: 2080 - DNA, 291 bp, Zea mays
  Clone ID: 700100392H1
ctctggtccgtggccatggcgtcgtccatgctctccgctaccaccgtgccactccagcaggggggcggcctgtccgagttctccgggctcaggagctccgcgtcgctgcccatgcgccggaacgccacctccgacgacttcatgtccgccgtctccttcaggacccacgcggtcggcacgagcggcgggccgcggcgggcgccgacggaggcgaacctgcaggtggccatcaatgggttcggccgcatcgggcgcaacttcctgcggtgctggcacgggcgcggcgacgcc

SEQ ID NO: 2081 - DNA, 275 bp, Zea mays
  Clone ID: 700044021H1
gcccgtcggcgacaacgccatctccgtcgacggcaaggtcatcaaggtcgtgtccgaccgcaaccccagcaacctgccgtggggcgagctcggcatcgacctcgtcatcgagggcaccggcgtcttcgtcgaccgctatggcgcggggaagcacatccaggcgggggccaagaaggtgctcatcacggcgcccggcaagggcgacatccccacctacgtcgtcggcgtcaatgccgaccagtacaaccccgacgagcccatcatcagcaacgcct

SEQ ID NO: 2082 - DNA, 281 bp, Zea mays
  Clone ID: 700043432H1
tggcgtcgtccatgctctccgctaccaccgtgccactccagcaggggggcggcctgtccgagttctccgggctcaggagctccgcgtcgctgccgatgcgccggaatgccacctccgacgacttcatgtctgccgtctccttcagaacccacgcggtcggcacgagcggcgggccgcggcgggcgccgacggaggcgaacctgaaggtggccatcaatgggttcggccgcatcgggcgcaacttcctgcggtgctggcacgggcgcggcgacgcctcaccc

SEQ ID NO: 2083 - DNA, 272 bp, Zea mays
  Clone ID: 700045175H1
ggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaacttgaaggtggccatcaacgggttcggccgcatcgggcgcaacttcctgcggtgctggcacgggcgcggcgacg

SEQ ID NO: 2084 - DNA, 298 bp, Zea mays
  Clone ID: 700099592H1
cggacgcgtgggcgtggtccgtggccatggcgtcgtccatgctctccgctaccaccgtgccactccagcaggggggcggcctgtccgagttctccgggctcaggagcaccgcgtcgctgcccatgcgccggaatgccacctccgacgacttcatgtccgccgtctcgttcaggacccacgcggtcggcacgagcggcgggtcgcggcgggcgccgacggaggcgaagctgaaggtggccatcaacgggttcggccgcatcgggcgcaacttcgctgggtgctggcacgggcgcggcga

SEQ ID NO: 2085 - DNA, 284 bp, Zea mays
  Clone ID: 700101559H1
cacgcggtcggcacgagcggcgggtcgcggcgggcgccgacggaggcgaactcgaaggtggccatcaacgggttcggccgcatcgggcgcaacttcctgcagtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctccgtcgacggcaaggtcatcaaggtcgtgtc

SEQ ID NO: 2086 - DNA, 280 bp, Zea mays
  Clone ID: 700045717H1
tggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctccgtcgacggcaaggtcatcaaggtcgtgtccgaccgcaaccccagcaacctgccgtggggcgagctcggcatcgacctcgtcatcgtgggcaccggcgtcttcgtcgacc

SEQ ID NO: 2087 - DNA, 276 bp, Zea mays
  Clone ID: 700100711H1
gggtccgtggccatggcgacgtccaagctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcgtcgggcgccgacggaggcgaagctgaaggtggccatcaatgggttcggccgcatcgggcgcaacttcctgcggtgctggcacggg

SEQ ID NO: 2088 - DNA, 300 bp, Zea mays
  Clone ID: 700098021H1
ccttcaggacccacgcggtcggcacgagcggcgggccgcggcgggcgccgacggaggcgaactgaaggtggccatcaatgggttcggccgcatcgggcgcaacttcctgcagtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatcaaggtcgtgtccgaccg

SEQ ID NO: 2089 - DNA, 274 bp, Zea mays
  unsure (1)...(274): unsure at all n locations
  Clone ID: 700044254H1
ancgcctcctgcaccaccaactgcctcgcgccattcgtcaaggtgctcgaccaaaagttcggcatcatcaagggcaccatgaccaccacccactcctacaccggcgaccagaggctgctggacgcgagccaccgcgacctgcgccgcgcccgcgccgccgcgctcaacatcgtgcccacgtccaccggcgccgccaaggccgtctcgctggtgctccccaacctcaagggcaagctcaacgggatcgcgctccgggtgcccaccccgaacgtct

SEQ ID NO: 2090 - DNA, 276 bp, Zea mays
  Clone ID: 700041717H1
ctctggtccgtggccatggcgtcgtccatgctctccgctaccaccgtgccactccagcaggggggcggcctgtccgagttctccgggctcaggagctccgcgtcgctgccgatgcgccggaatgccacctccgacgacttcatgtctgccgtctccttcagaacccacgcggtcggcacgagcggcgggccgcggcgggcgccgacggaggcgaactgcaaggtggccatcaatgggttcggccgcatcgggcgcaacttcctgcggtgctggcac

SEQ ID NO: 2091 - DNA, 267 bp, Zea mays
  Clone ID: 700044347H1
ctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaacttgaaggtggccatcaacgggttcggccgcatcgggcgcaacttcctgcggtg

SEQ ID NO: 2092 - DNA, 305 bp, Zea mays
  Clone ID: 700097318H1
cccacgcgtccggccgtctccttcaggacccacgcggtcggcacgagcggcgggccgcggcgggcgccgacggaggcgaactgtaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatcaa

SEQ ID NO: 2093 - DNA, 268 bp, Zea mays
  Clone ID: 700045244H1
gcctcctgcaccaccaactgcctcgcgccattcgtcaaggtcctcgaccaaaagttcggcatcatcaagggcaccatgaccaccacccactcctacaccggcgaccagaggctgctggacgcgagccaccgcgacctgcgccgcgcccgcgccgccgcgctcaacatcgtgcccacatccaccggcgccgccaaggccgtctcgctggtgctccccaacctcaagggcaagctcaacgggatcgcgctccgggtgcccacaccgaacg

SEQ ID NO: 2094 - DNA, 260 bp, Zea mays
  Clone ID: 700041539H1
gctcaacgggatcgcgctccgggtgcccaccccgaacgtctccgtcgtcgacctcgtcgtgcaggtctccaagaagaccctcgccgaggaggtgaaccaggcgttccgcgacgccgcggccaacgagctcacgggcatcctcgaggtctgcgacgtgccgctcgtgtccgtcgacttcaggtgctccgacgtctcctccaccatcgacgcctccctcaccatggtcatgggcgacgacatggtcaaggtcatctcctggt

SEQ ID NO: 2095 - DNA, 290 bp, Zea mays
  Clone ID: 700100339H1
atcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaacgtgaaggtggccatcaacgggttcggccgcatcgggcgcaacttcctgcggtgctggcacgggcgcggcga

SEQ ID NO: 2096 - DNA, 301 bp, Zea mays
  Clone ID: 700099768H1
cccacgcgtccgcggacgcgtgggtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgtaaggtggccatcaacgggttcggccgcatcgggcgcaacttcctgcggtgctacgggcgcggcgacgc

SEQ ID NO: 2097 - DNA, 257 bp, Zea mays
  Clone ID: 700043795H1
atggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctg

SEQ ID NO: 2098 - DNA, 264 bp, Zea mays
  Clone ID: 700043117H1
ggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaacttgaaggtggccatcaacgggttcggccgcatcgggcgcaacttcctgcggt

SEQ ID NO: 2099 - DNA, 320 bp, Zea mays
  Clone ID: 700211227H1
atgagctccgcgtcgctgcccatgcgccggaatgccacctccgacgacttcatgtccgccgtctccttcaggacccacgctgtcggcacgagcggcgggtcgcggcgggcgccgacggaggcgaactgaaggtggccatcaacgggttcggccgcatcgggcgcaacttcctgcggtgctggcacgggcgcggcgacgcctcgctcctcgacgtcatcgccatcaacgacaccggcggtgtcaatcaggcgtcccacctgctcaagtacgactccacgctcggcatcttcgacgccgacgtcaagcccgtcggcgacaat

SEQ ID NO: 2100 - DNA, 256 bp, Zea mays
  Clone ID: 700044187H1
gcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggc

SEQ ID NO: 2101 - DNA, 259 bp, Zea mays
  Clone ID: 700025676H1
cctacaccggcgaccagaggctgctggacgcgagccaccgcgacctgcgccgcgcccgcgccgccgcgctcaacatcgtgcccacatccaccggcgccgccaaggccgtctcgctggtgctccccaacctcaagggcaagctcaacgggatcgcgctccgggtgcccacaccgaacgtctccgtcgtcgacctcgtcgtgcaggtctccaagaagaccctcgccgaggaggtgaaccaggcgttccgcgacgccgcggc

SEQ ID NO: 2102 - DNA, 301 bp, Zea mays
  Clone ID: 700094879H1
ccacgcgtccgccacgcgtccggccgcatcgggcgcaacttcctgcggtgctggcacgggcgcggcgacgctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatcaaggtcgtgtccgaccgcaaccccagcaacctgccgtggggcgagctcggcatcgacctcgtcatcgagggcaccggcgtctt

SEQ ID NO: 2103 - DNA, 256 bp, Zea mays
  Clone ID: 700217617H1
gtccatgctctccgctaccaccgtgccactccagcaggggggctggctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgtaaggtggccatcaatgggttcggccgcatcgggcgtaacttcctgcggtgctggcactgg

SEQ ID NO: 2104 - DNA, 296 bp, Zea mays
  Clone ID: 700404848H1
atggcgtcgtccatgctctccgctaccaccgtgccactccagcagggagacggcctgtccgagttctccgggctcaggagctccgcatcgctgcccatgcaccggaatgccacctccgacgacttcatgtccgccgtctccttcaggacccacgcagtcggcacgaacagcgggccgcggcgggcgccgacggaggcgagctgaaggtggccatcaatgggttcggccgcatcgggcgctacttcctgcggtgctggccgggcgcggcgacgcctcgcccctcgacgtcatcgcct

SEQ ID NO: 2105 - DNA, 262 bp, Zea mays
  Clone ID: 700044959H1
ctctggtccgtggccatggcgtcgtccatgctctccgctaccaccgtgccactccagcaggggggcggcctgtccgagttctccgggctcaggagctccgcgtcgctgcccatgcgccggactgccacctccgacgacttcatgtccgccgtctccttcaggacccacgcggtcggcacgagcggcgggtcgctgcgggcgccgacggaggcgaactgaaggtggccatcaacgggttcggccgcatcgggcgcaacttcct

SEQ ID NO: 2106 - DNA, 264 bp, Zea mays
  unsure (1)...(264): unsure at all n locations
  Clone ID: 700213689H1
ggacgcgtggtggtccgtggccatggcgtcgtccatgctctccgctaccaccgtgccactccagcaggacgggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgnaaggtggccatcaacgggttcggccgcatcgggcgca

SEQ ID NO: 2107 - DNA, 283 bp, Zea mays
  Clone ID: 700210347H1
ctctggtccgtggccatggcgtcgtccatgctctccgctaccaccgtgccactccagcaggggtgcggcctgtccgagttctccgggctcaggagctccgcgtcgctgcgcatgcgccggaatgccacctccgacgacttcatgtccgccgtctccttcaggagccacgcggtcggcacgagcggcgggccgcggcgggcgccgacggaggcgaagctgaaggtggccatcaatgggttcggccgcatcgggcgcaacttcctgcggtgctggcacgggcgcg

SEQ ID NO: 2108 - DNA, 245 bp, Zea mays
  Clone ID: 700045145H1
gccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactgaaggtggccatcaacgggttcggccgcatcgggcgcaac

SEQ ID NO: 2109 - DNA, 252 bp, Zea mays
  Clone ID: 700217745H1
ctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgaaggtggcatcaatgggtcggcgcatcggcgaactt

SEQ ID NO: 2110 - DNA, 290 bp, Zea mays
  Clone ID: 700099288H1
cacgcggtcggcacgagctgcgggccgcggcgggcgccgacggatgcgaactgtaaggtggccatcaatgggttctgccgcatcgggcgcaacttccctctgtgctggcacgggcgctgcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatcaaggtcgtgtccgaccg

SEQ ID NO: 2111 - DNA, 299 bp, Zea mays
  Clone ID: 700099630H1
cccacgcgtccgggcgtcgtccatgctctccgctgccaccgtgccactccagcaggggggcggcctgtccgagttctccgggctcaggagctgcgcgtcggtgcacatgcgccgggatgccacttccggcgagttcatgtccgccgtgtccttcgagacgcacgcggtcggcacgagcggcgggtcgcggcgggcgccgacggaggcgaactgaaggtggccatcaacgggttcggccgcatcgggcgcagcttcctgcggtgctggcacggtcgcggcgacgcctcgcccctcgacgt

SEQ ID NO: 2112 - DNA, 280 bp, Zea mays
  Clone ID: 700214977H1
cggacgcgtgggcggacgcgtgggtcccacctgctcaagtacgactccacgctcggcatcttcgatgccgacgtcaagcccgtcaccgacaacgccatctccgtcgactgcaaggtcatcaaggtcgtgtccgaccgcaatcccagcaacctgccgtggggcgagctcggcatcgacctcgtcatcgagggcaccggcgtcttcgtcgaccgcgagggcgcggggaagcacatccaggcgggggccaagaaggtgctcatcacggcgcccggcaagggcg

SEQ ID NO: 2113 - DNA, 247 bp, Zea mays
  Clone ID: 700045545H1
caaaagttcggcatcatcaagggcaccatgaccaccacccactcctacaccggcgaccagaggctgctggacgcgagccaccgcgacctgcgccgcgcccgcgccgccgcgctcaacatcgtgcccacgtccaccggcgccgccaaggccgtctcgctggtgctccccaacctcaagggcaagctcaacgggatcgcgctccgggtgcccaccccgaacgtctccgtcgtcgacctcgtcgtgcagg

SEQ ID NO: 2114 - DNA, 237 bp, Zea mays
  Clone ID: 700198007H1
cggcgcccggcaagggcgacatccccacctacgtcgtcggcgtcaatgccgaccagtacaaccccgacgagcccatcatcagcaacgcctcctgcaccaccaactgcctcgcgccattcgtcaaggtgctcgaccaaaagttcggcatcatcaagggcaccatgaccaccacccactcctacaccggcgaccagaggctgctggacgcgagccaccgcgacctgcgccgcgcccgcg

SEQ ID NO: 2115 - DNA, 272 bp, Zea mays
  unsure (1)...(272): unsure at all n locations
  Clone ID: 700216050H1
tctggtcngtggccatggngtcgtccatgctctccgctaccaccgtgccactccagcaggggggcggnctgtccganttctccgggctcangagctccgcgtcgctgcccatgcgccggaatgccacctccgacgacttcatgtcngnccgtctccttcaggacncangnggtcggnacgngcggngggnngnggngggcgnngacggnggngaactgaatgtggccatcaatgggttnngncgnatngggcgnaacttcctgcggtgtggg

SEQ ID NO: 2116 - DNA, 273 bp, Zea mays
  Clone ID: 700214595H1
cggacgctgggcggacgcgtgggcaaaagttcggcatcatcaagggcaccatgaccaccacccactcctacaacggcgaccagaagctgctggacgcgagccaccgcgacctgcgccgcgcccgcgccgccgcgctcaacatcgtgcccacgtccaccggcgccgccaaggccgtctcgctggtgctccccaacctcaagggcaagctcaacgggatcgcgctccgggtgcccaccccgaacgtctccgtcgtcgacctcgtcgtgcaggtct

SEQ ID NO: 2117 - DNA, 242 bp, Zea mays
  unsure (1)...(242): unsure at all n locations
  Clone ID: 700215383H1
gcgggccgcggcgggcgccgacggaggcgaactgaaggtggccatcaatnggttcggccgcntcgggcgcaacttcctgcggtgctggcncgggcgcggcgacgcctcgcccctcgacgtcatcgccatcaacgacnccggaggcgtcaagcaggcgtcccacctgctcaagtacgactccacgctcggcntcttcgatgccgacgtcaagcccgtcggcgacaacgccatctccgtcgacg

SEQ ID NO: 2118 - DNA, 302 bp, Zea mays
  Clone ID: 700098015H1
cgacgcctcgcccctcgacgtcatcgccatcgtacgcgtgggtggtgtgtcgcaggtgttctacatggtcaagtacgtttccatgatcggcatcttcgacgccgacgtcaagcccgtcggcgacaacgccatctccgtcgacggcaaggtcatcaaggtcgtgtccgaccgcaaccccagcaacctgccgtggggcgagctcggcatcgacctcgtcatcgagggcaccggcgtcttcgtcgaccgcgcaggcgcggggaagcacatccaggcgggggccaagaaggtgctcatcacggcgc

SEQ ID NO: 2119 - DNA, 265 bp, Zea mays
  unsure (1)...(265): unsure at all n locations
  Clone ID: 700210596H1
cccacgcgtccgcccacgcgtccgcggacgcatggatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaactgnaaggtggccatcaatgggttcggccg

SEQ ID NO: 2120 - DNA, 233 bp, Zea mays
  Clone ID: 700440284H1
aacgggatcgcgctccgggtgcccaccccgaacgtctccgtcgtcgacctcgtcgtgcaggtctccaagaagaccctcgccgaggaggtgaaccaggcgttccgcgacgccgcggctacatcgagctcacgggcatcctcgaggtctgcgacgtgccgctcgtgtccgtcgacttcaggtgctccgacgtctcctccaccatgcgagctccctcaccatgggtatgggcaacg

SEQ ID NO: 2121 - DNA, 243 bp, Zea mays
  unsure (1)...(243): unsure at all n locations
  Clone ID: 700215096H1
tcccacctgctcaagtacgactccacgctcggcatcttcgnangccgacgtcaaanccgtcggcgacaacgccatctccgtcgacggcaaggtcatcaaggtcgtgtccgancgcaaccccagcaacctgccgtggggcgagctcggcatcgacctcgtcatcganggcaccgncgtcttcgtcgaccgcgagggcgcngggaagcacattcaggcnggggccaanaagtgtncnnacggggc

SEQ ID NO: 2122 - DNA, 200 bp, Zea mays
  Clone ID: 700207885H1
ggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaag

SEQ ID NO: 2123 - DNA, 185 bp, Zea mays
  Clone ID: 700044936H1
gtccgtggggatggcgtcgtccatgctctccgctaggagcgtgccactccagcaggggggcggcgctgtccggtttctccgggctcaggagtccgcgtcgctgcgcatgcggcgggatcgcagtccggacgacttcatgtcgcgcgtctcgttcaggacgcacgcggtcgggacgagccgcgggt

SEQ ID NO: 2124 - DNA, 285 bp, Zea mays
  Clone ID: 700042261H1
catggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaactagaaggtggccatcaacgggttcggccgcatcgggcgcaacttcctgcggtgctggcacgggcgcggcgaccctcgcccctc

SEQ ID NO: 2125 - DNA, 152 bp, Zea mays
  Clone ID: 700213316H1
ggcgacatccccacctacgtcgtcggcgttaatgccgaccagtacaaccccgacgagcccatcatcagcaacgcctcctgcaccaccaactgcctcgcgccattcgtcaaggtcctcgaccaaaagttcggcatcatcaagggcaccatgac

SEQ ID NO: 2126 - DNA, 125 bp, Zea mays
  Clone ID: 700101372H1
aaagttcggcatcatcaagggcaccatgaccaccacccactcctacaccggcgaccagaggctgctggacgcgagccaccgcgacctgcgccgcgcccgcgccgccgcgctcaacatcgtgccca

SEQ ID NO: 2127 - DNA, 125 bp, Zea mays
  Clone ID: 700053328H1
cggcgaccagaggctgctggacgcgagccaccgcgacctgcgccgcgcccgcgccgccgcgctcaacatcgtgcccacgtccaccggtgccgccaaggccgtctcgctggtgctccccaacctta

SEQ ID NO: 2128 - DNA, 125 bp, Zea mays
  Clone ID: 700100601H1
gccatcaacgacaccggcgggtcaagcaggcgtcccacctgctcaagtacgactccacgctcggcatcttcgacgccgacgtcaagcccgtcggcgacaacgccatctccgtcgacggcaaggtc

SEQ ID NO: 2129 - DNA, 131 bp, Zea mays
  Clone ID: 700101784H1
cttgatcctctggtccgtggccatggcgtcgtccatgctctccgctaccaccgtgccactccagcaggggggcggcctgtccgagttctccgggctcaggagctccgcgtcgctgcccatgcgccggaatg

SEQ ID NO: 2130 - DNA, 101 bp, Zea mays
  Clone ID: 700100849H1
ccatggcgtcgtccatgctctccgctaccaccgtgccactccagcaggggggcggcctgtccgagttctccgggctcaggagctccgcgtcgctgcccatg

SEQ ID NO: 2131 - DNA, 120 bp, Zea mays
  Clone ID: 700098705H1
cccacgcgtccgctctggtccgtggccatggcgtcgtccatgctctccgctaccaccgtgccactccagcaggggggcggcctgtccgagttctccgggctcaggaagctccgcgtcgct

SEQ ID NO: 2132 - DNA, 104 bp, Zea mays
  Clone ID: 700098336H1
atcaagggtcacatgaccaccacccactcctacacctgcgaccagaggctgctggacgcgatccaccgcgacctgctccgctcccgcgccgccgcgctcaacat

SEQ ID NO: 2133 - DNA, 92 bp, Zea mays
  Clone ID: 700404788H1
tgtcgaccgcgaaggcgcggggaagcacatccaggcgggggccaagaaggtgctcatcacggcgcccggcaagggcgacatccccacctacg

SEQ ID NO: 2134 - DNA, 109 bp, Zea mays
  Clone ID: 700097106H1
ccgaccgtgggcgcgacgcgtgggcggacgcgtgggctggtccgtggccatggcgtcgtccatgctctccgctaccaccgtgccactccagcagggggaacccctgtcc

SEQ ID NO: 2135 - DNA, 305 bp, Zea mays
  Clone ID: 700267791H1
agcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttg

SEQ ID NO: 2136 - DNA, 277 bp, Zea mays
  Clone ID: 700346835H1
agaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctga

SEQ ID NO: 2137 - DNA, 301 bp, Zea mays
  Clone ID: 700205354H1
acactcgaggtgcgagaaactcagcgtgagggcgataccacgcaggcgccccctgccatgccacaatattcgagtggagtgaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtca

SEQ ID NO: 2138 - DNA, 268 bp, Zea mays
  Clone ID: 700213067H1
cacacgcgtccgcggacgcgtggcaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagag

SEQ ID NO: 2139 - DNA, 293 bp, Zea mays
  Clone ID: 700073493H1
acgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctgaatatgttgttggatcttccggtgtcctcacgacgact

SEQ ID NO: 2140 - DNA, 302 bp, Zea mays
  Clone ID: 700281924H2
tggatttgacatgccggattgagaaaagcgcctcctatgatgatgtgaaagcagccatcaagacggcatcagagggtgcactcaaaggtattcttggctacacagacgaggatgttgtttccaatgattttgttggtgattcaaggtcaagcatctttgatgccaaggctggtattggactgagctcttccttcatgaagctcgtgtcttggtatgacaacgagtggggctacagcaaccgggttctggatctgatcgctcacatggctcttgtgagcgccaagcactgatgttcgtactcg

SEQ ID NO: 2141 - DNA, 293 bp, Zea mays
  Clone ID: 700076167H1
gaaaaacgcctcctatgatgatgtgaaagcagccatcaaggcggcatcagagggtgcactcaaaggaattcttggctacacagacgaggacgttgtttccaatgattttgttggtgattctaggtcaagcatctttgatgccaaggctggtatcggactgagctcttctttcatgaagctcgtgtcttggtatgacaacgagtggggctacagcaaccgggttctggatctgatcgcccacatggccctcgtcagcgccgccgccaagctctgacgtccgtgctcgttcctcc

SEQ ID NO: 2142 - DNA, 287 bp, Zea mays
  Clone ID: 700106880H1
gtgaaagcagccatcaagacggcatcagagggtgcactcaaaggtattcttggctacacagacgaggatgttgtttccaatgattttgttggtgattcaaggtcaagcatctttgatgccaaggctggtattggactgagctcttccttcatgaagctcgtgtcttggtatgacaacgagtggggctacagcaaccgggttctggatctgatcgctcacatggctcttgtgagcgccaagcactgatgttcgtactcgttcctccagtaccagtagtagcctagata

SEQ ID NO: 2143 - DNA, 280 bp, Zea mays
  Clone ID: 700343834H1
agagggtgcactcaaaggtattcttggctacacagacgaggatgttgtttccaatgattttgttggtgattcaaggtcaagcatctttgatgctaaggctggtattggactgagctcttccttcatgaagctcgtgtcttggtatgacaacgagtggggctacagcaaccgggttctggatctgatcgctcacatggctcttgtgagcgccaagcactgatgttcgtactcgttcctccagtaccagtagtagcctagataagaggctgcacgtttgacg

SEQ ID NO: 2144 - DNA, 280 bp, Zea mays
  Clone ID: 700612539H1
gctacacagacgaggatgttgtttccaatgattttgttggtgattcaaggtcaagcatctttgatgccaaggctggtattggactgagctcttccttcatgaagctcgtgtcttggtatgacaacgagtggggctacagcaaccgggttctggatctgatcgctcacatggctcttgtgagcgccaagcactgatgttcgtactcgttcctccagtaccagtagtagcctagataagaggctgcagttttgacggccattttcttttagctgttgtttgg

SEQ ID NO: 2145 - DNA, 223 bp, Zea mays
  Clone ID: 700017623H1
gcacgaggttgtttccaatgattttgttggtgattcaaggtcaagcatctttgatgccaaggctggtattggactgagctcttccttcatgaagctcgtgtcttggtatgacaacgagtggggctacagcaaccgggttctggatctgatcgctcacatggctcttgtgagcgccaagcactgatgttcgtactcgttcctccagtaccagtagtagcctaga

SEQ ID NO: 2146 - DNA, 274 bp, Zea mays
  Clone ID: 700043423H1
gccgccctttttttttttttttgtttgtgattcaaacccattcaatccgactcaatccacatggattaagagctaaatgaacaagccctaatagacgcccgaaccagacatgctctgaaatcgttctcaaatacacacaagggatagatagaggtacagttgagttatacaaaggtttcatcaagtttcttaaagtacagcagagcttccatttcctacatgaccagatagccctagcaaagcatgcagctcctacaccaaaagccatccatgt

SEQ ID NO: 2147 - DNA, 322 bp, Zea mays
  Clone ID: 700098586H1
gggcgactacgaccacagcgtcgccgacatcatcagcaacgcgtcctgcacgaccaactgcctcgcgccattcgtcaagatcttggacaaggagttcggaatcgtgaaggggaccatgacgacgacgcactcgtacaccggcgaccagaggctgctggacgcgtcccaccgcgacctccggcgggcccgcgcagcggcgctgaacatcgtgccgacgagcacgggcgccgccaaggccgtggcgctggtgctgcacgagctcaaggggaagctgaacggcatcgcgctgcgggtgccgaccccgaacgtgtccgtggtggac

SEQ ID NO: 2148 - DNA, 292 bp, Zea mays
  Clone ID: 700101965H1
gtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggctgctggacgcgtcccaccgcgacctccggcgggcccgcgcagcggcgctgaacatcgtgccgacgagcacgggcgcctccaaggccgtggcgcaggtgctggcgcagctgaatgggaagctgaacg

SEQ ID NO: 2149 - DNA, 340 bp, Zea mays
  unsure (1)...(340): unsure at all n locations
  Clone ID: 700097652H1
cggcaccttcaaggccgacgtcaagatcgtggacgacacgaccatcagcgtcgacggcaagcccatcacggtcgtctccagcagggacccgctcaagctcccatggggtgagctcggcattgacatcgtcatcgagggcaccgtagtcttcgtcgacggccccggcgccggcaagcacatccaggccggcgcgaagaaggtgatcatcacggctcncgccaagggcgccgacatcccgacctatgtcgtcggcgtcaacgagggcgactacgaccacagcgtcgccgacatcatcagctacgcgtcctgcacgaccaactgcctcgcgccattcgtcaaa

SEQ ID NO: 2150 - DNA, 260 bp, Zea mays
  Clone ID: 700045073H1
ctggtgatcaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctcaaggggaagctgaacggcatcgcgctgcgggtgccgaccccgaa

SEQ ID NO: 2151 - DNA, 306 bp, Zea mays
  Clone ID: 700100461H1
ggacgaggagttcggaatcgtgaaggggaccatgacgacgacgcactcgtacaccggcgaccagaggctgctggacgcgtcccaccgcgacctccggcgggcccgcacagcggcgctgaacatcgtgccgacgagcacgggcgccgccaaggccgtggcgctggtgctgccgcagctcaaggggaagctgaacggcatcgcgctgcgggtgccgaccccgaacgtgtccgtggtggacctggtgatcaacaccgtgaagactggcatcacggccgacgacgtgaacgcggcgttccgcaatgacgc

SEQ ID NO: 2152 - DNA, 309 bp, Zea mays
  Clone ID: 700100784H1
ggggtgagctcggcattgacatcgtcatcgagggcaccgtagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggc

SEQ ID NO: 2153 - DNA, 271 bp, Zea mays
  Clone ID: 700041674H1
caacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgctgcggcgctgaacatcgtgccgacgagcacgggcgccgccaaggccgtggcgctggtgctgccgcagctcaag

SEQ ID NO: 2154 - DNA, 289 bp, Zea mays
  Clone ID: 700101071H1
aacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgcagcggcgctgaacatcgtgccgacgagcacgggcgcctgcaaggccgtggcgctggtgctgccgcagctcaaggggaagctgaacggcatcg

SEQ ID NO: 2155 - DNA, 288 bp, Zea mays
  Clone ID: 700099485H1
gaacatcgtgccgacgagcacgggcgccgccaaggccgtggcgctggtgctgccgcagctgaaggggaagctgaacggcatcgcgctgcgggtgccgaccccgaacgtgtccgtggtggacctggtgatcaacaccgtgaagactggcatcacggccgacgacgtgaacgcggcgttccgcaatgccgccgccggcccgctgcagggcatcctggatgtctgcgacgtgccgctcgtgtccgttgacttcaggtgctccgacgtgtcctgcaccatcgacgcgtcgct

SEQ ID NO: 2156 - DNA, 290 bp, Zea mays
  unsure (1)...(290): unsure at all n locations
  Clone ID: 700101345H1
caagtacgactcgatgctcggcaccttcaaggccgacgtcaagatcgtggacgacactaccatcagcgtcgacggcaagcccatcacggtcggctccaccanggagacgctcaagctcccatggggtgagctcggcattgacatcgtcatcgagggcaccggagtcttcgtcgacggcccaagcgccggcaagcacatccaggccggcgcgaagaaggtgatcatcacggctcccgcaaatggcgccgacatcccgacctatgtcgtcggcgtcaacgagggcgactacg

SEQ ID NO: 2157 - DNA, 259 bp, Zea mays
  Clone ID: 700043784H1
cgtcaacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgcggcggcgctgaacatcgtgccgacgagcacgggcgccgcaaaggccgtggcgctggtg

SEQ ID NO: 2158 - DNA, 302 bp, Zea mays
  Clone ID: 700099589H1
gccgacgtcaagatcgtggacgacactaccatcagcgtcgacggcaagcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgcggacatcatcagcaacgcgtcctgcacgac

SEQ ID NO: 2159 - DNA, 301 bp, Zea mays
  Clone ID: 700099264H1
cccacgcgtccggaggcgaactgtaaggtggcgatcaacggcttcggccgcatcggcggaacttcctccggtgctggcacggccgcgaggactcgccgatcgacgtcgtcgtcgtgaacgacagctgaggcgtcaggaacgcgtcccacctcctcaagtacgactcgatgctcggcaccttcaaggcagacgtcaagatcgtggacgacactaccatcagcgtcgacggcaagcccatcacggtcgtctccagcagggacccgctcaagctcccatggggtgagctcggcattgacatcgt

SEQ ID NO: 2160 - DNA, 262 bp, Zea mays
  Clone ID: 700041766H1
cgcacgtcaaggggaagctgaacggcatcgcgctgcgggtgccgaccccgaacgtgtccgtggtggacctggtgatcaacaccgtgaagactggcatcacggccgacgacgtgaacgcggcgttccgcaatgccgccgccggcccgctgcagggcatcctggaggtctgcgacgtgccgctcgtgtccgtcgacttcaggtgctccgacgtgtcctgcaccatcgacgcgtcgctcagcatggtcatgggcgacgacatggt

SEQ ID NO: 2161 - DNA, 324 bp, Zea mays
  Clone ID: 700098403H1
cgaacgtgtccgtggtggacctggtgatcaacaccgtgaagactggcatcacggccgacgacgtgaacgcggcgttccgcaatgccgccgccggcccgctgcagggcatcctggatgtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgcggcggcggccggcagcggcg

SEQ ID NO: 2162 - DNA, 282 bp, Zea mays
  Clone ID: 700042111H1
ctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcg

SEQ ID NO: 2163 - DNA, 278 bp, Zea mays
  Clone ID: 700042979H1
gccccggcgccggcaagcacatccaggccggcgcgaagaaggtgatcatcacggctcccgccaagggcgccgacatcccgacctatgtcgtcggcgtcaacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaccagatgctgctggcacgcgtccaccgcgac

SEQ ID NO: 2164 - DNA, 326 bp, Zea mays
  Clone ID: 700579708H1
ccggagtcttcgtcgacggccccggcgccggcaagcacatccaggccggcgcgaagaaggtgatcatcacggctcccgccaaggaccccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccctctggaggacttctgcaaggacaaccccgagaccgacgagtgcaaggtgtacgaagca

SEQ ID NO: 2165 - DNA, 317 bp, Zea mays
  Clone ID: 700097230H1
cccacgcgtccgcccacgcgtccgcgccaaggccaccggggagaacgccgtgagggcgcccgcagaggcgaactgaaggtggcgatcaacggcttcggccgcatcggccggaacttcctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacactagcatcagcgtcgacggcaagcccatcacggtcgtctccagcagggacccgct

SEQ ID NO: 2166 - DNA, 312 bp, Zea mays
  Clone ID: 700097983H1
ggcgtccttctccgacgtccttggcgcgcactcgtcgccaaggccaccggggagaacgccgtgagggcgcccgccgaggcgaactgaaggtggcgatcaacggcttcggccgcatcggccggaacttcctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacacgaccatcagcgtcgacggcatagccatcacggtcgtct

SEQ ID NO: 2167 - DNA, 225 bp, Zea mays
  Clone ID: 700099990H1
ctgacgcgtgggcggacgcgtgggacgagggcgactacgaccacagcgtcgcggacatcatcagctacgcgtcctgcacgaccaactgcctcgcgccattcgtcaagcatcttggacgagtgagttcggaattgtcaaggggaccatgacgacgacgcactcgtacaccggcgaccagaggctgctggacgcgtcccaccgcgacctccggcgggcccgctcggc

SEQ ID NO: 2168 - DNA, 215 bp, Zea mays
  Clone ID: 700404886H1
ccgacatcccgacctatgtcgtcggcgtcaacgagggcgactacgaccacagcgtcgcggacatcatcagcaacgcgtcctgcacgaacaactgcctcgcgccattcgtcaagatcttggacgaggagttcggaattgtcaaggggaccatgacgacgacgcactcgtacaccggcggccagaggctgctggacgcgtcccaccgcgacctccgg

SEQ ID NO: 2169 - DNA, 306 bp, Zea mays
  Clone ID: 700101261H1
atgtccgcggtacggtggtcggtacgcgtgggctggacgcgtgggcggacgcgtgggcgacgtcaagatcgtggacgacacgaccatcagcgtcgacggcagtcccatcacggacgtctccagcaaggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgaggg

SEQ ID NO: 2170 - DNA, 250 bp, Zea mays
  unsure (1)...(250): unsure at all n locations
  Clone ID: 700025513H1
cgccgtgaggncgaccgcagaggcgaantgaaggtggcgatcaacggcttcggccgcatcggcggaaacttcctccggtgctggcacggccgcgangactcgccgatcgacgtcgtcgtcgtgaacgacagcgganncgtcangaacgcgtcccacctcctcaagtacgactcgatgctcggnaccttcaaggccgacgtcaagatcgtggacgacacgaccatcagcgtcnacggcaagcccatcaagg

SEQ ID NO: 2171 - DNA, 249 bp, Zea mays
  Clone ID: 700042534H1
acgccgtgagggcgcccgcagaggcgaactggaagggggcgatcaacggcttcggcagcatcggccggaacttcctccggtgctggcacggccgcgaggactcgccgatcgacgtcgtcgtcgtgaacgacagcagaggcgtcaggaacgcgtcccacctcctcaagtacgactcgatgctcggcaccttcaaggccgacgtcaagatcgtggacgacacgaccatcgacatcgacggcaagcccatca

SEQ ID NO: 2172 - DNA, 290 bp, Zea mays
  Clone ID: 700404890H1
ccgacttctccgggctcaggccggggtcgtgctccgtcgagcgtctgccgcgcgggcaggcgtccttctccgacgtccttggcgcgcagtcgtcgccaacgccaccggggagaacgccgtgagggcgcccgcagaggcgaactcgaaggtggcgatcaacggcttcggccgcatcggccggaacttcctccggtgctggcacggccgcgacgactcgcagatcgacgtcgtcgtcgtgaacgacagcggacgctcaggaacgcgtcccacctcctcaagtacgactcgat

SEQ ID NO: 2173 - DNA, 307 bp, Zea mays
  Clone ID: 700100028H1
agaggctggacttcgccgacttctccgggctcaggccggggtcgtgctccgtgagcgctgccgcgcgtgtaggcgtccttctccgacgtccttggcgcgcactcgtcgccaaggccaccggggagaacgccgtgagggcgcccgccgaggcgaactgtaaggtggcgatcaacggcttcggccgcatcggccggaacttcctccggtgctggcacggccgcgaggactcgccgatcgacgtcgtcgtcgtgaacgacagcagaggcgtcaggaacgcgtcccacctcctcaaatacgactcgatgct

SEQ ID NO: 2174 - DNA, 209 bp, Zea mays
  Clone ID: 700097683H1
cccacgcgtccgcccacgcgtccgcttggcgcgcactcgtcgccaaggccaccggggagaacgccgtgagggcgcccgcagaggcgaactgaaggtggcgatcaacggcttcggccgcatcggccggaacttcctccggtgctggcacggccgcgaggactcgccgatcgacgtcgtcgtcgtgaacgacagcggaggcgtcaggaacg

SEQ ID NO: 2175 - DNA, 131 bp, Zea mays
  Clone ID: 700045480H1
atgacggtcgtctccagcagggacccgctcaagctccgatggggtgagctcggcattgacatcgtcatcgagggcaccggagtcttcgtcgacggccccggcggcgggaagcagatccaggccggcgcgaa

SEQ ID NO: 2176 - DNA, 306 bp, Zea mays
  Clone ID: 700101596H1
cgcatccccgccggcgcccggctgcacagcagggcggcggcgtcgtccaggcacggcgtgcagaggctggacttcgccgacttctccgggctcaggccggggtcgtgctccgtgagcgctgccgcgcgggacgcgtccttctccgacgtccttgccgcgcagtcgtcgccaaggccaccggggagaacgccgtgagggcggccgccgaggcgaactacaaggtggcgatcaacggcttcggccgcatcggccggaacttcctccggtgctggcacggccgcgacgactcgccgatcgacgtcgtcg

SEQ ID NO: 2177 - DNA, 179 bp, Zea mays
  Clone ID: 700434377H1
ccccgaacgtgtccgtggtggacctggtgatcaacaccgtgaagactggcatcacggccgacgacgtgaacgcggcgttccgaaggccgccgccgcacgctgcagggcatcctggaggtctgcgacgtgccgctcgtgtccgtcgacttcaggtgctccgacgtgtcctgcaccatcga

SEQ ID NO: 2178 - DNA, 139 bp, Zea mays
  Clone ID: 700043206H1
cgcagaggcgaactagaaggtggcgatcaacggcttcggccgcatcggacgggacttcctccggtgctggcacggccgcgaggactcgccgatcgacgtcgtcgtcgtgaacgacagcggaggcgtcacgaacgcgtcc

SEQ ID NO: 2179 - DNA, 120 bp, Zea mays
  unsure (1)...(120): unsure at all n locations
  Clone ID: 700025514H1
gnccggcgcgaagaaggtgatcatcacggctcccgccaaggncgccgacatcccgacctatgtcgtcngcgtcaacganngcnactacgaccacagcntcgccnacatcatcagcnacnc

SEQ ID NO: 2180 - DNA, 233 bp, Zea mays
  unsure (1)...(233): unsure at all n locations
  Clone ID: 700198075H1
cggacggtgggcggacgcgtgggcggacgcgtggggaacgcgtcccacctcctcaagtacgactcgatgaccggcaccttcagtgccgacgtcaagatcgtggacgacacgaccatcagcgtcgacggcaagcccatcacggtcgtctccagcagggatccgcttaagctcctatggcgtgagctcggcattgacatcggtcatcgagggcacagtagtcntcgtcgacggcc

SEQ ID NO: 2181 - DNA, 315 bp, Zea mays
  Clone ID: 700100768H1
atccgatcccacccggcagcggcgctcgcaatggccacccacgcagctctcgccgcctcccgcatccccgccggcgcccggctgcacagcagggcgcggcgtcgtccaggcacggcgtgcagaggctggacttcgccgacttctccgggctcaggccggggtcgtgctccgtgagcgctgccgcgcgggaggcgtccttctccgacgtccttggcgcgcactcgtcgccaaggccaccggggagaacgccgtgagggcgcacgcagaggcgaactgtaaggtggcgatcaacggcttcggccgcatcggccggaa

SEQ ID NO: 2182 - DNA, 265 bp, Zea mays
  Clone ID: 700043373H1
atggccacccacgcagctctcgccgcctcccgcatccccgccggcgtcgtccaggcacggcgtgcagaggctggacttcgccgacttctccgggctcaggccggggtcgtgctccgtgagcgctgccgcgctgggaggcgtccttctccgacgtccttggcgcgcactcagtcgccaaggccaccggggagaacgccgtgagggcgcccgcagaggcgaactgtaaggtggcgatcaacggcttcggccgcatcggccggaactt

SEQ ID NO: 2183 - DNA, 319 bp, Zea mays
  Clone ID: 700097375H1
atccgatcccacccggcagccgcgcgcgcaatggccacccacgcagctctcgccgcctcccgccggcgtcgtccaggcacggcgtgcagaggctggacttcgccgacttctccgggctcaggccggggtcgtgctccgtgagcgctgccgcgccggaggcgtccttctccgacgtccttggcgcgcagtcagtcgccaaggccaccggggagaacgccgtgagggcgctcgcagaggcgaactgacaggtggcgatcaacggcttcggccgcatcggtcggaacttcctccggtgctggcacggccgcgaggactcgcc

SEQ ID NO: 2184 - DNA, 304 bp, Zea mays
  Clone ID: 700208045H1
cccacgcgtccgcacccatccgatcccacccggcagcggcgctgcgcagatggccacccacgcagctctcgccgcctcccgcatccccgccggcgcccggctgcacagcagggcgccggcgtcgtccaggcacggcgtgcagaggctggacttcgccgacttctccgggctcaggccgtggtcgtgctccgtgagcgctgccgcgcgggaggcgtccttctccgacgtccttggcgcgcacgtcgtcgccaaggccaccggggagacggcgtgaggcgcccgcagagcgaactgaaggtggcga

SEQ ID NO: 2185 - DNA, 178 bp, Zea mays
  Clone ID: 700426721H1
gacttgttatggatttaaaccgactcaatctcacttaatccacatggattgagagcgaaccgaacaaaccgtaatatgtgtgttcttggggtggaattttggatggtaatgtacaaggacgagtggattaatttacagtgatgtcggaggaccgacaagggttgcagtagctccacgc

SEQ ID NO: 2186 - DNA, 359 bp, Zea mays
  Clone ID: 700573046H1
tgctatacatgatataaaaagcagggatcgggagaaggatgaaccagttccgaagctacctgtggagaagcttcggcttaacagcaaaaaatggaaccgacctaaaggggaaaaggttgtctagtccttgatagattatccctaggtcaatagtaaatgtcaagggcatgaatgtaattttacacaggctgcgtcttgtgcctataaatagatgaacagtagcactgtattgttcacgttgacttgtattcgcttgcacgtcactctcgagccttttaccttctgtcaagatgaaggtataaatgtaattcgatattgttcatattcattcatgatattataataacaatgtcctgata

SEQ ID NO: 2187 - DNA, 259 bp, Zea mays
  Clone ID: LIB143-029-Q1-E1-H1
caatggacggtgtcgtacttgaacatgtaggtcatgtactccgtggccactggaagcacagcgacatcacactcatggactccacgacccttctcttcggtgacaagccggtcaccgtctttggcatcaggaaccctgacgaaatcccgtgaggtgaggctggcgctgagtatgtcgtggagtccaccggcgtcttcactgacaaggacaaggctgctgcacatctcaagggtggtgccaagaaggttgttatctctgc

SEQ ID NO: 2188 - DNA, 244 bp, Zea mays
  Clone ID: LIB143-020-Q1-E1-F2
gtcgcgttgcagtactgcacactcacgtacatacatcaatcgccggtccagcgtccgagcacatctagcatcttccatgccaaggccgggatcgctctgatagaccacttcgtcaagctcgtcacgtggtaggacaactattggggctacagcaactgcgtcatcgacctgatgcgccacatgttcaagacgcagtataggggtgttttccccatgcttctgcatgatgggagctgcaggtgta

SEQ ID NO: 2189 - DNA, 384 bp, Zea mays
  Clone ID: LIB143-049-Q1-E1-H3
gggacatcacgcatcatgccagactcgggacgatacagcctagatgagtctataccaccactcggtccccgtcccgcacactaacccaaggcagataagatcggataagggtcgcagatcgaagcggtgccagggtgcctgcaaatgacattcagctctcgccgtaagacccttcatcagcaacgactacatgacctacatgttcaagtacgacactgtgcacggacagtggaagcaccatgaagtcaaagtgaaggactccaaaacccttctctttggtgagaaagaggttgctgtgtttggctgcaggaaccctgaggagatcccgtggggttcggttggtgctgaatatgtggttgagtctactggtgttttcactgacca

SEQ ID NO: 2190 - DNA, 330 bp, Zea mays
  Clone ID: LIB143-049-Q1-E1-H4
gggaggaagatcacacagcatttcactggttcatctcactagatgaacgcgtagactattactacactctagagtgaatcctagcacctggcctccgtcgcgcatcagcgcatccccatggcccaacatcaagatcgggatcaatgtggttcggcacgatgagcacgctggacgccaaagtagcccggcacagtgacgatgtccagctcgtcgccgtggaggaccccttcatcaacaccgactacactgacctacatgttcaagtacgacattgtgcacggacagtgggaagccacaggaactcaaggtgaaggaccccaaaacccttct

SEQ ID NO: 2191 - DNA, 386 bp, Zea mays
  Clone ID: LIB148-009-Q1-E1-G2
agggacgtttgtgggggcaaccgtgcatccattccctaccggcgattgggcgtggaaggcggtgtggcgtgggcaattcttcgtcgaagatcgcgcttcgtcgtgaagccgctcacatccgcggtcggcgtccggtgctgcctaaattttggtatcttcggattcatggtaaaagcagatacaatgaggagcttgatcgtgacaagggttgtcgtcgctccgaagctgtgcgaaagggagcttcggctaaatcgcagaaaagggaaccgacttaaaagggaaaaggctgttcagtcctcatagatttttctataagccaatagtaaatgtaaagggcataattgtattttccataggctgtgtcctgtgcctataaatagatgaac

SEQ ID NO: 2192 - DNA, 346 bp, Zea mays
  unsure (1)...(346): unsure at all n locations
  Clone ID: LIB189-007-Q1-E1-B4
cggtnggaacttcacctgtcaggcccggtccagataccgggccgagccacgcgtccacggaaacgtgggaccaggcgttccgcgacgccccggcaaacaagctcacgggcacccccaagtccgccaacttccgccccttttcgttcaacttcagggcccccaacttctctccaacaatcaaaccctccccaacaagggccatggccaacaacatggtcaaggtcacctcctggtactacaaccattggggctacccccagagggtcgtcgacctcgctgacatctgccccaaccggtgaaagtgaaccgttgcattgtaatagcactttgtaactcctcaccctcc

SEQ ID NO: 2193 - DNA, 273 bp, Zea mays
  unsure (1)...(273): unsure at all n locations
  Clone ID: LIB189-023-Q1-E1-B8
agggtgttggangcaactactagacggacgggtacctatctcaccattccccgtcagacccacgcatccacccacgcgtccgcggacgcgtgggggcgtcgtccatgctctccgctaccaccgtgccactccagcaggggggcggcctgtccgagttctccgggctcaggagctccgcgtcgctgcccatgcgccggaatgccagctcgggcgacttcatgtccgccgtctccttcaagacccacgcggtcggcacgatctgcgggtcgccgc

SEQ ID NO: 2194 - DNA, 210 bp, Zea mays
  Clone ID: LIB3059-004-Q1-K1-C3
gaagctgcactcacttgaaggtggttccaataagttgtcatatgtcttatcaggggctccaaactcatgatgtataattttacagtgtaccatctgctatttcatgatctttgctactaaaacaggatgatccatttcctcaagttcttcaactggctgtattttaaaagtataaaagctttgtggctttcgcattgaaagtgatgtgta

SEQ ID NO: 2195 - DNA, 278 bp, Zea mays
  Clone ID: LIB3059-013-Q1-K1-B4
ccgcatcgtccgcggacgcgtgggcgatcccttcatcagcaccgactacatgacctagatggttatagtacgacactgtacacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactgttgttattacttacctgtaataatcctgcatcttactttaaattctatcc

SEQ ID NO: 2196 - DNA, 356 bp, Zea mays
  unsure (1)...(356): unsure at all n locations
  Clone ID: LIB3059-059-Q1-K1-D6
tcttccttcatgaagctcgtgtcttggtatgacaactagtggggctacagcaaccgggttctggatctgatcgctcacatggctcttgtgagcgccaagcactgatgttcgtactcgttcctccagtaccagtagtagcctagataagaggctgcagttttgacggccattttcttttagctgttgtttggaataaaagaccaaatgttggaacacttggaactcgcgcaaaactggaatccgattcatgacctgtgttttagttgtagagggggcaaatttgcatcgtactatatgcgggattgttgatcggatgtcgtatggttcaaaagaaatacanactacaactggttcaa

SEQ ID NO: 2197 - DNA, 432 bp, Zea mays
  Clone ID: LIB3059-052-Q1-K1-E5
ctgaggttctgcgatgacgtgagcatgccaaattcagattaggcttgctttgcctgtgtcccctctttttgtatcctggggacgcggatcttgtgagtatggccaaagaaatgtttactactttagcagtgttggaaacgcgtgacataactggttacgagtagttttagccgtcttctgtctagcggtgtggccggtagtggcagcatgcgtctgcagagaacatgtttggtttttattgcacattatttacatattaaattatcattatccatcttagatttaacgtctctattgaccattgtaatctataaataacacctttcatccctatatcttatcatgtcaggggtgtctttagcaaaatataccaaacaattagagacgttagatataagatgagtgatgataatttaatatatgtaatatatg

SEQ ID NO: 2198 - DNA, 76 bp, Zea mays
  Clone ID: LIB3059-055-Q1-K1-C8
acgaggggcatgattgtaattccttacaggctgtgtcctgtgcctataaagagtgaatagttctcctttactgttc

SEQ ID NO: 2199 - DNA, 347 bp, Zea mays
  unsure (1)...(347): unsure at all n locations
  Clone ID: LIB3060-001-Q1-K1-A9
gtatacgttttancccatagaattcgtttagcactagctagacccgcccggtctcggattaccgtgctcgacccactcgtccgctctggtccgtggccatggcgatgtccatgctctccgctaccaccgtgccactgcagcgggggggttgaaagtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaagcgaagctgaangtggccatcaacaggttcagctcgatcgggcgcaacttcctg

SEQ ID NO: 2200 - DNA, 261 bp, Zea mays
  Clone ID: LIB3060-002-Q1-K2-G3
tcgtggccatgcttcgacagccttcgctgccaccggccactccagcaaggcggcgggcggtccgagttctccgggctcacgagctccccgtcgctgcccatgcgccggaatgccacctccgacgacttgatgtccggcgtcttcttcaggacccacgcggccggacgaacggcggaccgcggcgggcgccgacggaggcgaagctgaaggtggccatcaatgggttcggccgcatcgggcgcaacttcctgcggtgctggc

SEQ ID NO: 2201 - DNA, 230 bp, Zea mays
  Clone ID: LIB3060-004-Q1-K1-E12
gtcaaggtcatctcctggtactacaactagtggggctactcgcagagggtcgtcgacctcgctgacatctgcgccaaccagtggaagtgaagcgttgcattgtaatagcactttgtaactcctcacccttcacagggctttgggattcaccccgaaatgactcactttcggtgaaattcacccgttatcggcgagggcgttttatttttcttgtcaaatgatttcattgg

SEQ ID NO: 2202 - DNA, 348 bp, Zea mays
  unsure (1)...(348): unsure at all n locations
  Clone ID: LIB3060-040-Q1-K1-H9
aggtgggggcngacgtggtctgtttttccaattggcnnactacnacganccatccgcctcaattcccgggtctggtccgtggccagggcgtggtccatgctctccgctactaccgtgttactccagcaggggggcggcctgtcggacttgtccggtctcaagagctccgcgtcgctgcccatgcgccggaatgccacctccgacgacttcatgtccgccgtctacttcaggacccacgcggtcggcacgagcggctggccgtggcgggcgccgacggacgcgaagctgaaggtggccatcaatgggttcggccgcatcgggcgcaacttgctgcggtgctggcacggg

SEQ ID NO: 2203 - DNA, 168 bp, Zea mays
  unsure (1)...(168): unsure at all n locations
  Clone ID: LIB3060-037-Q1-K1-B8
cttcttccattctttnnactaccacccnaccactcnatcaggggggcttatcnaaacgagtggnccgccctcaaaatctcctcntcactacccatgctccnaaatgccacctccnactactttatcnccnccaactccttcacaancnanactgnnnnnacgngcaaa

SEQ ID NO: 2204 - DNA, 401 bp, Zea mays
  unsure (1)...(401): unsure at all n locations
  Clone ID: LIB3060-024-Q1-K1-C10
gagtatatgcctgttgaannttgccaatntgcccagtacnattatcatacccattcccaactggagccacgacccacgcgtcctctctcgtccagcaccatggtttcgcttatgctctccgctaccacagctccgctccggtaaattggcagcctgtccgagttctccgctctcatgagctccgcctcgctgtccatgctccagaatgccaccttcgacgacttcatgtacgccgtctccttcatgacccaccccgtcggcacgagcatccgttcacctcgggcaccgacggatgccaatctaaatgtggccatcaacggattctgccacatctgactcaacttccttcggtgctgacacggtcactgcgacacctctcccctccacgtcatctccatcaa

SEQ ID NO: 2205 - DNA, 358 bp, Zea mays
  unsure (1)...(358): unsure at all n locations
  Clone ID: LIB3060-020-Q1-K1-B1
gcgagctgcgctactcgcccgncgccttgggctttattaagatcggaatcaacggctcggggacggagccgcaggctcgtggccagggtcgccctccagagcgaggatgtcgagctcgtcgccgtcaacgaccccttcatcaccacggactacatgacctacatgttcaagtccgacaccgtccacggcccctggaagcacagcgcctcaccactaaaggcctccaagacccttgtcttcggagacaagccgtgcaccggctttggcaatcaggaaccctgaggaaatcccatggagtgaggctggcgctgcctatgccggggagcccaccggcgtctccactgacaaggacaaggct

SEQ ID NO: 2206 - DNA, 343 bp, Zea mays
  unsure (1)...(343): unsure at all n locations
  Clone ID: LIB3060-023-Q1-K1-D10
agagttcaactctagcttgangttcgattccccgccctagnttcnatctancactcaagnatacaggtccaagccacgcgtccaacgatcgcacccggcancactcagcaccagcttcgctttatggccacccacgcagctctcgccgcctccggcatccccgacaacgccccactgcacagcatatcggccgcgtcatccatgcacggcgtgcagaggctggacttctccgacttctccaggctcaagcctgagtcgtgctccgtgagcgctgccgcgcgggaagcgtccttctccgacatccttggcgcgcagctcgtctccaatgccacacgagagaacg

SEQ ID NO: 2207 - DNA, 507 bp, Zea mays
  unsure (1)...(507): unsure at all n locations
  Clone ID: LIB3061-034-Q1-K1-H4
ggcnnccttgagggtcaannggtggaaaggganttccangaaccttcttcttttggttggaagaaaggaaggtgnggcttggggttttggcttgcaagggaaccccttganggaagaatccccatggggggtttccgggtttggccgcttgaaataatgttggtttggaagtctacttgggtgggttttcacttgaccaaggaagaaagggcttgcaagctcacttgaaggggtgggtgccaagaaggttgtcatttcttgctcctagcaagggatgcccccatgttcgttgttgggtgtcaaccgaagaaggaagtacaagtcttgacatcaacattgnctctaatgctagcttgcacaaaccaaactgccttgctccgcttgctaagggtcatcaaatgacaaagttcgggtattgttgagggggtcttgatgaccacttgttcatgccatcactgctacccaagaagacttgttgatggggccctcatctaaagggactgggag

SEQ ID NO: 2208 - DNA, 383 bp, Zea mays
  Clone ID: LIB3062-004-Q1-K1-D3
gaatctttgtgtgctcaagttcttcgtgcaaaatatttcccgatgaagaacattccgggggcaagacctaaaggaggaatatcatgttcctatacttggcgagtatcctaaatggattgcaacttttaagaaatgggctgatctggagagttggtaattgcaattctatcaatatttggaaggatccatggaccccacgtggagaaaccaggaagataattactccatccaaggggtcaatccgtcatccaaagagtttatgaactgataaatccatttaagggcttgttcgggtagctctcaatccatatggattgagtgagatttggtggggttaaaatcccagcatggacaaaaggcacacacgtggtccagctttctac

SEQ ID NO: 2209 - DNA, 325 bp, Zea mays
  unsure (1)...(325): unsure at all n locations
  Clone ID: LIB3062-022-Q1-K1-G4
agtgagggccttagagtgctattcagctcacacgacaagtanagcatgacctgcactcccgggccgaggcattcgtacgatcgggtggctcgtggtcagagtccatctgctgatcgaggatgccgagctctgatccgtcaaggaccacttggtcaccactgattacatgacctacatgttcaagtacatctccgtgcacggacaatggtagcacagcgacatatccctaacggtctccaatactcttctattctgcgagatgccagtcaactactttaggatcaggaactccgaagagatcccgtggcgtgaggctggtgctgag

SEQ ID NO: 2210 - DNA, 417 bp, Zea mays
  Clone ID: LIB3062-047-Q1-K1-F4
actatgtctgcgtgtcttacttaattgattgccttaagcccttacaaacttgttatttttcgaagtattactatgtgatcctaaagttattagtgggttgtcctcagcaatttaggtgccgtttggttcaaattttggtaacgtaatgggtaactcataacattaaatcatgtttgtttaagtttaactgtaatcgataccacactacaaatggatagtcttattcaaatttgttactgccggtattcgagtgtgaatcgttaccattaccatttacgttacatttcgtgaaccaaacggcaccttacttttttatagactatgtctccattgttttcattcactttcactgacacataagttccttatcacttatcagctggcagtacttctgtcttctcgccatctatgtcagtc

SEQ ID NO: 2211 - DNA, 345 bp, Zea mays
  unsure (1)...(345): unsure at all n locations
  Clone ID: LIB3062-045-Q1-K1-B5
aacaaccatntacacngaatcntatgntgcactcaaaggtatccttggctacncaagactangatnntgnttccaatgattctgttgganattcaaggtcaatcatctttgatgccaatgctgtnattggactganctcttccttcatgaatntccacgncttgntataacaaccngtgnggctacantacacgggttctggatctgatccntnacatttatcttanganctccananacttnatatttgactanttcnttcagtaccaattatttcctcgataaaaanctgnaanttttacaacnattttctttaaanaatggnttcgaatnnaaaaccaanct

SEQ ID NO: 2212 - DNA, 322 bp, Zea mays
  Clone ID: LIB3062-045-Q1-K1-H6
caaggactccaagacgcttctcttctgcgataagccgttcaccgtctctgtcatcgggaagccctactagatcccgtggggagaggctgtttctcattatactctttagtccacctgtgtcttcactgacaaggacaaatctgccagcacatctgaatggtattgccaaaaaggacgctatctctgccccaagcatatatgcacccatgtttgttcttagtgtcaatgaggacaagctcacctcccatgttaacattgattacaatgctagctgcaccacaaactgacttgctaccctcgctaaggtcaatcatgacaacta

SEQ ID NO: 2213 - DNA, 175 bp, Zea mays
  unsure (1)...(175): unsure at all n locations
  Clone ID: LIB3062-057-Q1-K1-A6
gtgaacgactatanttcaatnnnctacgncatttcagatcgtttttttgccggacgcacgcgttcaataaatgtggatggcgcgtgcctctgtttcttcaggttcatgctgagtcttgacatgtttggcacttttggttccctggctggtaccatctgtgacaaatccgctcgct

SEQ ID NO: 2214 - DNA, 176 bp, Zea mays
  Clone ID: LIB3066-011-Q1-K1-G4
gagcggaattggatgggtttgaatcccaaacaagtcaaacttcttctcaatttttttcaagccgactcaatccatgtgttttgggaataaccgaccaagcccttagtgtgtttgttacttcattccgcatggtttgggcctttgaagttaaaagaatcataagaccttgttcggtt

SEQ ID NO: 2215 - DNA, 107 bp, Zea mays
  Clone ID: LIB3066-035-Q1-K1-C8
cccacgcgtccgcccacgcgtccgaaccactacgatacacccgttataggttgttatcggtaaacttttaacggtcattctatttcaaaagttttgcattttgcact

SEQ ID NO: 2216 - DNA, 384 bp, Zea mays
  Clone ID: LIB3066-021-Q1-K1-B3
tgattatacagtattctgtctctatagattgtagctgcagcagtctgaacatgaaattaacgaacaacctcggtactgcttggccaggatcccggtgctttcaactagttagggctcgttcggttagctctcaatccatgtggattgagtgagattggatgagtttgaatcccaaacaaattaaacttaattttttccaatcccatctaatccatgtgtattgggaataaccgaacaaggctttactgttttatctgtccagcagtaccgaggttgttggttaatttcatgataagagagcgagtttcagcaatgttcgtatactgattatacagtattctgtctctatagattgtagctgcagcagtctgaacaaacatcaat

SEQ ID NO: 2217 - DNA, 233 bp, Zea mays
  Clone ID: LIB3067-016-Q1-K1-F10
accggtgtcttcactgacaaggacaaggctgttgcgcatctgaagggtggtgccaagaaggggggtatctcagccccaagcaaagatgcacccatgttggttgttggagtcaatgaaggcaagtgcaccttggatgtgaacattggttccaatgctagtcgcaccacaaactggcttgctccacttgctaaggtcattcatgacaactttggcattattgagggcctgatgac

SEQ ID NO: 2218 - DNA, 431 bp, Zea mays
  Clone ID: LIB3067-005-Q1-K1-A12
cccacgcgtccgggttattcccaatacacattgattggacgggattggaaaaaattgtgaggaagtttgacttgtttgggattcaaacccatcgaatcccgctcaatccacatggattgagagctaaccgaacaagcccgtaatgtattccttggtttctgctttcccggacgcgtgtgtgcggaagccaaactggatgaggcacttcaaattgatcccaacacgtccgatgcactctggtgcttgggaaatgctcagacctctcatggattcttcactccagacaatgcaatagctaatgagttctttacaaaggcaaccggatgttttcagaatgctgttgatgtggaacctgcaaatgagctgttcaggacgtctttagacttgcaaatgaatgcacctgaactgcatttggatatccaaaagcaaat

SEQ ID NO: 2219 - DNA, 292 bp, Zea mays
  unsure (1)...(292): unsure at all n locations
  Clone ID: LIB3067-055-Q1-K1-H11
ctgtnntnnttactgtcatcacctgaccgcgtccngcgcncggaannccggggcggaccaagcgtgcgaggacagacaagtacacctcgtatgttttcatcgtttacaatgctaaccgcatcacacagtgccttgctacccttgctaagggcattcatgacaacttcggcattggtgacggtctgataacaactgttcatgccattactggcactcatactactgtttactgaccctcatcctaagactgtagaagtgagcaggctcccatctctaacatcattcatagcag

SEQ ID NO: 2220 - DNA, 430 bp, Zea mays
  Clone ID: LIB3068-001-Q1-K1-F4
cgacagatagccgtaacttctgtgctgtgccagccgcatccctgagacaagatggtggaaggtcggagtgaacggattcggccgcatcgggcgcctggtcaccagggctgcttttaattctggcaaagtggacatcgtcgccatcaatgaccccttcattgaccttcactacatggtctacatgttccagtatgattccacccacggcaagttcaacggcacagtcaaggcatagaacgggaagctcgtcatcaatggaaaggccatcaccatcttccaggagcgagatcctgccaacattaagtggggtgatgctggtgctgagtatgtggtggagtccactgggggcttcactaccatggagaaaggctgggctcacttgaagggtggcgccaagagggtcatcatctctgcaccttctgccgatgcc

SEQ ID NO: 2221 - DNA, 504 bp, Zea mays
  unsure (1)...(504): unsure at all n locations
  Clone ID: LIB3068-036-Q1-K1-F4
gttcatgccatcactgccacccagaaactgttgatggaccctnacccaaggactgganaggggggcaggggttgcaagtttnaacataattccaagaagcaccngttcttgcaaaaggttgtcggaaaggggtcnttcctgaattgattggcaagctaatgggntgntcnttccggttnccaacgntgantttttnaattgtaaaccttnattgtnaaaantcaaaaaaggggggccnttttaccggggaaattcaanaaantttttaaaggccntttttangggcccnatttaagggtttttaatggcnntacttnnagnagaatttggttttcacccnantttcccgggtaaaaaaanggntaancnnttttttaaacccaaaggncgggantttcccttaanaaccnccntttntaaaaattntnttttggnaccaanaaacggttngggtntaaaaaaacccnttttttaancctntaccnccatnntttaaaaaaaccc

SEQ ID NO: 2222 - DNA, 492 bp, Zea mays
  Clone ID: LIB3069-019-Q1-K1-H1
tgggtcccggtcgatacagtacatgacagcacgtactcattggcttggaacctttgggctgatttatgtgcttggctctgcttatttgctgcttcttcagtcttctcatctgttagctgttacgggtaagaccaagactggaactaatggtcctggaaggactggtaggtctgcggttagggctgtttcttagagtgaggacgctgagtctgctgttgctaatgattttcctactattatggatcatacgattcatacgcctaagcatgatattgcttatggttatcggaagtatagtgatactatatctaaggatcttaagatttcctctcctggcgataagttggctattgctcccggtactaggaatttcgaggaaactttgcggggcgaggtcggtgtcgagcacgctgcggagcttattggtgctcctatcgataaggataaggtcgtcgtatactctaagggcggcgttaaagagggccgcactct

SEQ ID NO: 2223 - DNA, 292 bp, Zea mays
  Clone ID: LIB3069-025-Q1-K1-F9
ataggtttgacttgtttgggatttaaactctccctatcccactcaatccacatggattgagagctgaccgaacaagcccacacatgtctagttggttcaactgtaccattactagcaggtgatggaccattgggtttatgacaaatggtgacaaatatcatatacacgctctcgcgctcgaaggtcagatcatttttgttgatcttatctagcgaagtgatggcttatatgttcaggatcatgagctcgttgagatgtattgagaggtctctgaatgcttaagttcagacaa

SEQ ID NO: 2224 - DNA, 113 bp, Zea mays
  unsure (1)...(113): unsure at all n locations
  Clone ID: LIB3078-029-Q1-K1-F12
tcgtccacgcgttcgnccacgcgttcggttcaccggcgccgccaaagccgtctcgctggtgctccccaacctcaagggcaagctcaaccggatcgcgctccgggtgcccaccc

SEQ ID NO: 2225 - DNA, 258 bp, Zea mays
  Clone ID: LIB3078-039-Q1-K1-A2
cgacgacgcactcgtacaccggctacctgaggctgctggacgcgtcccaccgcggccgcctgctgtcccgcgcgggggcgctgaacatcgtgccgacgagcacgggcgccgccaaggccgtggcgctggtgctgccgcatctgaaggtgaagctgaactgcatcgtgctgcgggtgccgaccgcgaacgtgtccgaggtggacctggtgatctacaccgtgaagactggcatgacggtcaaggacgtgaacgcggttt

SEQ ID NO: 2226 - DNA, 335 bp, Zea mays
  Clone ID: LIB3079-001-Q1-K1-G1
tcgtcaccgacttcaccggtgacagcaagtcgagcatcttctacgcctatgccgggattgccctgaacgaccacttcatcaagctggtctcttggtacgacaacgagtgggtctacagcaaccgcgtcgtcgacctgatccggcacatgttcaagacccagtagagagagatattgctgcctccctatcgtgggtcgaacccaatggcctgtggtcgcagactattatgtgctgcttagttatgctgagaataaatgtgaacggtgcccctggacgctggatccatgctggatttggacactttgtcttatgtgtgtttaacttatctgctaccg

SEQ ID NO: 2227 - DNA, 337 bp, Zea mays
  Clone ID: LIB36-002-Q1-E1-C8
cccaagcgtcaggacctggtgatcaacaccgtgaagactggcatcacagccgacgacgtgaacgcggcgttccgcaatgccgccgccggccagatgcatggcatcatggatgtctgcgacatgccgcacgtgtccgtcgacttcaggtgctccgacgtgtcctgcatcatcgacgcatcactcagcatggtcatgggcgacgacatggtcaaagtcgtcgcctgttacgacaacgactggtggtacagccaacacgtggttgatctggcgcatctgatggcggcacaagtggcccggcacgacagcagactgcatcagcgaacctcctggaagactt

SEQ ID NO: 2228 - DNA, 332 bp, Zea mays
  Clone ID: LIB36-019-Q1-E1-H2
agatatctggtcattcattactaggactcgtaggacgtcgcaacactctagaatgagtcgtatcatccatgctctccgctaccaccgtgccactccagcaggggggcggcctgtccgagttctccgggctcaggagctccgcgtcgctgcccatgcgccggagtgccgcgtctgacgacgtcatgtccgccgtctccttcaggacgcacgcggtcggcaccagctgtaggtcgcggcgggcgcccacggaggccaagctgaaggtggccatcatcgggttcggccgcagctggcgcaagttcctgcggtgctggcacgggcgcggcgacgcc

SEQ ID NO: 2229 - DNA, 441 bp, Zea mays
  unsure (1)...(441): unsure at all n locations
  Clone ID: LIB36-015-Q1-E1-G8
aagtaatactgctcgactgcacgtatcggctggctacttgccgggctggccncatgcgtcaaccaacgcgtccggtcagttgttgacctcacggtcagaatcgagaacggggcctcttacgaggaactcaagagagctattaaggctgcctctgagggcgcactcaagggtattacgggctacgtcgaggacgatctggttgccaccgacttcagcggtgacagcatgtctagcctctgcgatcccgggggcaggattgcgactgcaactaccagttcatcgcgctcgtcacgtggtaccaccactcagtggggccaccggagccccgtcatcgagctgatccgtcagtcgatctcgacttagtcaacacacagctgtctgcgtcacgaacgccggtcgtccacaaccggactgggtcccacaggaacaatgccacggatc

SEQ ID NO: 2230 - DNA, 395 bp, Zea mays
  Clone ID: LIB83-003-Q1-E1-A11
cccacgcgtccggttgaaacaaacagatatgcacttctatattgattattgaatgaagaacttgtatgtttgtttcaaccggacgcgtgggttctggttttgccaatagctccaatgggcggcaaataggttcttacttcaatagtagttcaaacagattaggcagtccaattggttatgttggccttaatgatgaaattagttggggaaaccttacttctgttcatgggatgggcaacatttcaagccttggaccgggaaaccttggccgtggaaccggagataacaactttggattgccttctggaacctacgtgaggagcaactcaactggtacaattggcgagccattttctgcatcagccaatccatatgaatcgaacaatctaagtgca

SEQ ID NO: 2231 - DNA, 178 bp, Zea mays
  Clone ID: LIB83-007-Q1-E1-C2
atgggatgtgtcacgtgcctataaataggtgaacagtacccccgtactgcgggggctgacttggcatttgctttagcgtcacgcttgtactttcgccttctttcaagccgaaggtacatttgtaatttgatattatttctaattttctataataataatacagaaacgagttgataat

SEQ ID NO: 2232 - DNA, 166 bp, Zea mays
  Clone ID: LIB84-027-Q1-E1-H4
gccggccctagccacgttcactttgcaaggcccggtctagactaccgggccgagccacgcgtccaggcgacttcgtcgaccgcgagggcgcggggaagcacatccaggcgggggccaagaaggtgctcatcacggcgcccggcaagggcgacatccccacctacgt

SEQ ID NO: 2233 - DNA, 87 bp, Zea mays
  Clone ID: LIB84-030-Q1-E1-C10
agcttctatcaagccgaaggtacaaatgtaattcgatattgttcatatttgttcatgataatataataaaactatcttaatgatgtc

SEQ ID NO: 2234 - DNA, 466 bp, Zea mays
  Clone ID: LIB84-016-Q1-E1-E5
tcgctagtctcacaccggcaagccaggtctaggactcgcgggtcgacacaagcctctaaacagacttctattatgaacgaaacaagtactgtctgagctccaagataccccttggagtagttttggcaatcccgccgttcaactatcctgtcaacttagcagtttctaagattggcccagcactaattgcaggcaatgctcttgtgctaaagcctccaactcagggcgctgtggctgcacttcatatggtacactgcttccacctggctggtttcccgaaaggtttgatcagttgtgtgactgggaagggttctgaaataggagattttcttacaatgcatcctggagtcaactgcataagttttactggtggcgatactggtatagccatttcaaagaaggctggaatggtccctcttcagatggagcttgggggaaaagatgcttgcattgtgctagaggatgc

SEQ ID NO: 2235 - DNA, 415 bp, Zea mays
  Clone ID: LIB3062-056-Q1-K1-C9
atcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccc

SEQ ID NO: 2236 - DNA, 398 bp, Zea mays
  unsure (1)...(398): unsure at all n locations
  Clone ID: LIB143-061-Q1-E1-G2
tgattggtgaagtcttgtagttgcatatggttgttcattttctttcttaacacttgctttagacttgaatgaattaagaagggggaaacacttttgtgggtgtaaataatttagttcaagcaataggtaatccaacgatcatgatgcttgttatggtttagtagtagcttatctatgcttttgtgctcgcttttacctgtggttgcatatcaagtattattaaaatgccttgttgtctaaatatgatatattgtgttgggggccttcggcttccgaaggtcctcaaaaacatgatttaacaatgtttctggagtataatgtgtgaacaggtatcttcggacttgaatcagaaagggagaagctcanaagatacgaaagttgacacagtgccgaagctg

SEQ ID NO: 2237 - DNA, 406 bp, Zea mays
  Clone ID: LIB84-012-Q1-E12-B5
gcttggctagataggattaattagttcttggttattgattggtgaagtcttgtagttgcatatggttgttcattttctttcttaacacttgctttagacttgaatgaattaagaagggggaaacacttttgtgggtgtaaataatttagttcaagcaataggtaatccaacgatcatgatgcttgttatggtttagtagtagcttatctatgcttttgtgctcgcttttacctgtggttgcatatcaagtattattaaaatgccttgttgtctaaatatgatatattgtgttgggggccttcggcttccgaaggtcctcaaaaacatgatttaacaatgtttctggagtataatgtgtgaacaggtatcttcggacttgaatcagaaagggagaagctcacaagat

SEQ ID NO: 2238 - DNA, 341 bp, Zea mays
  Clone ID: LIB3067-056-Q1-K1-B4
cccacgcgtccgcatcaccatcctaaccacattaaggcttttcggttagctctcaatccatgtggattgagtgggattggatgagtttgaatcccaaacaagtcaaactttttaagaatttttttcaatctcatccaatccatgtgtattgggaataaccgaacaaggccttagatgtctcgtgagcatggatcggctatggtgattagcatgaatgtgttgtggtaactagttggaagactaaatttcctgacgtttggatgtttgcaactgctatgtactataaagactcctcgtgccacagatgtttttgttaaattagtaacgcttttgcatcttgt

SEQ ID NO: 2239 - DNA, 334 bp, Zea mays
  unsure (1)...(334): unsure at all n locations
  Clone ID: LIB3061-037-Q1-K1-C8
gcaaaaaaaacttcctgaacaggaagaccgaaatgtangtcgaatgcatgcattgctgtaggaggaatagtccactggaggtacatgagcctaaaataatttgtggagtggtggttgacttcagtggtaagtgcctttcagagtgtaccggcatgcccaaaactgaaatttccggtttagatagaattgggggcgcggaagaaggtgccatgtgtgtgtttgtgtgtgttgcctgtggatggaggaattgatgggagtatgtgaactgatgtagctagtctatgtttgttaccattgagggcttgttcggttagctttcaatccatgtggattg

SEQ ID NO: 2240 - DNA, 363 bp, Zea mays
  Clone ID: LIB3059-042-Q1-K1-G12
tcgcggacgcgtgggcggacgcgtggggcatctttgatgctaaggctggcattgccttgagcggcaacttcgtgaagctcgtgtcctggtacgacaactagtggggatacagcacccgcgtggtcgacctgatccgtcacatgaacagcaccaactaagatgaagaactcaagtcaaggtctggtgatacgagcgagttgtcttcttcccccccgggagaaaagtgcttacgagaataaattttttccatcggaatgtctgaaactatgttgggtgtatcctagtggttggttgagcattaatggctcatattttgtcaggtctatgtgtcgccgtgaaacttttaatcaaatcagttcactc

SEQ ID NO: 2241 - DNA, 411 bp, Zea mays
  unsure (1)...(411): unsure at all n locations
  Clone ID: LIB84-002-Q1-E1-A7
gcgacgacatggtcaaggtcatctcctggtacgacaacgagtggggctactcgcagagggtcntcgacctcgctgacatctgcgccaaccagtggaagtgaagcgttgcattgtaatagcactttgtaactcctcaccctccaccgggctttgggattcaccccgaaatgactcactttcggtgaaattcacccgtttcggcgangtcgtccgaatataccggccaaatgtttccattggatttcaattattangtcaactctatagttganacanacatacaaggttcttcattcangtaatcaatatacgaagtgcntatctgtttcntcttcaananaagnngnncggcnggggggcggncnngngnantagtcnanggggnngnannggnggacngcgtgggnggng

SEQ ID NO: 2242 - DNA, 172 bp, Zea mays
  Clone ID: LIB83-001-Q1-E1-E4
ttcaccccgaaatgactcactttcggtgaaattcacccgtttcggcgaggtcgtccgaatataccggccaaatgtttccattggatttcaattattagtcaactctagagttgaaacaaacatacaagttcttcattcaataatcaatatagaagtgcatatctgtttcctc

SEQ ID NO: 2243 - DNA, 464 bp, Zea mays
  Clone ID: LIB3069-013-Q1-K1-H10
ttggatatcatggcctggccctttggtatgatttatgtgcttggctcagcggcagactgtgagtggttgtcctgtccctcggcacgcttccttgcgccttcatcgcggacgctctggacgccgattcgattgctagaactgagaagggggttcttcacgaggacactaagaaagtcaccaaggtcgtccttgagggcttatctaagggcactacgggccacgcggaagaggactcggccctcattgatccttccggcgatagtaggctgagtactcctgatgttaaggttgggactgtctcgaatgattatcctgctaagtctgctctgcggcatgataatgagcggggtcatagtaattgtgctgctgattcgacttgttatacgcctaagatttagcaggggcccccttttttcgtcctctacggacggccgtcgtccgcgcacgttgagaacaaacgcgga

SEQ ID NO: 2244 - DNA, 343 bp, Zea mays
  Clone ID: LIB3078-024-Q1-K1-G1
ggcaatcctgatcagtgatgcaatggagactggaactgtgcagatcaactctgcaccgggtcgtgggcctgatcatttccccttccagggactgaaagacagtggcattgggtcccaggggataacaaacagcattaacatgatgaccaaggtgaagagcactgtcataaacctgccgtcaccatcctacaccatgggctgagatattcttgttaagtgttctatagctccatgagcaatgtagagagttaaatgtttcatagccacgtgagatttggacgctatttacacctcagttcttcctgcagaagatcttttgcaagttaaagaataaagtgcgttg

SEQ ID NO: 2245 - DNA, 372 bp, Zea mays
  Clone ID: LIB3069-038-Q1-K1-F4
cctgatcagtgatgcaatggttactggatctgtgcagatcaactctgcaccggctcgtgggcctgatcatttccccttccagggactgaaagacagtggcattgggtcccaggggataacaaacagcattaacatgatgaccaaggtgaagagcactgtcataaacctgccgtcaccatcctacaccatgggctgagatattcttgttaagtgttctatagctccatgagcatgtagagagttaaatgtttcatagccacgtgagatttggacgctatttacacctcagttcttcctgcagaagatcttttgcagtttaaagaataaagtgcgttgaaagtaaaaaaaataaatattttaaaaatgtttttg

SEQ ID NO: 2246 - DNA, 435 bp, Zea mays
  unsure (1)...(435): unsure at all n locations
  Clone ID: LIB148-039-Q1-E1-A11
ggtnnagtacatcacatcgcgtgtcggccngtannnannntggccggtcgatacaacaccctagattgagtcgtattaggagcatagggaggagggcaacgagggcgacgggttctacggcggcataaggaagctccgcggcaaggatgacatctccaagtggaggcagctgtggccaacagacgtcctggagtaagcaggagccgcatcccttctcacaccgagattgatccatcgctcaaatgacacgcctttctttcatcatattgaccaaattcgtcgtctctgtcgcgctgttgtaaacgggttagcagaagaacacacagggtgacaacaaatccttgttcggttatttctaatacatatggattggatgagattggaaaaaattaagaagaagtttaacttgtttgcgattcaaacacatccaatctc

SEQ ID NO: 2247 - DNA, 421 bp, Zea mays
  unsure (1)...(421): unsure at all n locations
  Clone ID: LIB148-006-Q1-E1-B8
agtgaagcggaaggagcatagggaggagggcaacgagggcgacgggttctacggcggcataaggaagctccgcggcaaggatgacatctccaagtggaggcagctgtggccaacagacgtcctgnagtaagcaggagccgcatcccttctcacaccgagattgatccatcgctcaaatgacacgcctttctttcatcatattgaccaaattcgtcgtctctgtcgcgctgttgtaaacgggttagcagaagaacacacagggtgacaacagatccttgttcggttatttctaatacatacggattggatgagattggaaaagattaagacgaagttaaacttgtttgcaattcagacacatccaatctcattcagttcacatggattgacagctaaccgatcaaccctgtagttggacaag

SEQ ID NO: 2248 - DNA, 381 bp, Zea mays
  Clone ID: LIB148-017-Q1-E1-D6
aggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcgtggggatgtaactgtaagccttgtgacccctaagcagtctgcgtcttgtgcctgctgctgtagcggtagagcagagagagagatcaaatgtaaattacattttttagctcaaattcacgacaaattggttgtcctaaaaaaaaaagaaaaaaaagacaactacataggcaatcaagaattcaatt

SEQ ID NO: 2249 - DNA, 453 bp, Zea mays
  unsure (1)...(453): unsure at all n locations
  Clone ID: LIB148-024-Q1-E1-C10
gggntgngacgtaatatcgcactgcagactcaatactaggactcgtaggacgatacaacactctagactgagtcgtactattgtaaacgggttagcagaagaacacacagggtgacaacaaatccttgttcggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcgtggggatgtaactgtaagccttgtgacccctaagcagtctgcgtcttgtgcctgctgctgtagcggtagagcagagagagagatcaaatgtaaattacatttnttagctcaaattcacgacannnaa

SEQ ID NO: 2250 - DNA, 329 bp, Zea mays
  unsure (1)...(329): unsure at all n locations
  Clone ID: LIB148-058-Q1-E1-D8
aggtctctgtcgcgctgttgtaaacgggttagcagaagaacacacagggtgacaacaaatccttgttcggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcngtgggggaantggnntttaaaaaancccnnttgggnnnttttaaaaaaaaaaggggggcccccccc

SEQ ID NO: 2251 - DNA, 422 bp, Zea mays
  unsure (1)...(422): unsure at all n locations
  Clone ID: LIB143-040-Q1-E1-H8
acgcctttctttcatcatattgaccaaattcgtcgtctctgtcgcgctgttgtaaacgggttagcagaagaacacacagggtgacaacaaatccttgttcggttatttctaatacatatggattggatgagattggaaaaaattaagaagaagtttaacttgtttgcgattcaaacacatccaatctcattcaattcacatggattgagagctaaccgaacaagcctgtagttggacaagggtgtaacacttatttgtcaggcgtaccgggcacagaccgcttcctatttgttcgtggggatgtaactgtaagccttgtgnaccctaagcagtctgcgtcttgtgcctgctgctgtancggtagagcagagagagagatcanatgtanattacattttttagctcaaattcacgacaaattg

SEQ ID NO: 2252 - DNA, 408 bp, Zea mays
  Clone ID: LIB148-057-Q1-E1-H7
atcgtttaagaaattcgccgcttgatgtgtggatccgtcgcggctgccgtcaagcatagacaccaagaaccagacctcggggtggatcatcggggtcgcggaggtctactggatggggtcaagaagtatccgggcaagtcgtctctgggaaccctgcttattgctcgccggatgctagcgccgccgtggactgcgcggctccgagaagtcgaggtcgtcgcgacatatcccaggaaccttcggacttggaacgaagctgtccataatatggaaagcatgattgggacgaaggtcgaatcaattctgaagctatgcgcaaggaagcttcggctcagtagcagaaaaaggaaccgacctaaaaaggaaaaggctatttagtcctcgatagattgtccttaagtcaattgt

SEQ ID NO: 2253 - DNA, 373 bp, Zea mays
  Clone ID: LIB36-012-Q1-E1-B4
gaggctccgcctgatatcgctcgcaccctcctatacgtatacataattattatagggaacatatctggtgcatatataaatttagtgtacatggtgcatatattaaatcagcattactcattttagatataatgtctctagttgttggtatattttgctaagaacaccctccgacgtggtgaagtatagcggtggaaaatattatttataaattgcaatgatcaactagagacgttaaatctaaaataaatagtgatgatttaatatgtgcaccatatatactaagcttcgatgtacaccagatatgtcctcgttattacatgtacacgaggtatgatatgcattccatgttttcgtggtggtttcgattgag

SEQ ID NO: 2254 - DNA, 353 bp, Zea mays
  Clone ID: LIB36-002-Q1-E1-A4
cggacgcgtgggcggacgcgtgggccggctgctacgcttgccatccacctccaccttcgtctcgctgtcctagatgtttgctgtatgaatcgcatagtagatcatgttctctattcctgccttcagtttcttttctcagttgtggtttatcgcggcggggttgatgttgagatttgagatcctcacctgaggaatggaaaaatgctcacctgaggaatggaaaaatggtaagggcttgttcggttattcctatcccatgtggattggatgggattggaaaaaattatgaaagattttaacttgtttgagattgaaatccatccaatcccacctataaatgaaagtcaaaattt

SEQ ID NO: 2255 - DNA, 265 bp, Zea mays
  Clone ID: LIB36-013-Q1-E1-F8
gtataaccatttcaaagaaggctggaatggtccctcttcagatggagcttgggggaaaagatgcatgcattgtgctagaggatgcatatctggatttggtttccgcaaatatagtaaagggtggcttctcatacagtggccagaggtgcactgctgtcaaagtactgctgatcatggaatcgattgctgatgctgtggtacagaaggttaatgccaatttggcgaaactgaaagttggcccacctgaggacgactctgatatcac

SEQ ID NO: 2256 - DNA, 409 bp, Zea mays
  Clone ID: LIB3062-009-Q1-K1-B6
gcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgc

SEQ ID NO: 2257 - DNA, 428 bp, Zea mays
  Clone ID: LIB3059-029-Q1-K1-E5
atcggcaggctcgtggccagggtcgccctgcagagcgaggatgtcgagctcgtggccgtgaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcacccatgtttgttgttggtgtcaatgaggacaagtacaccttcgatgttaacattgtttccaatgctagctgcaccac

SEQ ID NO: 2258 - DNA, 425 bp, Zea mays
  unsure (1)...(425): unsure at all n locations
  Clone ID: LIB3066-001-Q1-K1-C3
cccacgcgtccgcggacgcgtgggcactcgcgaactccatttcgatcccatttgaaatcaacccatcctcgtttcctccgtctagcagcctctcaccctcatggccaagatcaagatcgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttccgttggcgctgaatatgttgntgagtctactggtgttttcactgaccaagaga

SEQ ID NO: 2259 - DNA, 435 bp, Zea mays
  unsure (1)...(435): unsure at all n locations
  Clone ID: LIB3067-029-Q1-K1-F10
tgtcgagctcgtcgccgtgaacgaccccttcatcagcaccgactacatgacctacatgtgcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcactagaaaggtggtgccaagaaggttgtcatctctgctcctagcaaggatgcccccatgtttgtcggtggtgtcaacgagaaagagtacaagtctgacattaacattgtctncaatgctagctgcacaaccaactgccttgctcctcttgctaaggtcatcaatgacaagttcggtat

SEQ ID NO: 2260 - DNA, 422 bp, Zea mays
  Clone ID: LIB3062-012-Q1-K1-C5
gctgcctccgcctctcgagtctcgtccacccgtcgtcctcctagctcctctactggccggtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaag

SEQ ID NO: 2261 - DNA, 417 bp, Zea mays
  Clone ID: LIB3061-011-Q1-K1-H1
cacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaagttgctgtgtttggctgcaggaaccctgaggagatcccatggggttcggttggcgctgaatatgttgctgagtctactggtgttttcactgaccaggagaaggctgcagctcac

SEQ ID NO: 2262 - DNA, 422 bp, Zea mays
  Clone ID: LIB3061-034-Q1-K1-H6
acacactcgagaactccatttcgatctcatttgaaatcaacccatcctcgtggcctgggtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttga

SEQ ID NO: 2263 - DNA, 420 bp, Zea mays
  Clone ID: LIB3061-011-Q1-K1-D5
tcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagcaagctgatatctctgccccaagcaaagacgcacccatgtttgcagttggtgtcaatgaggacaagtacacctcggatg

SEQ ID NO: 2264 - DNA, 414 bp, Zea mays
  Clone ID: LIB3068-026-Q1-K1-E3
cggacgcgtgggcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtg

SEQ ID NO: 2265 - DNA, 403 bp, Zea mays
  unsure (1)...(403): unsure at all n locations
  Clone ID: LIB3061-034-Q1-K1-A7
ctcatttgaaatcaacccatcctcgtttcctccgtctagcagcctctcacccgcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgctgagtctactggtgttttcactgaccaggagaaggctgcagctcacttgaanggtg

SEQ ID NO: 2266 - DNA, 456 bp, Zea mays
  Clone ID: LIB143-006-Q1-E1-F5
aaccgcacgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggatgttgctgtgtttggctgcaggaaccctgaggagatcccgtggggttcggttggtgctgaataggttgttgagtccactggtgttttcactgacaaggagaaggctgcagctcacttgaagggtggtgccaagaaggttgtcatctctgctcctagcaaggatgcccccatgt

SEQ ID NO: 2267 - DNA, 389 bp, Zea mays
  Clone ID: LIB3068-008-Q1-K1-H2
ctttcccctacctctccagcatctcccgtctccgtcgtctcgtctccgctcctcacctgggcagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaagga

SEQ ID NO: 2268 - DNA, 417 bp, Zea mays
  Clone ID: LIB3060-001-Q1-K2-C11
agctcccatatccgctcccctacctctccagcatcctcccgtctccgtcgtctcgtctccgctcctgacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaagagatcccgtggggtgaggctggtgctgagtatgtcgtggagtccaaccgtgtcttcactgacaaggaccaggctgctgcaca

SEQ ID NO: 2269 - DNA, 418 bp, Zea mays
  Clone ID: LIB3059-042-Q1-K1-G11
ccgacgcgtccgcaagatcaagatcggtttcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtctactggtgttttcactgaccaggagaaggctgcagctcacttgaagggtggtgccaagaaggttgtcatttctgctcctagcaaggatgcccccatgttcgttgttggtgtc

SEQ ID NO: 2270 - DNA, 395 bp, Zea mays
  Clone ID: LIB3060-053-Q1-K1-H6
agctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactg

SEQ ID NO: 2271 - DNA, 402 bp, Zea mays
  Clone ID: LIB3062-001-Q1-K2-B9
cgagtctcgtccacccgtcgtcctcctagctcctctactcgccagtcgccatgggcaagagtaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggcgtgaggctggcgctgagtatgtcgtggagtccaccggcgtcttcactgacaaggacaaggctgctgcacatctcaagggtggtg

SEQ ID NO: 2272 - DNA, 447 bp, Zea mays
  Clone ID: LIB143-050-Q1-E1-C2
attcattcagccagcaagcacaggatcgaggactcgcgggtcgacacacgcctctacactaaatctccatatcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgctgaatatgttgttgagtccacgggtgttttcactga

SEQ ID NO: 2273 - DNA, 435 bp, Zea mays
  Clone ID: LIB3059-002-Q1-K2-D10
cacacactcgagaactccatttcgatctcatttgaaatcaacccatcctcgttggctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaaccctgaggagatcccatggggttcggttggcgcttgaatatgttgttgagtctactggtgttttcactgaccaggagaaggctgcagctcacttgagggtggtgcca

SEQ ID NO: 2274 - DNA, 399 bp, Zea mays
  Clone ID: LIB3066-021-Q1-K1-G1
atcacacacactcgcgaactccatttcgatcccatttgaaatcaacccatcctcgtttcctccgtctagcagcctctcaccctcatggccaagatcaagatcgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagaagttgctgtgtttggctgcaggaaccctgaggagatcccatggggttccgttggcgctgaatatgttgttgagtctactggtgttttcact

SEQ ID NO: 2275 - DNA, 388 bp, Zea mays
  Clone ID: LIB36-006-Q1-E1-G10
accacgcatccgatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaaaaaggttgttatctctgccccaagcaaagatggcaccatgtttgttgttggtgtcaatg

SEQ ID NO: 2276 - DNA, 408 bp, Zea mays
  Clone ID: LIB3061-013-Q1-K1-D10
cacagatcacacacactcgagatctccatttcgatcccatttgaaatcaacccatcgtcgtgtcctccgtctagcagcctctcaccctcatggccaagatcaagatcgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggtcgctgtgtttggctgcaggaaccctgaggagatcccatggtgctcggttggcgctgaatatgctgtcgagtctactggtgttttcactgacc

SEQ ID NO: 2277 - DNA, 408 bp, Zea mays
  Clone ID: LIB3062-035-Q1-K1-B9
gcgccgctgcctccgcctctcgagtctcgtccacccgtggtcctcctagctgctctactcgccaggggggatgggcaagattgagatcggaatcaacggcttcggaaggatcggcaggctcgtggccagcgtcgccctccagagcgaggatgtcgagctcgtcaccgtcaacgaccccttcatcaccaccgactacatgacctacatgttcaagtacgacaccgtccacgggcactggaagcacagcgacatcacactcaaggactccaagacccttctcttcggtgacaagccggtcaccgtctttggcatcaagaaccctgaggaaatcccgtcgcgtgaggctggcgctgactatgtcacggagtccaccggcgtctatactgacaaggacaaagctgctgcaca

SEQ ID NO: 2278 - DNA, 415 bp, Zea mays
  unsure (1)...(415): unsure at all n locations
  Clone ID: LIB3068-002-Q1-K1-D3
cccacgcgtccgcccctacctctccagcatctcccgtctccgtcgtctcgtctccgctcctgacctcgcgagccatgggcaagatcaagatcggaatcaacggtttcggaaggatcggcaggctcgtggccagtgtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctntggcatcaggaaccccgaggagatcccgtggggtgaggctggtgctgagtatgtcgtggagtccaccggtgtcttcactgacaaggacaaggctgctgcacatct

SEQ ID NO: 2279 - DNA, 392 bp, Zea mays
  Clone ID: LIB3059-030-Q1-K1-E12
cacacactcgagaactccatttcgatctcatttgaaatcaacccatcctcgtttccggcgtgtagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagaagttgctgtgtttggctgcaggaaccctgaggagatcccatggggttcggttggcgctgaatatgcttgtgagtctactggtgttttc

SEQ ID NO: 2280 - DNA, 395 bp, Zea mays
  unsure (1)...(395): unsure at all n locations
  Clone ID: LIB3059-048-Q1-K1-D4
cacacactcgagaactccatttcgatctcatttgaaatcaacccatcctcgtttcctccgtctggcaggctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagangttgctgtgtttggctgcaggaacccctgaggagatcccatggggttcggttggcgctgaatatgttggtgagtctactggtgttttcac

SEQ ID NO: 2281 - DNA, 421 bp, Zea mays
  Clone ID: LIB143-025-Q1-E1-E8
aggggtgtgcagcattgttcagctgtacagtacggacaagaattcccgggcccgagtctcgtccaaacgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgaca

SEQ ID NO: 2282 - DNA, 417 bp, Zea mays
  unsure (1)...(417): unsure at all n locations
  Clone ID: LIB143-057-Q1-E1-E6
cacacactcgagaactccatttcgatcgcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgacgtcaaggtgaacgactccaagacccttctctttggtgagaacgacggtgctgtgtctggctgcaggaaccctgaggagatcccatggggttcggttggcgctgaatatgttgttgagtctactggtgtnttcactgaccaggagaaggctgcagctc

SEQ ID NO: 2283 - DNA, 396 bp, Zea mays
  Clone ID: LIB143-015-Q1-E1-F12
actccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaagctgctgcacatctg

SEQ ID NO: 2284 - DNA, 439 bp, Zea mays
  Clone ID: LIB3060-049-Q1-K1-H7
cgccggctttaaaaacgcacacaagcgctaaaaccctctccagcgtccacctcagctggcatatccgctccgctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtgctgagtatgtcgtggagtccaccggtg

SEQ ID NO: 2285 - DNA, 363 bp, Zea mays
  Clone ID: LIB143-025-Q1-E1-H7
cctcagctcccatatccgctcccctacctctccagcatcctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactccaagacgcttctcttcggcgagaagccggtcaccgtctttggcatcaggaaccccgaggagatcccgtggggtgaggctggtg

SEQ ID NO: 2286 - DNA, 369 bp, Zea mays
  Clone ID: LIB84-027-Q1-E1-F5
acgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgccgagtatgtcgtggagtccaccggcgtcttcactgac

SEQ ID NO: 2287 - DNA, 456 bp, Zea mays
  Clone ID: LIB36-003-Q1-E1-C2
aggtgggcagactggtaccctgagtagcgtctaaatcagggtcgacgacccgtccgccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagcttgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgaatatgtcgtggagtccaccggtgtcttcactgaccaggac

SEQ ID NO: 2288 - DNA, 436 bp, Zea mays
  Clone ID: LIB3067-032-Q1-K1-B12
tcgcggacgcgtgggtcgcccacgcgtccgttcactcgtccgctcgagaactccatttcgatggcaggttgaaatcaacccatcctcgtttcctccgtctagcagcctctcaccctcatggccaagatcaagatcgggatcaatgggtttggcaggatcggaaggctggtggccagagtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctctggtgagaaggaggttgctgagtttggctgcaggaaccctgatgagatcccatggggttcggttggcgctgaatatgttcgtgagtctactggtgttttcactgacc

SEQ ID NO: 2289 - DNA, 449 bp, Zea mays
  unsure (1)...(449): unsure at all n locations
  Clone ID: LIB3069-038-Q1-K1-F9
cccttctcttcggtgacntgccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattggttccaatgctagctgcaccacaaactgccttgttcccttgctaaggtcattcatgacaacttcggcattgntganggtttgatgacaactggtcatgccatactggcacacaagaaactgttgacggacccttaagccaaggctggaaaaggtggcaaggcttgcaactttaacataattctagcaacaccgtgcttgccaaggt

SEQ ID NO: 2290 - DNA, 388 bp, Zea mays
  Clone ID: LIB3066-021-Q1-K1-G2
atcacacacactcgcgaactccatttcgattccattttaaatcaacccatcctcgtttccggcgtgtggcagcctctcaccctcatggccaagatcaagatcgggatcaatgggttcggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaagactccaagacccttctctttggtgagaaggaggttgctgtgtttggctgcaggaaccctgaggagatcccatggggtttccgtggcgcttaatatggttgtgagtctactg

SEQ ID NO: 2291 - DNA, 351 bp, Zea mays
  Clone ID: LIB3069-043-Q1-K1-A1
gtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactga

SEQ ID NO: 2292 - DNA, 374 bp, Zea mays
  Clone ID: LIB3060-020-Q1-K1-A12
ctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatccccgtgggtgaggctggtgctgagtatgtcgtggagtccaccggtgtcttcactgac

SEQ ID NO: 2293 - DNA, 505 bp, Zea mays
  unsure (1)...(505): unsure at all n locations
  Clone ID: LIB143-014-Q1-E1-F8
gcggggtaggaactgttacgacagcctggtctggtgccaatncaagcattcgccgggccacccacgcgaccgcagtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgcaaagaaggttgtcat

SEQ ID NO: 2294 - DNA, 397 bp, Zea mays
  Clone ID: LIB3066-021-Q1-K1-G3
atcacacacaatctcgaactcgctttggatttcatttagcatcaacccatgctcgattccggcgtggagactctctcatggtaatggcccagatcaagatcgggatcaatgggttcggcaggatcggaaggctggaggccagggtggacctgcagagcgacgacgtcgagctcgtcaccgtgaacgaccccttcatcagcaccgattacatgacctacatgttcaagtatgacactgtgcacggacagtggaagcaccatgaggtcaaggtgaaggactccaagacccttctctttggtgagaatgatgttgctgtgtttggctgcacgaaccctgaggagatcccatggggtttccgtggcgctgaatatggtggtgagtctacttgtgttttcac

SEQ ID NO: 2295 - DNA, 315 bp, Zea mays
  Clone ID: LIB3066-004-Q1-K1-G9
gcaagatcaagatcggaatcaacggtttcggaaggatcggcaggctcgtggccagggtggccgtgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtcgggtgaggctggtgctgagtatgtcgtggagtccaccggtgtcttcactgaca

SEQ ID NO: 2296 - DNA, 326 bp, Zea mays
  Clone ID: LIB143-055-Q1-E1-B3
actacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaacgttgttatctctgccccaagcaaagatgcacccatgtttgttgttggtgtcaatgaggacaagtacacctccgatgttaacattgtttccaatgct

SEQ ID NO: 2297 - DNA, 407 bp, Zea mays
  Clone ID: LIB3060-046-Q1-K1-C4
cagctcccatatccggtccccttaccttctcagcatctcccgtctccgtcgtctcgtcgctgctcctcagctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggac

SEQ ID NO: 2298 - DNA, 445 bp, Zea mays
  Clone ID: LIB3060-012-Q1-K1-E9
gctgcctccgcctctcgagtctcgtccacccgtcgtcctcctagctcctctactcgggagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaacccctgaggaaaatcccgtggggtgaggctggcgctgagtatgtcgtggagtccaccggcgtcttcactgacaaggacaaggctgctgcacatctcaagggtggtgccaagaaggtgttatctctgccccaa

SEQ ID NO: 2299 - DNA, 423 bp, Zea mays
  Clone ID: LIB3066-037-Q1-K1-A2
gcgtgattgagttcattcgcactgacgaactttcggtcctgattcccggtcgaccacgcgttcgggacgcgtgggctcgccagccatgggcaagatcaagatcggaatcaacggcttcggaaggatcggcaggctcgtggccagtgtcgccctgcagagcgaggatgtcgagctcgtcgccgtcaacaaccccttcatcaccacggattacatgacctacatgttcaagtactacaccgtgcacggccaatggaagcacagcgacatcaccctcaaggactccaagacgctgatattctgcgagaagccggtcaccgtatttggcatcaggaaccccgaggagatcccgtggtgcgaggctgctgctgagtatgtcgtggagtccaccggtgtcttcactgacaaggacacggctgctgcaca

SEQ ID NO: 2300 - DNA, 374 bp, Zea mays
  Clone ID: LIB3067-031-Q1-K1-G12
cggacgcgtgggtcgcccacgcgtccgcccacgcgtccgctcgagaactccgggtcgagctcatttgaaatcaacccatcctcgtttcctccggctagcagcctctcaccctcatggccaagatcaagatcgggatcaatgggtttggcaggatcggaaggctggtggccagggtggccctgcagagcgacgacgtcgagctcgtcgccgtgaacgaccccttcatgagcaccgattacatgacctacatgttcaagtatgacactgtgcacggacagtggaagcaccatgaggtcaaggtgaaagactccaagacccttctctttggtgagaaggacgttgctgtgtttggctgcaggaaccctgatgagatc

SEQ ID NO: 2301 - DNA, 419 bp, Zea mays
  unsure (1)...(419): unsure at all n locations
  Clone ID: LIB143-049-Q1-E1-D6
ggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaaagatgcgcccatgtttgttgttggtgtcaatgaggacaagtacacctccgatgttaacattgtttccaatgctanctgcaccacaaactgccttgctccccttgctaaggtcattcatgacaactttggcattattganggcttgtgacaactgttcatgccaatcactggccacccaaaagactgtttattggaccctcaagccnanggactggganaagttgcaagggctgccnaccntttaannatnaattccccag

SEQ ID NO: 2302 - DNA, 375 bp, Zea mays
  Clone ID: LIB3060-022-Q1-K1-E7
gctgcctccgcctctcgagtctcgtccacccgtcgtcctcctagctcctctactcgccagtcggcatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggacctccaaaaccttcttttccgtgaccagcccgtcaacggctttggcatcaagaaccctgaagaaatcccgtggggtgaggcttgcccttaatatgtcctggagtccaacggcgttt

SEQ ID NO: 2303 - DNA, 378 bp, Zea mays
  Clone ID: LIB143-012-Q1-E1-C2
aactgtacctccagggccggtaggaatacggcgtcggcccacgcgaccgctcatttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggt

SEQ ID NO: 2304 - DNA, 362 bp, Zea mays
  Clone ID: LIB36-006-Q1-E1-D9
accacgcatccgctctctctacaattatcactacctgctgctccctcatgcaccgtgctcaaatctgaccaaagtgggttctgctgactgttttttgtttttttggggtctctcgatcttctctggatgcaggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtc

SEQ ID NO: 2305 - DNA, 451 bp, Zea mays
  Clone ID: LIB3060-001-Q1-K2-C12
gcgagctcccatatacgctcccctacctctccagcattctcccgtctccgtcgactagacggggctccgtacctctccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacgtacatgttcaagtacgacaccgtgcacggccaatggaagcacagcgacatcgccctcaaggactgcaagacgcttctcttcggctagaagccggtcaccgtctttggcatcaagaaccccgaagagaatcccatgtgtgaggctggagctgagtatgtcgtggagtccaccggtgtcttcactgacaatgacaatgctgctgcacatctgatgggtggtgccaagaaagtttttatt

SEQ ID NO: 2306 - DNA, 445 bp, Zea mays
  unsure (1)...(445): unsure at all n locations
  Clone ID: LIB143-063-Q1-E1-G8
gggcctncagtagacatcatacttgcagacggcagacgcaggacntaaaagncncgggccgacccacacgtccattcaaatccatccatcctcgtctcctccgtcccgcagcatctcaaccccatggccaagatcacgatcgggatcaatgggttcggcaggatcggaaggctggtggccacggtggccctgcagagtgactatgtcgagctcgtcgccgtgaacgacgccttcatcagcatcgactacatgacctacatgttcaagtacgacactgtgcacggacagtggaagcaccatgaaatcaacgtgaaggactccaaaacccttctctttggtgagaaggaagttgctgtgtttggctgcaggaaccctgacgagatcccgtggggttcggttggtgctgaataggttgttgagtctactggtgttttcactgaccagg

SEQ ID NO: 2307 - DNA, 406 bp, Zea mays
  unsure (1)...(405): unsure at all n locations
  Clone ID: LIB3060-028-Q1-K1-E1
taggaagcgagtgttgagnccggctccacgctcaccatcgcaccgccatggaattcccgggctcgtagctcctctactcgcgagtcgccatgggcaagattaagatctgaatcaacggcttcggaaggatcggcaggctcntgaccggggtcgccctccagagcgaggatgtcgagctcgtcgacgtcaacgaccccttcatcaccacggactacatgacctacatgttcaagtacgacaccgtccacggccactggaagcacagctacatcacactcaaggactccaagacccttctcttcggtgacaagccggtcaccgtctttggcatcaggaaccctgatgaaatcccgtggggtgaggctggcgctgagtatgtcgttgagtacaccggcgtcttcactga

SEQ ID NO: 2308 - DNA, 341 bp, Zea mays
  Clone ID: LIB3061-001-Q1-K2-H1
gtctctgctactcacctagccgccagtcatgggcatgatcaagatcggaatcaacgggttcggaaggatcggctggctcgtggtcagggtcgtcctgcagagcgaggatgtcgagctcgtctgcgtcaacgaccgcttcatcaccacggattacatgacctacatgttcaagtacgacaccgtgcacggtcaatggaagcacatgcgacattaccctcaaggactccaagacgcttcttgttggcgagaagccggtcaccgtctttggcatcaagaacctccgagagattccgtgatgtgaggctggtgctgtatatgtcgtgcagtccatcggtgtcttc

SEQ ID NO: 2309 - DNA, 392 bp, Zea mays
  Clone ID: LIB143-017-Q1-E1-G4
ttgaactcgacagctgccagtctagaatcacgggtcgacgcccgcgtccacccacacgtccgcgatctcgtttcaaatccagccatcctcgtttcctccgtcccgcagcatctcaaccccatggccaagatcaagatcgggatcaatgggttcggcaggatcggaaagctggtggccagcgtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttc

SEQ ID NO: 2310 - DNA, 824 bp, Zea mays
  unsure (1)...(824): unsure at all n locations
  Clone ID: 30-LIB84-007-Q1-E1-H5
tcagctcccatatccgctcccctacctctccagcatctcccgtctccgtcgtctcgtctctgctcctcacctcgccgccangccatgggcaagatcaagatcggaatcaacggtttcggaaggatcggcangctcgtggccagggtcgccctgcagagcgaggatgtcgagctcgtcgccgtcaacgaccccttcatcaccacngattacatgacctacatgttcaagtacgacaccgtgcacggccaatggaagcacagcgacatcaccctcaaggactccaaggacgcttctcttcngcgagaagccggtcancgtctttggcatcatggaancccgangagatcccgtggggtganggctggtgcntgagtangtcgtgggagttccancgggtggtcttcacnnacaaaggacaaaggcntgctggcacatctggaaggggtcggtngccaaagaaagggtttgttatcgtctggcgcccaaggcaangtgangcannccaangtttggtntggtngggtgtcaaatgaatggnnaangtncancttcccgnntggtnaaanatttgntttncaaanggntatngcgngnagcnacaannngngccnttgggtcccncttggcnnagtggtnaattcantnnaccnancntttggganctaantgangggncttnntttncnganctgngttcatgnncancaaantgncaanccangnananctggtttgatgggnnccncnagccgananggnncngngtcaanggtgggaanggacggcagannctttnaaagtccantcgcnaagntannaatctg

SEQ ID NO: 2311 - DNA, 328 bp, Zea mays
  Clone ID: LIB3061-056-Q1-K1-F11
acgccgtcatcgatctcgtttcaaatccatccatcctcgtttcctccgtcccgcagcatctcaacccgatggggaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaagttgctgtgtttggctgcaggaaccctgaggagat

SEQ ID NO: 2312 - DNA, 385 bp, Zea mays
  Clone ID: LIB3062-023-Q1-K1-F7
ccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttggtggtgtcaatgaaggcaaggtccacttggatggtaaccatggtttcaattgttagttgaacaaaaaatggcttggttcccttggtaaaggcattcatgaccaccttggcattggtgaagggttgaagaccac

SEQ ID NO: 2313 - DNA, 378 bp, Zea mays
  Clone ID: LIB3068-055-Q1-K1-G2
tcgcgcagggctgccagctttaacatcattcccagcagcaccggtgctgccaaggctgtcgggaaggttgttcctgaattgaatggcaagctcactggcatgtccttccgggttcccaccgtggatgtgtcagctgtagacctcactgtcagaatcgagaagggggcctcctacgaggaaatcaagaaagctattaaggccgcttctgagggcccactcaagggtatcattggctacgtggaggaggatctgagttccaccgactttcaccggtgacagcaggtcgagctttttcgacgccaaggccggtattgccctgaacgaccacttcatcaagctcgtctcgtggtacgacaacgagtggtgctacagcaaccg

SEQ ID NO: 2314 - DNA, 342 bp, Zea mays
  Clone ID: LIB143-050-Q1-E1-C3
aacgatctcatttgagatcaacccatcctcgtttcctccgtctagcagcctctcaccctcatggccaagatcaagatcgggatcaatgggtttggcacgatcggaaggctggtggccagcgtggccctgcatagcgacgacgtcgagctcggcaccgtgaacgaccccttcagcagcagcgattacatgacctacatgttcaagtatgacactgtgcacggacagtggaagcaccatcaagtcaaggtcaatgaccccaacacccttctctttggtgagaaggacgttgctgtatgtggctgcaggaatccgcaggagatcccatggggttcggttggcgct

SEQ ID NO: 2315 - DNA, 371 bp, Zea mays
  Clone ID: LIB3061-005-Q1-K1-B3
ctcccagttcgatccccatttgaaaacaacccatccttcgttcctccgtctagcagccgctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaagaggttgctgtgtttggctgcaggaaccctgaggagatcccatggggttcggttggcgctgaatatgttgttgagtctact

SEQ ID NO: 2316 - DNA, 293 bp, Zea mays
  Clone ID: LIB3068-051-Q1-K1-C5
cggacgcgtgggcgagcatcttcgacgccaaggccgggattgccctgaacgacgacttcgtcaagctcgtgtcgtggtacgacaacgagtggggctacagcaaccgcgtcgtcgacctgatccgccacatgttcaagacccagtaggctagtagagagatagatttctgcctccctatcgtgggtcgtccccaatggcctttggtcgcagaccatctttgctgcttgtctatgctgagaataaatgtgaacggtgcccctggacgctggatccatgctggttttggacaaatt

SEQ ID NO: 2317 - DNA, 298 bp, Zea mays
  unsure (1)...(298): unsure at all n locations
  Clone ID: LIB3068-021-Q1-K1-C5
cccacgcgtccgtcgagtctcgtccacccgtcgtcctcctagctactgtactcgccagtcgccatgggcaagattaagatcggaatcaacggcttcggaaggatcggcaggctcgtggccagggtcgccctccagagcgaggatgtcgagctcgtggccgtcaacgaccccttcatcaccacggactacatgacctacatgttcaagtacgacaccgtccacggncactggaagcacagcgacatcacactcaaggactccaagacccttcttttcggtgacaagccggtcaccgtct

SEQ ID NO: 2318 - DNA, 331 bp, Zea mays
  Clone ID: LIB3059-002-Q1-K2-D11
cacacacttgagaactccatttcgatctcatttgaaatcaacccatccttgtgtccttcgtctgagcatcctttcaccctcatggccaacatcaagatcgggatcaatgggtttggcatgatcggaaggcttgtggccattgtggccctgcacagctacgacgtcgagctcgtagccgtgaacgaccccttcatcagcacctattacatgacctacatgttcaagtatgacactgtgcactgacagtggaagcaccatgaggtcaacgtgaacgacttcaagacccttctctttggtgagaaagaggctgctgtgtttgactgcacgaacc

SEQ ID NO: 2319 - DNA, 257 bp, Zea mays
  Clone ID: LIB143-029-Q1-E1-E1
gctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgttttgcacttttgcttcccttcctgctaccatctgtgacagaaccgctcgctaatatgggacctgagattagctttttgctgcttgtggtgat

SEQ ID NO: 2320 - DNA, 249 bp, Zea mays
  Clone ID: LIB3062-016-Q1-K1-E1
gaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtgtccaatgctatctgcacaac

SEQ ID NO: 2321 - DNA, 349 bp, Zea mays
  unsure (1)...(349): unsure at all n locations
  Clone ID: LIB3062-035-Q1-K1-H4
atgggatggnnnntnnttngnggctaacgccntagtacgtagncgactgtactgaattcccggatccgggtcggcccacgcgtacgctgggagatagagagaggagagggattgttttctcaaagagaaccttaacccaaacggcatgttcgcactgcagagcgaggatgtcaagctcgtcgccgtcaactaccccttcatcaccacggattacatgacctacatgttcaagtacgacaccgtgcactgccaatttaagcacatcgacatcaccctcaaagactccaagacgcttctcttctgctagaatccggtcaccgtctttggcatcatgaacccctaagagatc

SEQ ID NO: 2322 - DNA, 308 bp, Zea mays
  Clone ID: LIB189-023-Q1-E1-F1
cggactcgtgggcgacgccaaggccgggatcgctctgaacgaccacttcgtcaagctcgtctcgtggtacgacaacgagtggggcgacagcacacgcgtcgtcgacctgatccgccacatgttcaagacccactagacgggttttttccccctgcttctcatggatggttgcagcttgtgtacgccgacaataaatctggatcgcgcgtgcctctgggtcgccaggttcatgctgagtcaggacatgttttgcactttagcatcccttcctgctaccatctgtgaaagaaccgctcgctaatacggga

SEQ ID NO: 2323 - DNA, 465 bp, Zea mays
  Clone ID: LIB143-067-Q1-E1-H11
ggtcggagtaacgtcagctggcgcgccggtcgagatagcgggtccagcacgcgtccgacgcaaatccgctcccctacctctccagcatcctcccgtctccgtcgtctcgtctccgctcctcacctcgccagccatgggcaagatcaagatcggaatcaacggtttcggaaggatcgggaggctcgtggccagggtcgccctgcagagcgaagatgtcgagctcgtcgccgtcaacgaccccttcatcaccacggagtacatgacgtacatgttcaagtacgaaaccgtgcacggcaaatgaaagcaaagcaaaatcggccttcaaggaccccaaaacccttcccttcggcaaaaacccggtcaccgtctttggaatcaggaaccccaaggaaatcccttggggtaaggctggtgctaagtatgtcgtggagtccaccggtgtcttcactgacaaggacaaggctg

SEQ ID NO: 2324 - DNA, 298 bp, Zea mays
  Clone ID: LIB3061-024-Q1-K1-C11
gcacccgagtggtcgacctgatccgccacatgaacatcaccaagtaaatgaacaaagtgatgaaaacatgcaaagagtgatgaaagcatgcagagagagttgtgtttcttccccggaagtgcttccgagaataaatttttcttatctgattgtctaaaacctataacgggtgtaatggtatcgtagtggttggctgagcatcatgtgactcatattttgtcaggtctatgtgtcatccttaaacttgtaacggtcattatatttcaaaagttttgcattttccaaaactaacaacaaa

SEQ ID NO: 2325 - DNA, 308 bp, Zea mays
  Clone ID: LIB3068-041-Q1-K1-B11
cccacgcgtccgcccacgcgtccggtcgacctgatccgccacatgttcaagacccagtaggcgtagtagagagatagatttctgcctccctatcgtgggtcgtccccaatggcctttggtcgcagaccatctttgctgcttgtctatgctgagaataaatgtgaacggtgcccctggacgctggatccatgctggttttggacacgctgtctttttgtgtttaacttatctgctgccgtcctgtaacgaattcgcaagttttagttcttttgtgctttgttaaagaataaacaatgaggtttcagttt

SEQ ID NO: 2326 - DNA, 412 bp, Zea mays
  Clone ID: LIB3068-026-Q1-K1-D5
cccacgcgtccgcccacgcgtccggtcgacctgatccgccacatgttcaagacccagtaggctagtagagagatagatttctgcctccctatcgtgggtcgtccccaatggcctttggtcgcagaccatctttgctgcttgtctatgctgagaataaatgtgaacggtgcccctggacgctggatccatgctggttttggacacgctgcctttttgtgtttaacttatctgctgccgtactgttacgaattcgcaagttttagttcttttgggctttgctaaagaataaacaatgaggtttcagtttacacacaagttttgggatggattacaagctcagagactatgacctcaatgacaatgctttttcacctaaacttggacatgcaaaaaaaaaaaggggcgccctttt

SEQ ID NO: 2327 - DNA, 350 bp, Zea mays
  Clone ID: LIB3061-012-Q1-K1-C11
agttatgaggagaaatgtctgtgtatcccgtcaaatagtatactcttccgattccctttcgaccgacgcgtccgcgccagagattcgactgatccgtcaattacatcaccaataaatgaacaaacgtgtgaaacattcaaagagtgatgaaagcatgcatagagagttgtgtttcttccccggaagtgcttccgagaataaatttttcttatctgattgtctaaaacctataacgggtgtaatggtatcacagtggttggttgatcatcaagtgactcatattatgtcaagtctatgtgtcatcgttaaacttttaaccgacattatattacaaaagttatgcattttcc

SEQ ID NO: 2328 - DNA, 212 bp, Zea mays
  Clone ID: LIB143-066-Q1-E1-H11
acgcatatccgctcacctacctctccagcatcctcccgtctccgtcgtctcgtctccgctcctcacctcgccagccatgggcaagatcaagatcggaatcaacggtttcggaaggatcggcaggctcgtggccagggtcgccgtgcagagcgaggatgtcgagctcgtcgccgtcaacgacgccttcatcaccacggactacatgacgtaca

SEQ ID NO: 2329 - DNA, 218 bp, Zea mays
  Clone ID: LIB3059-004-Q1-K1-G1
ggaatcaacggtttcggaaggatcggcaggctcgtggccagggtcgccctgcagagcgaggatgtcgagctcgtcgccgtcaacgaccccttcatcaccacggattacatgacctacatgttcaagtactacaccttgcacggccaatgtatgcacagctacatcaccctcaaggactccaagtctcttctcttctgcgagaatctcttcactgtctt

SEQ ID NO: 2330 - DNA, 267 bp, Zea mays
  unsure (1)...(267): unsure at all n locations
  Clone ID: LIB3069-053-Q1-K1-D10
gcccaaaaaggtggtatctttngcccaaacaaaaatgccccatgtttgttgntggngtcaatgaggacaagtnccctccgatgttaacattgttttcaatgctagctggaccacaaactgncttggtcccttgctaaaggcattcatgacaactttggcattattgagggcttgatgacaactggtcatgccatcactggccccaaaaantggtgatggccctcacccaagactgganaagnggcaggctntcaacnttaaataatc

SEQ ID NO: 2331 - DNA, 188 bp, Zea mays
  Clone ID: LIB143-021-Q1-E1-E2
cgcgatgctcgcggaactggtctgcctatgcactactgctccggtactcgcgagtcgacccacgggcgcgctcaagaactcaatttcgatctcagttgaaagcaacccatcctcgtttcctccgtctagcagcctctcagcctcatggccaggatcaagatcgggatcaatgggtttggcaggatcgg

SEQ ID NO: 2332 - DNA, 109 bp, Zea mays
  Clone ID: LIB3062-057-Q1-K1-A8
ataaatgtggatggcgcgtgcctctgggtcgccaggttcatgctgagtctggacatgttttgcacttttgtttcccttcctgctaccatctgtgacagatccgctcgct

SEQ ID NO: 2333 - DNA, 404 bp, Zea mays
  Clone ID: LIB189-019-Q1-E1-C5
acggacgcgtgggcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtcaactggtgttttcactgaccaggagaaggctgca

SEQ ID NO: 2334 - DNA, 101 bp, Zea mays
  Clone ID: LIB143-037-Q1-E1-C8
aactgagtctggacatgttttgcacttttgtttcccttcctgctaccatctgtgacagatccgctcgctaatatgggacctgagattagctttttgctgct

SEQ ID NO: 2335 - DNA, 139 bp, Zea mays
  Clone ID: LIB3059-012-Q1-K1-F6
tctgattgtctaaaacctataattggtgtaatggtttcgtagtggttggttgaacaggggatgacgcatattttgtcaggtctatgtgttatcgttaaacttttaacggtcattctatttcaaaagttttgcattttgc

SEQ ID NO: 2336 - DNA, 460 bp, Zea mays
  unsure (1)...(460): unsure at all n locations
  Clone ID: LIB3078-050-Q1-K1-G8
ggcgccgccaaggccgtctcgctggtgctccccaacctcaagggcaagctcaacgggatcgngctccgggtgcccaccccgaacgtctccgtcgtcgacctcgtcgtgcaggtctccaagaagaccctcgccgaggaggtgaaccaggcgttccgcgacgccgcggccaacgagctcacgggcatcctcgaggtctgcgacgtgccgctcgtgtccgtcgacttcaggtgctccgacgtctcctccaccatcgacgcctccctcaccatggtcatgggcgacgacatggtcaaggtcatctcctggtacgacaacgagtggggctactcgcagagggtcgtcgacctcgctgacatctgcgccaaccagtggaagtgaaacgttgcattgnaatagcactttgnaacttcttaccttcaaaaggntttnggaatnaaccccnaaangcctnantttnggg

SEQ ID NO: 2337 - DNA, 440 bp, Zea mays
  unsure (1)...(440): unsure at all n locations
  Clone ID: LIB3060-041-Q1-K1-E8
gtcgtgtccgaccgcaaccccagcaacctgccgtggggcgagctcggcatcgacctggtcatcgagggcaccggcgtcttcgtcgaccgcgagggcgcggggaagcacatccaggcgggggccaagaaggtgctcatcacggcgcccggcaagggcgacatccccacctacgtcgtcggcgttaatgccgaccagtacaaccccgacgagcccatcatcagcaacgcctcctgcaccaccaactgcctcgcgccattcgtcaaggtcctcgaccaaaagttcggcatcatcaagggcaccatgaccaccacccactcctacaccggcgaccagaggctgctggacgcgagccaccgcgacctgcgccgcgcccgngcngncgcgctnaacatcgtgcccacgtncaccggtgccgncaaaggccgtttgcttgnnntccc

SEQ ID NO: 2338 - DNA, 444 bp, Zea mays
  Clone ID: LIB3078-055-Q1-K1-H5
gcgccgcgcccgcgccgccgcgctcaacatcgtgcccacgtccaccggtgccgccaaggccgtctcgctggtgctccccaacctgaagggcaagctcaacgggatcgcgctccgggtgcccaccccgaacgtctccgtcatcgacctcgtcgtgcacgtctccaagaagaccctcgccaaggaggtgaaccaggcgttccacgacgccgtggccaacgagctcacgggcatcctcgaggtctgcgacgtgccgctcgtgtccgtcgacttcaagtgctccgacgtctgctacaccatcgacgcctccctcaccatggtcatgggcgacgacatggtcaaggtcatctcctgggacgacaactagtggggctactcgcagagggacgtcgacctcgctgacatctgcgccaaccagtggaagtgaagcgtcgcattgtaatactc

SEQ ID NO: 2339 - DNA, 438 bp, Zea mays
  unsure (1)...(438): unsure at all n locations
  Clone ID: LIB3060-001-Q1-K2-A9
ctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctncgtcgacggcaaggtcatc

SEQ ID NO: 2340 - DNA, 408 bp, Zea mays
  Clone ID: LIB3060-043-Q1-K1-C11
gtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgc

SEQ ID NO: 2341 - DNA, 425 bp, Zea mays
  Clone ID: LIB3060-003-Q1-K1-D9
ctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatcttcgtcga

SEQ ID NO: 2342 - DNA, 408 bp, Zea mays
  Clone ID: LIB3060-041-Q1-K1-F6
gtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatc

SEQ ID NO: 2343 - DNA, 401 bp, Zea mays
  unsure (1)...(401): unsure at all n locations
  Clone ID: LIB3060-043-Q1-K1-F2
ctctggtccgtggccatggcgtcgtccatgctctccgctaccaccgtgccactccagcaggggggcggcctgtccgagttcgccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtnccacctgctcaagtacgactncacgctcggcatcttcgatgccgacgtcaaacccgt

SEQ ID NO: 2344 - DNA, 401 bp, Zea mays
  Clone ID: LIB3060-047-Q1-K1-C9
tggcgtcgtccatgctctccgctaccaccgtgccactccagcaggggggcggcctgtgcgagttctccgggctcaggagctccgcgtcgctgcccatgcgccggaatgccaccttcgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatc

SEQ ID NO: 2345 - DNA, 413 bp, Zea mays
  Clone ID: LIB84-017-Q1-E1-D3
tggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctccgtcgaccgc

SEQ ID NO: 2346 - DNA, 398 bp, Zea mays
  Clone ID: LIB36-002-Q1-E1-B8
tgatcctctggtccgtggccatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaagcgtcaagcaagcgtctcacctgctcaagtacgactcgacgctcggcatcttcgatgccgacgtc

SEQ ID NO: 2347 - DNA, 394 bp, Zea mays
  Clone ID: LIB3060-029-Q1-K1-B7
gcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgttccacctgctcaagtacgactccacgctcggcatcttcgacgccgacgtcaagcccgtcggcgacaacg

SEQ ID NO: 2348 - DNA, 406 bp, Zea mays
  Clone ID: LIB36-010-Q1-E1-C7
atggcgtcgtccatgctctccgctaccaccgtgccactccagcatgggggcggcctgtccgagttctccgggctcaggagctccgcgtcgctgcccatgcgccggaatgccacctccgacgacttcatgtccgccgtctccttcaggacccacgcggtctgcacgagcggcgggtcgcggcgggcgccgacggaggcgaagctgaaggtggccatcaacgggttcggccgcatcgggcgcaacttcctgcggtgctggcacgggcgcagcgacgcctcgcccctcgacgtcatcgccatcaacgacaccggcggtgtcaagcaggcgtcccacgtgctcaagtacgactccacgctcggcatcttcgacgccgacgtcaagcccgtcggcgacaacgccatctccg

SEQ ID NO: 2349 - DNA, 374 bp, Zea mays
  unsure (1)...(374): unsure at all n locations
  Clone ID: LIB3060-042-Q1-K1-A10
ctctggtccgtggccatggcgtcgtccatgctctccgctaccaccgtgccactccagcaggggggcggcctgtcgcgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactncacgctcg

SEQ ID NO: 2350 - DNA, 416 bp, Zea mays
  Clone ID: LIB3060-018-Q1-K1-F11
gctcttcgctaccaccgtgccactccatcaaggtggcggcctgtacgagttctccgggctcaggagctccgcgtcgctgcccatgcgccggaatgccacctccgacgacttcatgtccgccgtctccttcaggacccacgctgtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgacatcaacgacaccggaggcgtcaagcaggcgtaccacctgctcaagtacgactgcacgctcggcatcttcgatgccgacgtcaagcccgtcggcgacaacgccatctgcgtcgacggcaaggtcatcaaggtcg

SEQ ID NO: 2351 - DNA, 381 bp, Zea mays
  Clone ID: LIB36-003-Q1-E1-H7
accacgcgtccggcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttccatgccgacgtcaaacccgtcggcgacaacgccatctccgtcgacggcaaggtcatcaacgtcgtgtccgaccgcaaccccagcaacctgcccgtggggcg

SEQ ID NO: 2352 - DNA, 401 bp, Zea mays
  Clone ID: LIB189-029-Q1-E1-F9
acgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctccgt

SEQ ID NO: 2353 - DNA, 373 bp, Zea mays
  Clone ID: LIB36-006-Q1-E1-B1
gggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcggcatcttcgacgccgacgtcaagcccgtcggcgacaacgccatctccgtcgacggcaaggtcatcaaggtcgtgtccgaccgcaaccccagcaacctgccgtggggcgagctcgggatcgacctcgtcatcgagggcaccggcgtcttcgtcgaccgcgagggcgcggggaagcacatccaggcggaggccaagaacgtgctcatcacggcgcccggcaagggcgacatcccca

SEQ ID NO: 2354 - DNA, 386 bp, Zea mays
  Clone ID: LIB3060-021-Q1-K1-F4
gtccgtggccatggcgtcgtccatgctctccgctaccaccgtgccactccagcaggggggcgggctgtccgagttctccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagccaggcgtccacctgctcaaggacgactccacgctcggcatcttcgatgccgacg

SEQ ID NO: 2355 - DNA, 384 bp, Zea mays
  Clone ID: LIB3060-037-Q1-K1-B6
ctggtccgtggccatggcgtcgtccatgctctccgctaccaccgtgccactccagcagtggggctgcctgtccgagttctccgggctcaggagctccgcgtcgctgcccatgctccggaatgccacctccgacgacttcatgtccgccgtctccttcaggacccacgcggtcggcacgagcggcgggtcgcggcgggcgccgactgaggctaagctgaaggtggccatcaacgggttcggccgcatcgggcgcaacttcctgcggtgctggcacgggctcggcgacgcctcgcccctcgacgtcatcgccatcaacgacaccggcggtgtcaagcatgcgttccacctgctcaagtacgactccacgctcggcatcttcgacgc

SEQ ID NO: 2356 - DNA, 464 bp, Zea mays
  Clone ID: LIB84-003-Q1-E1-C1
actgtcagctgtcagtgcggtccaggatttacgggtcgacgacgcgtccagtggcaatggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcccacctgctcaagtacgactccacgctcgggcatcttcgacgccgacgtcaagccggtcggtgacaacgccatctccgt

SEQ ID NO: 2357 - DNA, 376 bp, Zea mays
  Clone ID: LIB36-021-Q1-E1-H3
atggcgtcgtctatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcgccatcaacgacaccggcggtgtcaagcaggcgtcgcacctgctcaagtacgactccacgctcgggatcttcgacgccgacg

SEQ ID NO: 2358 - DNA, 462 bp, Zea mays
  unsure (1)...(462): unsure at all n locations
  Clone ID: LIB3078-056-Q1-K1-G1
ggcgcggggaagcacatccaggcgggggccaagaaggtgctcatcacggcgcccggcaagggcgacatccccacctacgtcgtcggcgtcaatgccgaccagtacaaccccgacgagcccatcatcagcaacgcctnctgcaccaccaactgcctcgcgccattcgtcaaggtgctcgaccaaaagttcggcatcatcaagggcaccatgaccaccacccactnctacaccggcgaccagaggctgctggacgcgagccaccgcgacctgcgccgcgcccgggccggcgcgcttaacatcgtgcccacgttcaccggcgccggcaaagnccgtcttgcttgtgcttcccaaacttaaaggcnagcttaaacggatcgcgcttccggtgcccaacccgaacgtntttcgtcgtngacttgtngtgcaaggtttccaagaagaacctttgccgagganggtgaa

SEQ ID NO: 2359 - DNA, 319 bp, Zea mays
  Clone ID: LIB3060-025-Q1-K1-B12
ctctggtccgtggccatggcgtcgtccatgctctccgctaccaccgtgccgctccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcgcccctcgacgtcatcggcatcaacg

SEQ ID NO: 2360 - DNA, 405 bp, Zea mays
  unsure (1)...(405): unsure at all n locations
  Clone ID: LIB189-004-Q1-E1-F9
aggcgtcgtccatgctctccgctaccaccgtgccactccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctgggaacggcgcggcgaacccttcgccctcgacgtcatcgccatcaacgacaccggcggtgtcaaagcagggtccanctgctcaagtacgactccacgctcgggatcttcgacgccgacgtcaagcccgtcggcgacaacgccatctccgt

SEQ ID NO: 2361 - DNA, 380 bp, Zea mays
  unsure (1)...(380): unsure at all n locations
  Clone ID: LIB3060-035-Q1-K1-A11
cttgatcctctggtccgtggccatggcgtcgtccatgctctccgctaccaccgggccgctccagcaggggggcggcctgtccgagttctccgggctcaggagctccgcgtcgctgcccatgcgccggaatgccacctccgacgacttcatgtccgccgtctccttcaggacccacgcggtcggcacgagcggcgggtcgcggcgggcgccgacggaggcgaagctgaaggtggccatcaacgggttcggccgcatcgggcgcaacttcctgcggtgctggcacgggcgcggcgacgcctcggccctcgacgtcatcgccatcaacgacacccgcggtgtcaagcaggcgtnccacctgctcaagtacgactncacgctcg

SEQ ID NO: 2362 - DNA, 444 bp, Zea mays
  unsure (1)...(444): unsure at all n locations
  Clone ID: LIB3078-004-Q1-K1-D8
gcgacatccccacctacgtcgtcggcgtcaatgccgaccagtncaaccccgacgagcnnatcatcagcaacgcctactgcaccaccaactgcctcgcgccattcgtcaaggtgctcgaccaaaagttcggcatcatcaagggcaccatgaccaccacccactcctacaccggcgaccagaggctgctggacgcgagccaccgcgacctgcgccgcgcccgcgccggcgcgctnaacatcgtgcccacgtncaccggcgccggcaaggcccgtctngctggtgcttcccaaccttaaaggcaagctnaacgggatcgngcttccnggtgccaccccgnacgttttcgtcgcgaacttgtcgtgcangtttccagaagaccttgccgaagaggtgaancaagcggttcgcgaagccggggcaacagcttacggcatctcaaggttg

SEQ ID NO: 2363 - DNA, 482 bp, Zea mays
  unsure (1)...(482): unsure at all n locations
  Clone ID: LIB36-009-Q1-E1-H1
cgatgccgacgtcaagcccgtcggcgacaacgccatctccgtcgacggcaaggtcatcaaggtcgtgtccgaccgcaaccccagcaacctgccgtggggcgagctcggcatcgacctcgtcatcgagggcaccggcgtcttcgtcgaccgcgagggcgcggggaagcacatccaggcgggggccaagaangtgctcatcacggcgcccggcaagggcgacatccccacctacgtcgtcggcgttaatgccgaccagtacaacccccgacgagcccatcatcangcaangcctcctgcaccagcaactgcctcccgccattcgtcaaaggtcctcgaaccaaaaagtttcggncatcatccaaggggcnaccaatganccaccnancccaagtccctaacaacnggggnaacccaanaaaggncttgttgggaacgccaaanccanccggcaacctngnngccnggcngcccgggcggccgnc

SEQ ID NO: 2364 - DNA, 441 bp, Zea mays
  unsure (1)...(441): unsure at all n locations
  Clone ID: LIB3060-013-Q1-K1-F8
caaggtcgtgtccgaccgcaaccccagcaacctgccgtggggcgagctcggcatcgacctcgtcatcgagggcaccggcgtcttcgtcgaccgcgagggcgcggggaagcacatncaggcgggggccaagaaggtgctcatcacggcgcccggcaagggcgacatncccacctacgtcgtcggngtcaatgccgaccagtacaaccccgacgagcccatcatcagcaacgccttctgnaccaccaactgcttgcgccattcgtcaaggtgctcgaccaaaagttcggcatcatcaanggcaccatgaccaccanccanttctacacggngaccaaaagcttgttggacccaaccaccgggactgngccgggcccgggccgcggcttaanatngggcccacgtcaccggngnccgcnaggccgtttgctngggcttnccnaa

SEQ ID NO: 2365 - DNA, 378 bp, Zea mays
  Clone ID: LIB3060-041-Q1-K1-G11
tggtccgtggccatggcgtcgtccatgctctccgctaccaccgtgccactccagcaggggggcggcctgtccgagttgtccgggctcaggagctccgcgtcgctgcccatgcgccggaatgccacctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgcttgcacgggcgccgggaccccttggcccttgaagtcattggcattaaccacccccgaagccttaagcaagccgtccaactggttaagttccaattcaagcttggcattttt

SEQ ID NO: 2366 - DNA, 398 bp, Zea mays
  Clone ID: LIB3060-018-Q1-K1-F10
gctcttcgctaccaccgtgccactccagcatgggggcggcctgtacgagttctccgggctcaggagctccgcgtcgctgcccatgcgccggaatgccacctccgacgacttcatgtccggcgtctgcttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgtcatcaacgacaccggaggcgtcaagcaggcgttccaccttgctaagtacgactgcacgctcggcatcttcgatgccgacgtcaagcccgtcggcgacaacgccatctgcgtcgacg

SEQ ID NO: 2367 - DNA, 148 bp, Zea mays
  Clone ID: LIB3060-008-Q1-K1-F1
cgtggccatggcgtcgtccatgctctttgctaccaccgtgccactccagcaggggggcggcctgtccgagttctacgggctcatgagctccgcgtcgctacgtatgcgccagaatgccagttttgacgacttgatgttctacgttgca

SEQ ID NO: 2368 - DNA, 189 bp, Zea mays
  unsure (1)...(189): unsure at all n locations
  Clone ID: LIB3060-039-Q1-K1-E4
agttttattagctttattaatccgattcgncttangtcgntactgntccgtattcccggtctgctccgtggccatggcgtcgtccattctctccgctaccacctttccactccatcaaggtgtcttcctgtcgtaggtctccttgctcatgagctcctcgtcactgcccatgctcctgaatgccacctt

SEQ ID NO: 2369 - DNA, 429 bp, Zea mays
  Clone ID: LIB3060-016-Q1-K1-F3
agcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggctgctggacgcgtcccaccgcgacctccggcgggcccgcgcggcggcgctgaacatcgtgccgacgagcacgggcg

SEQ ID NO: 2370 - DNA, 409 bp, Zea mays
  Clone ID: LIB36-020-Q1-E1-A6
aggaccatgatgacgacgcactcgtacaccggcgaccagaggctgctggacgcgtcccaccgcgacctccggcgggcccgcgcggcggcgctgaagatcgtgccgacgagcacgggcgccgccaaggccgtggcgctggtgctgccgcagctgaaggggaagctgaacggcatcgcgctgcgggtgccgaccccgaacgtgtccgtggtggacctggtgatcaacaccgtgaagactggcatcacggtcgacgacgtgaacgcggcgttccgcaaggccaccgccggcccgctgcagggcatcctggatgtctgcgacgtgccgctcgtgtccgtcgacttcaggtgctccgacgtgtcctgcaccatcgacgcgtcgctcagcatggtcatgggcgactacatggtca

SEQ ID NO: 2371 - DNA, 367 bp, Zea mays
  Clone ID: LIB189-011-Q1-E1-H7
gtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgc

SEQ ID NO: 2372 - DNA, 465 bp, Zea mays
  Clone ID: LIB36-019-Q1-E1-B10
aacgttatacggcggcacaggacttagtactcgcgggtcgacccaagcctctaaagacactcgtgcgacagcggaggcgtcaggaacgcgtcccacctcctcaagtacgactcgatgctcggcaccttcaaggccgacgtcaagatcgtggacgacacgaccatcagcgtcgacggcaagcccatcacggtcgtctccagcaggcacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgccgacatcatcagcaacgcgtcctgcacgatcaactgcctcgcgccattcgtcaagatcttg

SEQ ID NO: 2373 - DNA, 436 bp, Zea mays
  unsure (1)...(436): unsure at all n locations
  Clone ID: LIB3060-049-Q1-K1-A12
agctgaacggcatcgcgctgcgggtgccgaccccgaacgtgtccgtggtggacctggtgatcaacaccgtgaagactggcatcacggccgacgacgtgaacgcggcgttccgcaaggccgccgccggcccgctgcagggcatcctggatgtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaaacatgangccacggntcttt

SEQ ID NO: 2374 - DNA, 397 bp, Zea mays
  Clone ID: LIB36-021-Q1-E1-H8
cgcatcggccggaacttcctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacactaccatcagcgtcgacggcaagcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctccccgccaaggcgccgacatcccgacctatgtcgtcggcgtcaacgaggccgactacg

SEQ ID NO: 2375 - DNA, 392 bp, Zea mays
  Clone ID: LIB84-028-Q1-E1-H5
acgcccacgcgtccggcaagcccatcacggtcgtctccagcagggacccgctcaagctcccatggggtgagctcggcattgacatcgtcatcgagggcaccggagtcttcgtcgacggccccggcgccggcaagcacatccaggccggcgcgaagaaggtgatcatcacggctcccgccaagggcgccgacatcccgacctatgtcgtcggcgtcaacgagggcgactacgaccacagcgtcgccgacatcatcagcaacgcgtcctgcacgaccaactgcctcgcgccattcgtcaagatcttggacgaggagttcggaatcgtgaaggggaccatgacgacgacgcactcgtacaccggcgaacagaggctgctggacgcgtcccaccgc

SEQ ID NO: 2376 - DNA, 410 bp, Zea mays
  Clone ID: LIB3060-036-Q1-K1-B9
cgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcgccgatcgacgtcgtcgtcgtgaacgacagcggaggcgtcaggaacgcgtcccacctcctcaagtacgactcgatgctcggcaccttcaaggccgacgtcaagatcgtggacgacactaccatcagcgtcgacggcaagcccatcacggtcgtctccagcagggacccgctcaagctcccatggggtgagctcg

SEQ ID NO: 2377 - DNA, 423 bp, Zea mays
  Clone ID: LIB36-001-Q1-E1-A3
ggagatcggaattgtcaaaggggacaatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctgaaggggaagctgaacggcatcgcgctgcgggtgccgaccccgaacgtgtccgtggtggacctggtgatcaacaccgtgaagactggcatcacggccgacgacgtgaacgccgcgttccgcaaggccgccgccggcccgctgcagggcatcctggatgtctgcgacgtgccgctcgtgtccgtcgacttcaggtgctccgacgtgttctgcaacatcgacgcgtcgctcaacatggtcatgggcgacgaca

SEQ ID NO: 2378 - DNA, 353 bp, Zea mays
  Clone ID: LIB189-017-Q1-E1-C6
cggacgcgtgggcggacgcgtggggatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctg

SEQ ID NO: 2379 - DNA, 374 bp, Zea mays
  unsure (1)...(374): unsure at all n locations
  Clone ID: LIB189-015-Q1-E1-C5
gctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcgccgatcgacgtcgtcgtcgtgaacgacagcggaagcgtcaggaacgcgtcncacctcctcaagtacgactcgatgctcggcaccttcaaggccgacgtcaagatcgtggacgacacgaccatcagcgtcgacggcaagcccatcacggtcgtctccagcagggacccgctcaagctcccatggggtgag

SEQ ID NO: 2380 - DNA, 400 bp, Zea mays
  Clone ID: LIB3060-035-Q1-K1-F2
atccgatcccacccggcagcggcgctgcgcaatggccacccacgcagctctcgccgcgtcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgaaggtggcgatcaacggcttcggccgcatcggccggaacttcctccggtgctggcacggccgcgaggactcggcgatcgacgtcgtcgtcgtgaacgacagcggaggcgtcaggaacgcg

SEQ ID NO: 2381 - DNA, 389 bp, Zea mays
  Clone ID: LIB36-003-Q1-E1-D2
accacgaatccgcacccatccgatcccacccggcagcactcggcagcggcgccgcgcaatggccacccacgcagctctcgccgcctcccgcatccccgccggcgcccggctgcacagcagggcggcggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgccgaggcgaagctgaaggtggcgatcaacggcttcggccgcatcggccggaacttcctccggtgctggcacggccgcgaggactcgccgatcgacg

SEQ ID NO: 2382 - DNA, 390 bp, Zea mays
  unsure (1)...(390): unsure at all n locations
  Clone ID: LIB3060-023-Q1-K1-D9
ccgatgccacccggcagcactcggcagcggcgccgcgcaatggccacccacgcagctctcgccgcctcccgcatccccgccggcgcccggctgcacagcagggcggcggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgccgaggcgaagctgaaggtggcgatcaacggcttcggccgcatcggccggaacttcctncggtgctggcacggccgcnaggactcgccgatcgacgtcgtcgtcgtgaacgacagc

SEQ ID NO: 2383 - DNA, 378 bp, Zea mays
  unsure (1)...(378): unsure at all n locations
  Clone ID: LIB3060-018-Q1-K1-E11
naggaagggagtgtttataaagcaagaagtactgtcaccctccggattcccggtcgaccagctccgaccggcagcggcgctgcgcatggccacccagcagtttcgccgctccgatcccgccggcgcccggtgcacacaggcgccgcgtcgccagcacgcgtcagagctggacttgcgactttcggctagccgggtcggctcggagcgctgcggcggagcgtctttcgactctgggccagtcgtgcaagcacgggaaacgcggagggcccgagagcgaactgaggggacaacgttcgcgatcggcggacttctcgggctgacgcggaggactgcgatgactgtcgtcggaacgaagggagcgtagaacgctccactctc

SEQ ID NO: 2384 - DNA, 258 bp, Zea mays
  Clone ID: 700043392H1
gacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaataatatacagatt

SEQ ID NO: 2385 - DNA, 256 bp, Zea mays
  Clone ID: 700041871H1
ctggaggtctgccacgtgccgctcgtgtccgtcgacttcaggtgctccgacgtgtcctgcaccatcgacgcgtcgctcagcatggtcatcggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacg

SEQ ID NO: 2386 - DNA, 133 bp, Zea mays
  Clone ID: 700426511H1
cgacatggtcaaggtcgtcgcctggtacgacaacgagtgggggtacagccaacgcgtggttgatctggcgcacctggtggcggccaagtggcccggcgcggcggcggccggcagcggcgaccctctggaggac

SEQ ID NO: 2387 - DNA, 221 bp, Zea mays
  Clone ID: 700044710H1
gcatacaactcatatatatatataacatacgtctctttcgtcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgctgccggccgccgccgcgccgggccacttg

SEQ ID NO: 2388 - DNA, 257 bp, Zea mays
  unsure (1)...(257): unsure at all n locations
  Clone ID: 700216320H1
aaatggaaagcggaagcctgtaccanttcggtgactgcantacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagagggtcgccgctgccggccgccgcggcgccgggccacttggcg

SEQ ID NO: 2389 - DNA, 250 bp, Zea mays
  unsure (1)...(250): unsure at all n locations
  Clone ID: 700216328H1
aaatggaaagcggaagcctgtaccacttcggtgactgantacaactcatatatataacatacgtctctttgggcgaataatctgtatattattctctatggaaagaaccctcgcgcccgtgctgtacgtttcgtcgtggaaagaaccctggcctcatgcttcgtacaccttgcactcgtcggtctcggggttgtccttgcagaagtcctccagngggtcgccgtnccggccgccgngggccgggctantt

SEQ ID NO: 2390 - DNA, 366 bp, Zea mays
  Clone ID: LIB36-006-Q1-E1-A7
acaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaagcatgaggccacggttctttccacgacggaacgtacagcacgggcgcgagggttctttccatagagaataatatacagattattcgcccaaagagacctatgttatatatatatgagttgtatgcagtcacccaactgggacaggtttccg

SEQ ID NO: 2391 - DNA, 417 bp, Zea mays
  Clone ID: LIB189-010-Q1-E1-F11
agaacgcggcgttccgcaaggccgccgccggcccgctgcagggcatcctggatgtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgccgcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaattatatacagattattcgcccaaagagac

SEQ ID NO: 2392 - DNA, 422 bp, Zea mays
  Clone ID: LIB83-006-Q1-E1-H8
gtccgtggtggacctggtgatcaacaccgtgaagactggcatcacggccgacgacgtgaacgcggcgttccgcaaggccgccgccggcccgctgcagggcatcctggatgtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgccgcggcggccggcagcggcgaccctctggaggacttctgcaaggacaaccccgagaccgacgagtgcaaggtgtacgaagcatgatgccagggttctttccacgacgaaacgtacagcacgggcg

SEQ ID NO: 2393 - DNA, 431 bp, Zea mays
  Clone ID: LIB36-017-Q1-E1-A1
tacacacgcgttctggcatcacggccgacgacgtgaacgcggcgttccgcaaggccgccgccggcccgctgcagggcatcctggatgtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaagcatgaggccacggttctttccacgacgggacgtacagcacgggcgcgaggggtttcttcatagagaataatatacag

SEQ ID NO: 2394 - DNA, 371 bp, Zea mays
  Clone ID: LIB3078-014-Q1-K1-H3
cccacgcgtccggcggcgttccgcaaggccgccgccggcccgctgcagggcatcctggaggtctgcgacgtgccgctcgtgtccgtcgacttcaggtgctccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgcggcggcggccggcagcggcgaccctctggaggacttctgcaaggacaaccccgagaccgacgagtgcaaggtgtacgaagcatgaggccagggttctttccacgacgaaacgtacaacacggg

SEQ ID NO: 2395 - DNA, 396 bp, Zea mays
  Clone ID: LIB189-022-Q1-E1-H11
agcgtcctatgccgcccggtcgcactaccggggcccagcacgcgtccggatgcaccgacgtgtcctgcaccatcgacgcgtcgctcagcatggtcatgggcgacgacatggtcaaggtcgtcgcctggtacgacaacgagtgggggtacagccaacgcgtggttgatctggcgcacctggtggcggccaagtggcccggcgccgcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaataatatacagattattcgcccaaagagacgtatgttatatatatgag

SEQ ID NO: 2396 - DNA, 416 bp, Zea mays
  Clone ID: LIB3078-002-Q1-K1-B8
gtcgcctggtacgacaacgagtgggggtacagccaacgcgtggttgatctggcgcggctggtggcggccaagtggcccggcgccgcggcggccggcagcggcgaccctctggaggacttctgcaaggacaaccccgagaccgacgagtgcaaggtgtacgaagcatgaggccagggttctttccacgacgaaacgtacagcacgggcgcgagggttctttccatagagaataatatacagattattcgcccaaagagacgtatgttatatatatgagttgtatgcagtcaccgaactggtacaggcttccgctttccatttcctgttgggagtcgtgtagtgtaatcctggggtgtgtatttggttcatcaatcatgccagccgatttgaatctcgtttcaccagcatgatctgat

SEQ ID NO: 2397 - DNA, 277 bp, Glycine max
  Clone ID: 700556687H1
cattgttccagatcaagtatttttgatgcaaaggctggaattgcattgaataagaactttgtgaagcttgtcctcttggtatgacaacgagtggggatacaggtaatccacctttaaccttttcttgtatgtgatagtggttagtgcgccaataagttgttaattagttcaaaaatctaatcacgcgaattttagatgctatattatgtattcagcttgatctaatactaataccctatgtgtgcctggttctgcagctcacgtgtcattgacctgc

SEQ ID NO: 2398 - DNA, 308 bp, Glycine max
  Clone ID: 700652993H1
ctaaggtcgatttctcgttgtgctaacattgcattggatagaaactaaagtcttaaaacattcataatcatatctctttttattagttgttattgtgtgtctcagtattcaattggttgaattgaagctacttgttataatggatcacgctattgatggttactgtgttggggattgcagccaaagagtggtcgatttggcacatctagtagcaagcaagtggccaggggcacctaaagcggggagtggagacccattggaggatttctgcgagacaaaccctgctgatgaggaatgcaaagtttatg

SEQ ID NO: 2399 - DNA, 211 bp, Glycine max
  unsure (1)...(211): unsure at all n locations
  Clone ID: 700669859H1
aattacactttcnatctcaganccaancacantnncatngnagntcaaacactcncntggcagcngacangaagattgggatcggcntcaacggatttggaaggattggccgattggnggccagggttgcncttcagaggaatgacgttgaacttgttgcngtcaacgancctttcatcaccactgatnacangacanaggtacgacaccg

SEQ ID NO: 2400 - DNA, 262 bp, Glycine max
  Clone ID: 700682023H1
aagaaggttgtcatctctgctcctagcaaggatgcccccatgtttgtcgttggtgtcaacgagaaggcgtacaagtctgacattaacattgtctccaatgctagctgcacaaccaactgccttgctcctcttcgtaaggtcatcaatgacaagttcggtatcgttgagggtctgatgaccactgtccatgtcatcactgctacccagaagactgttgatgggccctcgtctaaggactggaggggtggaatggctgctagtt

SEQ ID NO: 2401 - DNA, 268 bp, Glycine max
  Clone ID: 700739645H1
ctccttgactatggtcatgggagatgatatggttaaagtggttgcttggtatgacaatgaatggggttacagccaaagagtggtcgatttggcacatctagtagcaagcaagtggccaggggcacctaaagcggggagtggagacccattggaggatttctgcgagacaaaccctgctgatgaggaatgcaaagtttatgaatagaggagagctcctcttctaacgtatcatgtgaaaaagaaggaaattgttcagacagctatctga

SEQ ID NO: 2402 - DNA, 255 bp, Glycine max
  Clone ID: 700744137H1
ctcgagccgatcgagccggtcatcccaaccccggagggcaaactcagtggcattgcactccgtgtgcgaacaccaggcgtgtcagtggtggacctcgtccgtcaggtctcaaagaagacgtttgcagaagaagtgaatgcagcattcagagacggtgcagacaatgagctccagggaatcctttctgtgtgagatgagccacttgagtctgttgacttcatgtgcactgatgtgtcctcaaccgttgactcatcg

SEQ ID NO: 2403 - DNA, 254 bp, Glycine max
  Clone ID: 700749096H1
tttctaatgtcattctcgttctgttcaaacactctctctcacggcatcagataagaagactaggatcggcatcaacgggtttggaaggattggccgtttcgtggccacggctgccctccacaggaatgatgtgaacttgttgctgccaacgatcctttcatcaccactgactacacgacatacatgctcaagtacgacaccgctcacggccagtggcagcaccccgacgtgaaggtgaaggactctaagacctt

SEQ ID NO: 2404 - DNA, 267 bp, Glycine max
  Clone ID: 700763386H1
gcttcctacgatgaaattaaaaatgctatcaaggaagcttctttctccagcctcactgtgaggtcaacaacagagacatccacggtggggctggagaaagaagattcctacgatgaaattacaaatgctatcaaggaggaatcagagggcaagttgaagggaattcttggttacactgaagatgatgtggtctccactgactttaacggcgatagcagatcaagtatttttgatgcaaaggctggaattgcattgaataagaacttt

SEQ ID NO: 2405 - DNA, 218 bp, Glycine max
  unsure (1)...(218): unsure at all n locations
  Clone ID: 700854894H1
caacaacttctgctacttcctactccaaccgcacttctgttcggcacttcttatgagttgaggccaagancnnaatcaacgganntngaanaattngccgcatggaagccagagtggctctgagagagacgatgttgaactcgttgccgttaagacctttcatcacactgattaatgacatacatgtttaaatagataggttcatggacatggaagca

SEQ ID NO: 2406 - DNA, 238 bp, Glycine max
  Clone ID: 700870634H1
actgcttcaccttactgctctagaaaattcagtgctgaaacatggcttcggctactctctgtgtagccaaaccagagcttcaggcaaatgggaaaggcttcactgaagtctctggcctgcgaagctcatcaggctaccttccctttactagaaaatcttcagaggatttccattctgtcattggcttccagacgtatgcagtaggaagcagttgaggatacacgaagggtgtgacaga

SEQ ID NO: 2407 - DNA, 208 bp, Glycine max
  Clone ID: 700871731H1
acccacgcggctctagcttctacaaggatccccactaacaccaagtccccatccaaggcttcacactctttcgcaacccaatgcgcctcaaagagacttgaggtgacataattctctgggctaagatccacttcatgtgtgacatatgctaacgatgctagagaatcgtccttttgtgatcttgtagctgcccaactcactcccaaga

SEQ ID NO: 2408 - DNA, 228 bp, Glycine max
  Clone ID: 700891638H1
ccgaagcgcttattagctgtgtgacaggaaagggttccgagattggtgattttcttacaatgcatccgggggtgaactgcataagtttcactggtggggacactggaatagcaatatcaaagaaggccggcatggttcctcttcaaatggaattgggtggaaaagatgcctgcattgttcttgaagatgctgacttggatttggcagctgctaacattgtaaaaggag

SEQ ID NO: 2409 - DNA, 244 bp, Glycine max
  Clone ID: 700954983H1
catggatcaggcaaggtcaagatcggaatcaacggtaagtcttctccatccttcgatctctcttctgttgtttcagatcagcttagttattttttctactattccattttcgctgtttttttctctctcaattttatctaaatcgaaatgtaacaggatttggaagaattggccgtttggttgccagagtcgctctgcaaagagacgatgtggagctcgttgccgttaacgaccctttcattac

SEQ ID NO: 2410 - DNA, 238 bp, Glycine max
  Clone ID: 700961364H1
gaaatcctcttcaaccgcaacaaggacgcgatctcctccgacacggcgtcccgatcgacgtctttatccgtgcgttcacgcacgcgtatggcggatgagctggagcaggtgttcaacaagttcgacgtgaacggcgacggcaagatctcggcgtcggagctgaagaccactccgtgtgcctacacccaatgtttcagttgttgaccttgttgtgaatgttgagaagaagggtcttact

SEQ ID NO: 2411 - DNA, 240 bp, Glycine max
  Clone ID: 700961396H1
gaaatctctcggcaaccgcaacaaggacgcgatctcctccgatacggcgtcccgatcgacgtctttatccgtgcgtgcaggcacttaacatggcggctacgctggagcaggtgttcaacaagttcgacgtgaacggcgacggcaagatctcgcaatctcaatggaatagcgctccgtgtgcctacacccaatgtttcagttgttgaccttgttgtgaatgttgagaagaagggtcttact

SEQ ID NO: 2412 - DNA, 252 bp, Glycine max
  Clone ID: 700963442H1
gtgacacagttcaaccccacttgctcaaaaactcatcttcactcatctcagctcccttttctatcgaggactcttcctagacatcgccactgcactattgcgccacttctgctccgccattatcatgggcaaggtcaagatcggaatcaacggatttggaagaattggccgtttggtagccagagtggctctgcagagagacgatgttgaactcgttgccgttaacgaccctttcatcaccaccgattacat

SEQ ID NO: 2413 - DNA, 297 bp, Glycine max
  unsure (1)...(297): unsure at all n locations
  Clone ID: 700984474H1
cacannacatccacnaaccgcaaatatggtcgtcaaggtcggtatcaacggtttcggccgcattggtcgcatcgncttccgcaacgccgtcgancaaccaggacatcgacatcgtctgccgtgaacgaccccttcattgaggcccgagtacgccgcctacatgctcaagtacgactccacccacggtgtcttcaagggtgacatccaggtctccggcaagaacctcattgtcaacggcaaggagatcnccttctacaccgagcgtgaccccggcaacatnccctgggtctgaagaag

SEQ ID NO: 2414 - DNA, 261 bp, Glycine max
  unsure (1)...(261): unsure at all n locations
  Clone ID: 700989533H1
ctgggaaatgaaaggacaaaatattgcctcacatccaagattccactaggagtgattttngccattccaccttttaactatcccgtcaatcttgctgtttccaaaattgctcctgccctgattgctggaaactcaattgtgctcaagcctccaactcagggagctgtttctgctttgcacatggttcactgctttcacttggctggttttcccaaaggcctaatcaactgtgtcactggaaaaggctcagaaattggtgtt

SEQ ID NO: 2415 - DNA, 268 bp, Glycine max
  unsure (1)...(268): unsure at all n locations
  Clone ID: 700990284H1
acgcttcctgcaccacaaactgtnntgctccctttgtgaagatcctggatgcagagtttggaattgtgaagggaaccatgacaaccacgcattcctacactggagaccaggtacaatattgatcaatcacaagtnagttggaatccaaccttactttacttacaatatatgtgttcaaaggggatgtatctantgagaatggtttttgatgtgagaatgagaagaataactattagtctttagatcttatcataaatcatcaaaatta

SEQ ID NO: 2416 - DNA, 270 bp, Glycine max
  Clone ID: 700991120H1
ggacaaagcgaagtgccttatggatgactcgcaatgtacactctcacagcagttttcaccaggaaaagcatcttctgctgagttctcttggcaacttggcttggatactggtcattgcaaagttttcttggagtcggaagatgtaggaaggaccctagacctatcgctgtttggttcttatgaagatctgtataggagacttgccatcatgtttgggattgaaaggtctgagattttgaaccatgtgctctaccatgatgcagctggtgc

SEQ ID NO: 2417 - DNA, 273 bp, Glycine max
  unsure (1)...(273): unsure at all n locations
  Clone ID: 700991826H1
cagaattctctgggctaagatccacttcatgtgtgacatatgctaacgatgctaganaatcttccttttttgatcttgtagcttcccaactcactcccaagaccaatggatcatcaactcctgtgaggggagagacagtggccaagttgaagtggcaatcaatgggtttgggaggcatnggtagaaactcctncgntgntggcanggnggaaaaganccgcccgttgaggnggttgtngatgngngagggncgntgncanntctcnnccnntt

SEQ ID NO: 2418 - DNA, 257 bp, Glycine max
  unsure (1)...(257): unsure at all n locations
  Clone ID: 700993359H1
ttcttccaantncaaccacactagttntnaggnantcatgggcaagatcaagatcggaatcaacggatatngaagaattggccgtttggttgccanantcgctctgcaaagagacgatgtggagctcgttgncgttaacgaccctttcattatcacngattanntgacatatatgttnaantacnnnagtgttcaggganactggaagnatnangatgtcatgttaaaggangannagaccttttnttcggtnaaat

SEQ ID NO: 2419 - DNA, 276 bp, Glycine max
  unsure (1)...(275): unsure at all n locations
  Clone ID: 701000288H1
cggaaccttcgatgctgatgtcaagcctgttggcagcaatgtcatctccgtggatggaaaggaaatcnaagntgtttctgaccgcaaccctgccaaccttccttggaaggantttgggatagactggtgatngaaggnaccgngggtgtttgtagacagaaaaagtgcangganaacncantcaaggcagganntnaagaangtgctcatcactgcnctgggtaagggcgatatcccagcctacgngttggngtccatgngtatnaactacncccc

SEQ ID NO: 2420 - DNA, 275 bp, Glycine max
  Clone ID: 701049142H1
aattaatgatccatttattgatgcaaaatatatggcatacatgttcaaatatgattctactcacagtccattcaaggggatcattacgattttggatgactgtagtttggaaagtaatgggaagcaggttaaagtggtgagcaaaagagatcctgcagagatcccatggagtgattttggggctgaatatgtcattgagtcttctggagtttttacaacagtggagaaagcttcatcacatttgaaggctggtgccaagaaagttgtaatatcag

SEQ ID NO: 2421 - DNA, 261 bp, Glycine max
  Clone ID: 701049262H1
ggaatagttgaaggtttgatgacaacggtacatgcaacaacagcaacacaaaagaccgtagatggtccttctatgaaggattggcgacgaggaacaggggcagctcaaaatataattccaagttcaactggtgctgcgaaggccgttgggaaagttcttcctgagctaaatgggacactcactgggatggcattccgtgtaccgactcccaatgtttctgtggtggacttgacttgccggcttaagaagaatgcttcctat

SEQ ID NO: 2422 - DNA, 155 bp, Glycine max
  Clone ID: 701064532H1
tcaacttcatgctacacactatcgttcttccaagtgccaaccacgcttatctctgaagtcatcggcaaggtcgagatcggaatcaacggatttggaagaattggccgtttggttgccagactcgctctgcaaagagacgatgtggagctcgttgc

SEQ ID NO: 2423 - DNA, 273 bp, Glycine max
  Clone ID: 701107753H1
atcacttgttagttcaacatggctggcagtggcacctttgcagagatcatagatggtgatgtgttcaagtactatgcacaaggccattggaacaagtcctcttctggaaaattcgttcccatcatcaatccaaccactaggaagacccacttcaaggtccaagcttgtacacagaaagaggttaatagggtcatggaatcagcaaaaacagctcaaaaatcatgggccaagactccactgtggaaaagagcagagttgcttcacaaggctgca

SEQ ID NO: 2424 - DNA, 124 bp, Glycine max
  Clone ID: 701128594H1
gggcaaggtcaagatcggaatcaacggatttggaagaattggccgtttggttgccagagtcgctctgcaaagagacgatgtggagctcgttgccgttaacgaccctttcattaccaccgattac

SEQ ID NO: 2425 - DNA, 246 bp, Glycine max
  Clone ID: 701140262H1
atttgattctcctctaatgatattgtgtattattggatcttatgcaaaatttcattacttttattcaaaaatgcctactccatttttgtattggtccttctcaatttgtcttatatgatgtatttctcagggaggactcagagggcaagttgaagggaattcttggttacactgaagatgatgtggtctccactgactttatcggcgataccagatcaagtatttttgatgcaaaggctggaattg

SEQ ID NO: 2426 - DNA, 156 bp, Glycine max
  Clone ID: 701146678H1
tacggctgcgagaagacgacagaagggggagttttcaccgataaggacaaggctgccgcacatttgaagggtggtgccaaaaaggtattatttctgctcccagtaaggatgccccatgtttgtggttgggttaatgagcacgagtcaagccagagc

SEQ ID NO: 2427 - DNA, 302 bp, Glycine max
  Clone ID: 701151833H1
acggctgcgagaacacgacagaagggatgaaggattctgctagtcatgagatgaccgagaagcgcactggaagatgtcgctgatgagaacctcacagtgatgctggaggaggaagcctcctacgatgacattgaagatgctatcaaggaggaatcagagggcaagttgaagggatttcttggttacactgaaggtgatgtggtctccaccgactttgtgggcgatacagatcaagtatttttgatgcaaaggctggaattacattgaataagaacgttgtgaagcttgtttcttagtacgac

SEQ ID NO: 2428 - DNA, 273 bp, Glycine max
  Clone ID: 701203691H2
ctcgagccgaacttctgctacttcctactccaaccgcagcttatgctccgcagttatcatgagcacaggtcacgaatcgagtcaacggatttggaagcattaggcagtatggtagccagagtggctctgcagagaccacgatgttgaactcgttgccgttaacgaccctttcatcaccaccggttacatgacatgcatgtttaaatacgacagtgttcatggacactggaagcatcacgatgtcaccgttaaggacgagaagaccttctcatc

SEQ ID NO: 2429 - DNA, 182 bp, Glycine max
  Clone ID: 701208478H1
ctgctacttcctactccaaccgcacttctgctccgcaattatcatgggcaaggtcgagatctgcatcaacggatttggaagcattggccgtttggtagccagagtggctctgcagacatacgatcttgaactcgttgccgttacgaccctttcatcagcactgattacatgacatacctgtt

SEQ ID NO: 2430 - DNA, 337 bp, Glycine max
  Clone ID: 700763870H1
ggtgctcatcactgctcctggtaaaggagatatccccacctacgtggttggtgtcaatgagtatgactacagccctgatgaacccatcatcagcaatgcctcttgcaccactaactgccttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggc

SEQ ID NO: 2431 - DNA, 283 bp, Glycine max
  Clone ID: 700556966H1
cagcaatgcctcttgcaccactaactgccttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtctcagtg

SEQ ID NO: 2432 - DNA, 282 bp, Glycine max
  Clone ID: 700980735H1
cttgatcagaaattcggtatcatcaagggcaccatgaccaccactcactcctacaccggcgaccaaaggcttctcgacgcgagccaccgtgacctgaggcgcgccagggcggcagctctcaacattgtccccacttcaacaggagcagcaaaggcagtggcccttgtcctcccaaccctcaagggcaaactcaatggcattgcactccgtgtgccaacaccaaacgtctcagtggtggacctcgttgttcaggtctcaaagaagacctttgcagaagaagtg

SEQ ID NO: 2433 - DNA, 296 bp, Glycine max
  unsure (1)...(296): unsure at all n locations
  Clone ID: 700983864H1
cctgntgaacccatcatcagcaatgcntcttgcaccactaactgccttgcaccctttgtcaaggtccttgatcagaaattcggtatcatcaagggcancntgaccaccactcactcctacaccggcgaccaaaggcttctcgacgcgagccaccgtgacctgaggcgcgccagggcggcagctctcnacattgtccccacttcaacaggagcagcaaaggcagtggcccttgtcctcccaaccctcaagggcaaactcaatggcattgcactccgtgtgccancaccaaacgtctc

SEQ ID NO: 2434 - DNA, 284 bp, Glycine max
  Clone ID: 700786535H1
ggtatcatcaagggcaccatgaccaccactcactcctacaccggcgaccaaaggcttctcgacgcgagccaccgtgacctgaggcgcgccagggcggcagctctcaacattgtccccacttcaacaggagtctcaaaggcagtggcccttgtcctcccaaccctcaagggcaaactcagcggcattgcactccgtgtgccaacaccaaacgtctcagtggtggacctcgttgttcaggtctcaaagaagacctttgcagaagaagtgaatgcagcattcagaga

SEQ ID NO: 2435 - DNA, 278 bp, Glycine max
  Clone ID: 700728027H1
gaaattcggtatcatcaagggcaccatgaccaccactcactcctacaacggcgaccaaaagcttctcgacgcgagccaccgtgacctgaggcgcgccagggcggcagctctcaacattgtccccacttcaacaggagcagcaaaggcagtggcccttgtcctcccaaccctcaagggcaaactcaatggcattgactccgtgtgccaacaccaaacgtctcagtggtggacctcgttgttcaggtctcaaagaagacctttgcagaagaagtgaatgc

SEQ ID NO: 2436 - DNA, 250 bp, Glycine max
  Clone ID: 700684426H1
cttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtct

SEQ ID NO: 2437 - DNA, 293 bp, Glycine max
  unsure (1)...(293): unsure at all n locations
  Clone ID: 700559635H1
agaagcaaaactgaaggttgccataaacggatttggaaggattggaaggaacttcttgaggtgctggcacggtccgcaaagactcccctctngatgtcattgccatcaacgacaccggtggcgtgaaacaagcctcncaccntctcaagnacgattcgatcctcggaaccttcgatgctgatgtcaagcctgttggcagcgacatcatctctgtcgatggaaaggaaatcaaagttgtctctgaccgcnaccctgccaaccttccttggaaggatttggggatagacttggtg

SEQ ID NO: 2438 - DNA, 286 bp, Glycine max
  Clone ID: 700555476H1
tgtagacagagaaggtgcagggaaacacattcaagcaggagctaagaaggtgctcattactgctcctggtaaaggagacatccccacatatgtggttggtgtcaatgagtatgattacagccctgatgaacccatcatcagcaatgcatcttgcaccactaactgccttgcaccctttgtcaaggtccttgatcagaaattcggtatcatcaagggcaccatgaccaccactcatcctacaccggcgaccaaaggttctcgacgcgagccaccgtgacctgaggcg

SEQ ID NO: 2439 - DNA, 268 bp, Glycine max
  Clone ID: 700876005H1
ctacagccctgatgaacccatcatcagcaatgcctcttgcaccactaactgccttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccaattcaacaggagccgcaaaggcagtggcccttgtcctcccaaccctcaaaggcaaactcaat

SEQ ID NO: 2440 - DNA, 300 bp, Glycine max
  Clone ID: 700646201H1
ctcactcctacaccggcgaccaaaggcttctcgacgcgagccaccgtgacctgaggcgcgccagggcggcagctctcaacattgtccccacttcaacaggagcagcaaaggcagtggcccttgtcctcccaaccctcaagggcaaactcaatggcattgcactccgtgtgccaacaccaaacgtctcagtggtggacctcgttgttcaggtctcaaagaagacctttgcagaagaagtgaatgcagcattcagagagagtgcagacaatgagctccagggaatcctctctgtgtgtgaga

SEQ ID NO: 2441 - DNA, 265 bp, Glycine max
  Clone ID: 700873429H1
ctttgtcaaggtccttgatcagaaattcggtatcatcaagggcaccatgaccaccactcactcctacaccggcgaccaaaggcttctcgacgcgagccaccgtgacctgaggcgcgccagggcggcagctctcaacattgtccccacttcaacaggagcagcaaaggcagtggcccttgtcctcccaaccctcaagggcaaactcaatggcattgcactccgtgtgccaacaccaaacgtctcagtggtggacctcgttgttcag

SEQ ID NO: 2442 - DNA, 246 bp, Glycine max
  Clone ID: 700685875H1
cttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaac

SEQ ID NO: 2443 - DNA, 297 bp, Glycine max
  Clone ID: 700554131H1
aaggaactggggtgtttgtagacagagaaggtgcagggaaacacattcaagcaggagctaagaaggtgctcattactgctcctggtaaaggagacatccccacatatgtggttggtgtcaatgagtatgattacagccctgatgaacccatcatcagcaatgcatcttgcaccactaactgccttgcaccctttgtcaaggtccttgatcagaaattcggtatcatcaagggcaccatggaccaccacttcactccttacaccggcggaccaaaggcttctcgacgcgagccaccgt

SEQ ID NO: 2444 - DNA, 264 bp, Glycine max
  Clone ID: 700686559H1
ggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacccatcatcagcaatgcctcttgcaccactaactgccttgcaccctttgtcaaggtccttgatcagaaattcggtatcatcaagggtaccatgaccaccactcactccta

SEQ ID NO: 2445 - DNA, 249 bp, Glycine max
  Clone ID: 700873329H1
ctttgtcaaggtccttgatcagaaattcggtatcatcaagggcaccatgaccaccactcactcctacaccggcgaccaaaggcttctcgacgcgagccaccgtgacctgaggcgcgccagggcggcagctctcaacattgtccccacttcaacaggagcagcaaaggcagtggcccttgtcctcccaaccctcaagggcaaactcaatggcattgcactccgtgtgccaacaccaaacgtctcagtggt

SEQ ID NO: 2446 - DNA, 234 bp, Glycine max
  Clone ID: 701061532H1
tcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtctcagtggtgga

SEQ ID NO: 2447 - DNA, 246 bp, Glycine max
  Clone ID: 700876258H1
gtcaaggtccttgatcagaaattcggtatcatcaagggtaccatgaccaccactcactcctacaccggtgaccaaaggcttcttgatgcgagccaccgtgacctgaggcgtgcaagggcagcagcatcaacattgtccccacttcaacaggagcagcaaaggcagtggcccttgtcctcccaaccctcaaaggcaaactcaatggcattgcactccgtgtgccaacaccgaacgtctcagtggtgg

SEQ ID NO: 2448 - DNA, 276 bp, Glycine max
  unsure (1)...(276): unsure at all n locations
  Clone ID: 700991748H1
caangacaccggtggcgtgaaacaagcctctcaccttctcaagtacgattcgatcctcggaaccttcgatgctgatgtcaagcctgttggcagcgacatcatctctgtcgatggaaagaaatcaaagttgtctctgaccgcaaccctgccaaccttccttggaaagatttggggatagacttggtgattgaaggaactggggtgtttgtagacagagaaggtgcaaggaaacacattcnagcaggagctaagaaggtgctcattactgctcctggt

SEQ ID NO: 2449 - DNA, 259 bp, Glycine max
  Clone ID: 700752804H1
gcgtgaaacaagcctctcaccttctcaaatacgattccatcctcggaaccttcgatgctgatgtcaagcctgttggcagcaatgtcatctccgtggatggaaaggacatcaaagttgtttctgaccgcaaccctgccaaccttccttggaaggacttggggatagacttggtgattgaaggaaccggggtgtttgtagacagagaaggtgcagggaaacacattcaagcaggagctaagaaggtgctcatcactgctcc

SEQ ID NO: 2450 - DNA, 256 bp, Glycine max
  Clone ID: 700873301H1
cttccttggaaggacttggggatagacttggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacccatcatcagcaatgcctcttgcaccactaactgccttgcaccctttgtcaaggtccttgatcagaaattcg

SEQ ID NO: 2451 - DNA, 254 bp, Glycine max
  unsure (1)...(254): unsure at all n locations
  Clone ID: 700977867H1
atgactacagccctgatgaacccatcatcagcaatgcctcttgcaccactaactgccttgcaccctttgtcaaggtccttgatcagaaattcggtatcatcaagggtaccatgaccaccantcactcctacaccggtgaccaaaggcttcttgatgcgagccaccgtgacctgaggcgtgcaagggcagcagcactcancattgtccccacttcaacaggagcagcanaggcagtggcccttgtctcccaaccc

SEQ ID NO: 2452 - DNA, 300 bp, Glycine max
  Clone ID: 700558508H1
gggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagcctctcaccttctcaatacgattccatcctcggaaccttcgatgctgatgtcaagcctgttggcagcaatgtcatctccgtggatggaaaggaaatcaaagttgtttctgaccgcaaccctgccaaccttccttggaaggacttg

SEQ ID NO: 2453 - DNA, 277 bp, Glycine max
  Clone ID: 700558346H1
ccttgatcagaaattcggtatcatcaagggtaccatgaccaccacttcactcctacaccggtgaccaaaggcttcttgatgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtctcagtggtggactcgtcgttcaggtctcaaagaagactttgcagaag

SEQ ID NO: 2454 - DNA, 258 bp, Glycine max
  Clone ID: 701104595H1
ccgtggatggaaaggaaatcaaagttgtttctgaccgcaaccctgccaaccttccttggaaggacttggggatagacttggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacccatcatcagcaatgcctcttgca

SEQ ID NO: 2455 - DNA, 273 bp, Glycine max
  Clone ID: 701107372H1
gtcaagcctgttggcagcaatgtcatctccgtggatggaaaggaaatcaaagttgtttctgaccgcaaccctgccaaccttccttggaaggacttggggatagacttggtgattgaaggaaccggggtgtttgtggacagagaaggtgcagggaaacacattcaagcaggagctaagaaggtgctcatcactgctcctggtaaaggagatatccccacctacgtggttggtgtcaatgagtatgactacagccctgatgaacccatcatcagc

SEQ ID NO: 2456 - DNA, 263 bp, Glycine max
  Clone ID: 700877182H1
ggtgattgaaggaaccggggtgtttgtagacagagaaggtgcagggaaacacattcaagcaggagctacgaaggtgctcatcactgctcctggtaaaggagatatccccacctacgtggttggtgtcaatgagtatgactacagccctgatgaacccatcatcagcaatgcctcttgcaccactaagcgccttgcaccctttgtcaaggtccttgatcagaaattcggtatcatcaagggtaccatgaccaccactcactcct

SEQ ID NO: 2457 - DNA, 247 bp, Glycine max
  Clone ID: 700682345H2
ccctgccaaccttccttggaaggatttggggatagacttggtgattgaaggaactggggtgtttgtagacagagaaggtgcagggaaacacattcaagcaggagctaagaaggtgctcattactgctcctggtaaaggagacatccccacatatgtggttggtgtcaatgagtatgattacagccctgatgaacccatcatcagcaatgcatcttgcaccactaactgccttgcaccctttgtcaag

SEQ ID NO: 2458 - DNA, 265 bp, Glycine max
  unsure (1)...(265): unsure at all n locations
  Clone ID: 700999844H1
ggaacttcntgaggtgctggcacggtcgcaaagactcccctcttgatgtcattgccatcaacgacaccggcggcgtgaaacaagcctctcaccttctcaaatacgattccatcntcggaaccttcnatgctgatgtcaagcctgttggcagcaatgncatctccgtggatggaaaggaaatcaaagttgtttctgaccgcaaccctgccaaccttccttggnaggacttggggatagacntggtgattgaaggaaccgggtgttt

SEQ ID NO: 2459 - DNA, 283 bp, Glycine max
  Clone ID: 700962204H1
actgaacaacgaggtccaccactgagacgtttgcagaagaagtgaatgcagcattcagagagagtgcagacaatgagctccagggaatcctctctgtgtgtgatgagccacttgtgtctgttgacttcaggtgcactgatgtgtcctcaaccgttgactcatcgttgaccatggtcatgggagatgacatggttaaggtgattgcttggtatgacaatgagtggggctactcccaaagggttgtggatttggctgacattgttgccaacaagtggaagtgaga

SEQ ID NO: 2460 - DNA, 263 bp, Glycine max
  Clone ID: 700962351H1
ggaaatcaaagttgtttctgaccgcaaccctgccaaccttccttggaaggacttggggatagacttggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacccatcatcagcaatgcctcttgcaccactaactgccttgcac

SEQ ID NO: 2461 - DNA, 260 bp, Glycine max
  Clone ID: 700743037H1
caacgacaccggcggcgtgaaacaagcctctcaccttctcaaatacgattccatcctcggaaccttcgatgctgatgtcaagcctgttggcagcaatgtcatctccgtggatggaaaggaaatcaaattgtttctgaccgcaaccctgccaaccttccttggaaggacttggggatagacttggtgattgaaggaaccggggtgtttgtagacagagaaggtgcagggaaacacattcaagcaggagctaagaaggtgct

SEQ ID NO: 2462 - DNA, 263 bp, Glycine max
  unsure (1)...(263): unsure at all n locations
  Clone ID: 700975367H1
gcgacatcatctctgtcgatggnnaggnaatcaaagttgtctctgaccgcaaccctgccaaccttccttggaaggatttggggatagacttggtgattgaaggaactggggtgtttgtagacagagnnggtgcagggaaacacattcaagcaggagctaagaangtgctcattactgctcctgncaaaggagacatccccacatatgtggttggtgtcaatgagtatgattacagccctgatgaacccatcatcagcaatgca

SEQ ID NO: 2463 - DNA, 254 bp, Glycine max
  Clone ID: 700844411H1
gtcaatgagtatgactacagccctgatgaacccatcatcagcaatgcctcttgcaccactaactgccttgcaccctttgtcaaggtccttgatcagaaattcggtatcatcaagggtaccatgaccaccactcactcctacaccggtgaccaaaggcttcttgatgcgagccaccgtgacctgaggcgtgcaagggcagcagcactcaacattgtccccacttcaacaggagcagcaaaggcagtggcccttgt

SEQ ID NO: 2464 - DNA, 242 bp, Glycine max
  Clone ID: 700891407H1
atgcgagccaccgtgacctgaggcgtgcaagggcagcagcactcaacattgtccccacttcaacaggagcagcaaaggcagtggcccttgtcctcccaaccctcaaaggcaaactcaatggcattgcactccgtgtgccaacaccgaacgtctcagtggtggacctcgtcgttcaggtctcaaagaagacctttgcagaagaagtgaatgcagcattcagagagagtgcagacaatgagctc

SEQ ID NO: 2465 - DNA, 282 bp, Glycine max
  Clone ID: 700556475H1
ctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaacttcttgagg

SEQ ID NO: 2466 - DNA, 277 bp, Glycine max
  Clone ID: 700739632H1
caaagactcccctcttgatgtcattgccatcaactacaccggtggcgtgaaacaagcctctcaccttctcaagtacgattcgatcctcggaaccttcgatgctgatgtcaagcctgttggcagcgacatcatctctgtcgatggaaaggaaatcaaagttgtctctgaccgcaaccctgccaaccttcctaggcatgattgtgggatagacttggtgattgaaggaactggggtgtctgtagacagagaaggtgcacggtgacacttcatgcaggag

SEQ ID NO: 2467 - DNA, 259 bp, Glycine max
  Clone ID: 700752141H1
ctcgagccgcttcaacaggagcagcaaaggcagtggcccttgtcctcccaaccctcaaaagcaaactcaatggcattgcactccgtgtgccaacaccgaacgtctcagtggtggacctcgtcgttcaggtctcaaagaagacctttgcagaagaagtgaatgcagcattcagagagagtgcagacaatgagctcaagggaatcctctctgtgtgtgatgagccacttgtgtccgttgacttcaggtgcactgatgtgtc

SEQ ID NO: 2468 - DNA, 259 bp, Glycine max
  unsure (1)...(259): unsure at all n locations
  Clone ID: 700654954H1
gaaggacttggggatagacttggtgattgaaggaaccggggtgtttgtgcacagagaaggtgcagggaaacacattcaagcaggagctaagaaggtgctcatcactgctcctggtaaaggagatatccccacctacgtggttggtgtcnntgagtangnctacagcnctgatgancccatcatcagcaatgcctcnngcancactaactgccttgcaccctntgncaaggtcctngatcagaaattcggtatcatcaag

SEQ ID NO: 2469 - DNA, 235 bp, Glycine max
  Clone ID: 700874388H1
ctcactcctacaccggcgaccaaaggcttctcgacgcgagccaccgtgacctgaggcgcgccagggcggcagctctcaacattgtccccacttcaacaggagcagcaaaggcagtggcccttgtcctcccaaccctcaagggcaaactcaatggcattgcactccgtgtgccaacaccaaacgtctcagtggtggacctcgttgttcaggtctcaaagaagacctttgcagaaga

SEQ ID NO: 2470 - DNA, 286 bp, Glycine max
  Clone ID: 701156507H1
tggtggcgtgaaacaagcctctcaccttctcaagtacgattcgatcctcggaaccttcgatgctgatgtcaagcctgttggcagcgacatcatctctgtcgatggaaaggaaatcaaagttgtctctgaccgcaaccctgccaaccttccttggaaggatttggggatagacttggtgattgaaggaactggggtgtttgtagacagagaaggtgcagggaaacacattcaagcaggagctaagaaggtgctcattactgctcctggtaaaggagacatccccaca

SEQ ID NO: 2471 - DNA, 291 bp, Glycine max
  Clone ID: 700646112H1
gcttcggctactctctctgtagccaaaccacccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggatttggaaggattggaaggaacttcttgaggtgctggcacggtcgcaaagactcccctcttgatgtcattg

SEQ ID NO: 2472 - DNA, 245 bp, Glycine max
  Clone ID: 700873965H1
cgtggatggaaaggaaatcaaagttgtttctgaccgcaaccctgccaaccttccttggaaggacttggggatagacttggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacccatcatcagca

SEQ ID NO: 2473 - DNA, 240 bp, Glycine max
  Clone ID: 700741948H1
attggaaggaacttcttgaggtgctggcacggtcgcaaagactcccctcttgatgtcattgccatcaacgacaccggtggcgtgaaacaagcctctcaccttctcaagtacgattcgatcctcggaaccttcgatgctgatgtcaagcctgttggcagcgacatcatctctgtcgatggaaaggaaatcaaagttgtctctgaccgcaaccctgccaaccttccttggaaggatttgggg

SEQ ID NO: 2474 - DNA, 251 bp, Glycine max
  Clone ID: 700875513H1
ggcagcaatgtcatctccgtggatggaaaggaaatcaaagttgtttctgaccgcaaccctgccaaccttccttggaaggacttggggatagacttggtgattgaaggaaccggggtgtttgtagacagagaaggtgcagggaaacacattcaagcaggagctaagaaggtgctcatcactgctcctggtaaaggagatatccccacctacgtggttggtgtcaatgagtatgactacagccctgatgaacc

SEQ ID NO: 2475 - DNA, 245 bp, Glycine max
  Clone ID: 700874967H1
accctgccaaccttccttggaaggacttggggatagacttggtgattgaaggaaccggggtgtttgtagacagagaaggtgcagggaaacacattcaagcaggagctaagaaggtgctcatcactgctctggtaaaggagatatccccacctacgtggttggtgtcaatgagtatgactacagccctgatgaacccatcatcagcaatgcctcttgcaccactaactgccttgcaccctttgtca

SEQ ID NO: 2476 - DNA, 283 bp, Glycine max
  Clone ID: 700559242H1
gaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaattcttgaggtgctggcagg

SEQ ID NO: 2477 - DNA, 296 bp, Glycine max
  Clone ID: 700559801H1
gcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaattcttgaggtgctg

SEQ ID NO: 2478 - DNA, 246 bp, Glycine max
  Clone ID: 700659588H1
gtgaatgcagcattcagagagagtgcagacaatgagctcaagggaatcctctctgtgtgtgatgagccacttgtgtccgttgacttcaggtgcactgatgtgtcctcaaccgttgactcctcgttgaccatggtcatgggagatgacatggtgaaggtcattgcttggtatgacaatgaatggggctactcccaaagggttgtggatttggctgacattgttgccaacaaatggaagtgagagcca

SEQ ID NO: 2479 - DNA, 271 bp, Glycine max
  Clone ID: 700725516H1
gtttgtagacagagaaggtgcagggaaacacattcaagcaggagctaagaaggtgctcattactgctcctggtaaaggagacatccccacatatgtggttggtgtcaatgagtatgattacagccctgatgaacccatcatcagcaatgcatcttgcaccactaactgccttgcaccctttgtcaaggtccttgatcagaaattcggtatcatcaagggcaccatgaccaccactcactcctacaccggcgaccaaaggcttctcgacgcg

SEQ ID NO: 2480 - DNA, 244 bp, Glycine max
  Clone ID: 700901411H1
aacacattcaagcaggagctaagaaggtgctcattactgctcctggtaaaggagacatccccacatatgtggttggtgtcaatgagtatgattacagccctgatgaacccatcatcagcaatgcatcttgcaccactaactgccttgcaccctttgtcaaggtccttgatcagaaattcggtatcatcaagggcaccatgaccaccactcactcctacaccggcgaccaaaggcttctcgacgc

SEQ ID NO: 2481 - DNA, 246 bp, Glycine max
  Clone ID: 700790272H2
gacagaagcaaaactgaaggttgccataaacggatttggaaggattggaaggaacttcttgaggtgctggcacggtcgcaaagactcccctcttgatgtcattgccatcaacgacaccggtggcgtgaaacaagcctctcaccttctcaagtacgattcgatcctcggaaccttcgatgctgatgtcaagcctgttggcagcgacatcatctctgtcgatggaaaggaaatcaaagttgtctctga

SEQ ID NO: 2482 - DNA, 248 bp, Glycine max
  Clone ID: 700942783H1
aggtctcaaagaagacctttgcagaagaagtgaatgcagcattcagagagagtgcagacaatgagctccagggaatcctctctgtgtgtgatgagccacttgtgtctgttgacttcaggtgcactgtgtgtcctcaaccgttgactcatcgttgaccatggtcatgggagatgacatggttaaggtgattgcttggtatgacaatgagtggggctactcccaaagggttgtggatttggctgacattg

SEQ ID NO: 2483 - DNA, 256 bp, Glycine max
  Clone ID: 700876055H1
gcttcggctactctctctgtagccaaaccagcccttcaggcaaatgggaaaggcttctctgaattctctggcctccgcagctcatcaggcttccttcccttttctagaaaatcttcagaggatttccattctgtcatgccttccagacctatgcagttggaagcagtggaggatacaagaagggtgtgacagaagcaaaactgaaggttgccatatacggatttggaaggattggaaggaacttcttgaggtgctg

SEQ ID NO: 2484 - DNA, 292 bp, Glycine max
  Clone ID: 700554719H1
ctgctctagaaaattcagtggtgatacatggcttcggctactctctctgtagccaaaccagcccttcaggcaaatgggaaaggcttctctgaattctctggcctccgcagctcatcaggcttccttcccttttctagaaaatctacagaggatttccattctgtcattgccttccagacctatgcagttggaagcagtggaggatacaagaagggtgtgacagaagcaaaactgaaggttgccataaacggatttggaaggattggaagaattcttgaggtgctggcaggtc

SEQ ID NO: 2485 - DNA, 272 bp, Glycine max
  unsure (1)...(272): unsure at all n locations
  Clone ID: 700993112H1
tctgctctagaaaattcagtggtgatacatggcttcggctactctctctgtagccaaaccagcccttcaggcaaatgggaaaggcttctctgaattctctggcctccgcagctcatcaggcttnccttcccttttctagaaaatcttcagangatttccattctgtcattgccttccagacctatgcagttgnaagcagtggaggatacaagaagggtgtgacagaagcaaaactgaaggttgccataaacggatttggaaggattggaagg

SEQ ID NO: 2486 - DNA, 264 bp, Glycine max
  Clone ID: 700684688H1
gtcgagccgatcatcaagggcaccatgaccaccactgactcctacaccggcgaccaaaggcatctcgacgcgagccaccgtgacctgaaccgcgccagggcggcagctctcaacattgtccccacttgaccagcagcagcaaaggcagtggcccttgtcctcccaaccctcaagggcaaactcaatggcattgcactccgtgtgccaacaccaaacgtctcagtggtggacctcgttgttcaggtctcaaagaagacctttgca

SEQ ID NO: 2487 - DNA, 242 bp, Glycine max
  Clone ID: 700890177H1
agcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggatttggaaggattggaaggaacttcttgaggtgctggcacggtcgcaaag

SEQ ID NO: 2488 - DNA, 280 bp, Glycine max
  unsure (1)...(280): unsure at all n locations
  Clone ID: 700554380H1
catggcttcggctactctctctgtagccaaaccagcccttcaggcaaatgggaaaggcttctctgaattctctggcctccgaagctcatcaggcttccnncccttttctagaaaatcttcagaggatttccattctgtcattgccttccagacctatgcagttggaagcagtggaggatacaagaagggtgtgacagaagcaaaactgaaggttgccataaacgggtttggaaggattggaaggaattcttgaggtgctggcaggtcgcaaagatcccct

SEQ ID NO: 2489 - DNA, 246 bp, Glycine max
  Clone ID: 700876338H1
agagtgcagacaatgagctccagggaatcctctctgtgtgtgatgagccacttgtgtctgttgacttcaggtgcactgatgtgtcctcaaccgttgactcatcgttgaccatggtcatgggagatgacatggttaaggtgattgcttggtatgacaatgagtggggctactcccaaagggttgtggatttggctgacattgttgccaacaagtggaagtgagagccatcaaattctgaattggtaa

SEQ ID NO: 2490 - DNA, 297 bp, Glycine max
  Clone ID: 700993901H1
gtgggatggaaaggaaatcaaagttgtttctgaccgcaaccctgccaaccttccttggaaggacttggggatagacttggtgattgaaggaaacggggtgtttgtagacagagaaggtgcagggaaacacatttcaagcaggagtaagaaggtgtcatcatgtcctggtaaaggagatatccccactacgtggttggtgtcaatgagtatgactacagcctgatgaacccatcatcagcaatgcctcttgcaccataatgcttgcaccctttgtcaaggtccttgatcagaaattcg

SEQ ID NO: 2491 - DNA, 282 bp, Glycine max
  Clone ID: 701103760H1
cctcgagccgaatcggctcgagtggcattgcactccgtgtgccaacaccaaacgtctcagtggacggacctcgttgttcaggtctcaaagaagacctttgcagaagaagtgaatgcagcattcagagagagtgcagacaatgagctccagggaatcctctctgtgtgtgatgagccacttgtgtctgttgacttcaggtgcactgatgtgtcctcaaccgttgactcatcgttgaccatggtcatgggagatgacatggttaaggtgattgcttggtatgac

SEQ ID NO: 2492 - DNA, 261 bp, Glycine max
  Clone ID: 700684581H1
cccaggattcggctcgagccgaacgtctcagtggtggacctcgtcgatcaggtctcaaagaagacctttgcagaagaagtgaatgcagcattcagagagagtgcagacaatgagctcaagggaatcctctctgtgtgtgatgagccacttgtgtccgttgacttcaggtgcactgatgtgtccccaaccgttgactcctcgttgaccatggtcatgggagatgacatggtgaaggtcattgcttggtatgacaatgaatgg

SEQ ID NO: 2493 - DNA, 264 bp, Glycine max
  Clone ID: 701049681H1
ctgccttgcaccctttgtcaaggtccttgatcagaaattcgatatcatcaagggtaccatgaccaccactcactcctacaccggtgaccagaggcttcttgatgcgagccaccgtgacctgaggcgtgcaagggcagcagcactcaacattgtccccacttcaacaggagcagcaaaggcagtggccttgtcctcccaccctcaaagggcaactcaatggcattgcactccgtatgccaacacggaacgtctcaatggtgcacc

SEQ ID NO: 2494 - DNA, 274 bp, Glycine max
  Clone ID: 700681925H1
ccgaagctcatcaggcttccttcccttttctagaaaatcttcagaggatttccattctgtcattgccttccagacctatgcagttgcaagcagtggaggatacaagaagggtgtgacagaagcaaaactgaaggttgccataaaccggtttggaaggattggaaggaacttcttgaggtgctggcacggtcgcaaagactcccctctcaatgtcattgccatcaacgacaccggcggcgtgaaacaagcctctcaccttctcaaatacgattcc

SEQ ID NO: 2495 - DNA, 255 bp, Glycine max
  Clone ID: 700680184H2
cttcttgaggtgctggcacggtcgcaaagactcccctcttgatgtcagtgccatcaacgacaccggtggcgtgaaacaagcctctcaccttctcaagtacgattcgatcgtcggaaccttcgatgctgatgtcaagcctgttggcagcgacatcatctctgtcgatggaaaggaaatcaaagttgtctctgaccgcaggcctgccaaccttccttggaaggatttggggatagacttggtgattgaaggactggg

SEQ ID NO: 2496 - DNA, 249 bp, Glycine max
  Clone ID: 701108645H1
gggaatcctctctgtgtgtgatgagccacttgtgtccgttgacttcaggtgcactgatgtgtcctcaaccgttgactcctcgttgaccatggtcatgggagatgacatggtgaaggtcattgcttggtatgacaatgaatggggctactcccaaagggttgtggatttggctgacattgttgccaacaaatggaagtgagagccaaacaaattctcattggtaattaaattatgtatgtaccatgccat

SEQ ID NO: 2497 - DNA, 267 bp, Glycine max
  Clone ID: 701106940H1
cggaatcctctctgtgtgtgatgagccacttgtgtccgttgacttcaggtgcactgatgtgtcctcaaccgttgactcctcgttgaccatggtcatgggagatgacatggtgaaggtcattgcttggtatgacaatgaatggggctactcccaaagggttgtggatttggctgacattgttgccaacaaatggaagtgagagccaaacaaattctcattggtaattaaattatgtatgtaccacgccattgtaattttgtatgctta

SEQ ID NO: 2498 - DNA, 278 bp, Glycine max
  unsure (1)...(278): unsure at all n locations
  Clone ID: 700984503H1
ggaaccggnggtgtttgtagacaganaaggtncatggaaacacattcaagcaggagctaagaaggtgctcatgcactgctcctggtaaaggagatanccccaccttacgtggttggtgtcaatgagtatgactanagcnctgatgancccnttcatnancaatgcctcntgcaccactaactgccttgcaccctntgtcaaggtccttgatcagaaattcggtatcatcaagggtancatgaccaccactncatcctacaccggtgaccaaaggcttc

SEQ ID NO: 2499 - DNA, 252 bp, Glycine max
  Clone ID: 700738754H1
gaaaatcttcagaggatttccattctgtcattgccttccagacctatgcagttggaagcagtggaggatacaagaagggtgtgacagaagcaaaactgaaggttgccataaacggatttggaaggattggaaggaacttcttgaggtgctggcacggtcgcaaagactcccctcttgatgtcattgccatcaacgacaccggtggcgtgaaacaagcctctcaccttctcaagtacgattcgatcctcggaa

SEQ ID NO: 2500 - DNA, 220 bp, Glycine max
  Clone ID: 700685581H1
cactcctacaccggcgaccaaaggcttctcgacgcgagccaccgtgacctgaggcgcgccagggcggcagctctcaacattgtccccacttcaacaggagcagcaaaggcagtggcccttgtcctcccaaccctcaagggccaactcaatggcattgcactccgtgtgccaacaccaaacgtctcagtggtggacctcgttgttcaggtctcaaagaaga

SEQ ID NO: 2501 - DNA, 289 bp, Glycine max
  unsure (1)...(289): unsure at all n locations
  Clone ID: 700977296H1
ctgtcattgccttccagacctatgcagttgnaagcagtggaggatacaagaagggtgtgacagaagcaaaactgaaggttgccataaacggatttggaaggattggncggaacttcttgaggtgctggcacggtcgcaaagactcccctctgatgtcattgccatcaacgacaccggtggcgtgaaacaagcctctcaccttctcaagtacgattcgatcctcggaaccttcgatgctgatgtcaagcctgttggcagcgacatcatctctgtcgatggaaaggaaatc

SEQ ID NO: 2502 - DNA, 291 bp, Glycine max
  unsure (1)...(291): unsure at all n locations
  Clone ID: 700999412H1
tccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagcctctcacttctcaaatacgattccatcctcggaaccttcgatgctgatgtcaagcctgttggcagcatgtcatctccgtggatggaaaggaattcaaagttntttctgnc

SEQ ID NO: 2503 - DNA, 271 bp, Glycine max
  Clone ID: 700898819H1
agccacttgtgtccgttgacttcaggtgcactgatgtgtcctcaaccgttgactcctcgttgaccatggtcatgggagatgacatggtgaaggtcattgcttggtatgacaatgaatggggctactcccaaagggttgtggatttggctgacattgttgccaacaaatggaagtgagagccaaacaaattctcattggtaattaaattattatgtatgtaccatgccattgtaattttgtatgcttactactactactaaccactacacac

SEQ ID NO: 2504 - DNA, 269 bp, Glycine max
  Clone ID: 700994354H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaa

SEQ ID NO: 2505 - DNA, 267 bp, Glycine max
  Clone ID: 700685709H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaa

SEQ ID NO: 2506 - DNA, 258 bp, Glycine max
  Clone ID: 700738315H1
ctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatgcttcagaggatttccattctgtcattgccttccagacctatgcagttggaagcagtggaggatacaagaagggtgtgacagaagcaaaactgaaggttgccataaacgggtttgg

SEQ ID NO: 2507 - DNA, 250 bp, Glycine max
  Clone ID: 700873275H1
tactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaa

SEQ ID NO: 2508 - DNA, 282 bp, Glycine max
  Clone ID: 700555226H1
gcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggagatggaaggaattc

SEQ ID NO: 2509 - DNA, 242 bp, Glycine max
  Clone ID: 700892169H1
accttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaag

SEQ ID NO: 2510 - DNA, 251 bp, Glycine max
  Clone ID: 701107458H1
cttctgctctagaaaattcagtgctgaaacatggcttcggctaatctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaa

SEQ ID NO: 2511 - DNA, 268 bp, Glycine max
  Clone ID: 701047451H1
cttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttacattctgtcattgccttccagacctatgcagttggaagcagtggaggatacaagaagggtgtgacagaagcaaaactgaaggttgccataaacgggtttggaa

SEQ ID NO: 2512 - DNA, 248 bp, Glycine max
  unsure (1)...(248): unsure at all n locations
  Clone ID: 700994065H1
cttacaagcctctactatactgcttcancttctgctctagaaaattacagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagaccnatgcagttggaagcagtggaggatacaagaagggt

SEQ ID NO: 2513 - DNA, 250 bp, Glycine max
  Clone ID: 700968347H1
ctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaa

SEQ ID NO: 2514 - DNA, 245 bp, Glycine max
  Clone ID: 700740108H1
ttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaa

SEQ ID NO: 2515 - DNA, 279 bp, Glycine max
  Clone ID: 700556578H1
tagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgc

SEQ ID NO: 2516 - DNA, 289 bp, Glycine max
  Clone ID: 700646223H1
ctagtttcttacaaggctctactctactgcttcaccttctgcactagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacgg

SEQ ID NO: 2517 - DNA, 258 bp, Glycine max
  Clone ID: 700686442H1
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacag

SEQ ID NO: 2518 - DNA, 248 bp, Glycine max
  Clone ID: 700995540H1
tactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactg

SEQ ID NO: 2519 - DNA, 252 bp, Glycine max
  Clone ID: 700997359H1
caaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagat

SEQ ID NO: 2520 - DNA, 271 bp, Glycine max
  Clone ID: 700863529H1
ctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaac

SEQ ID NO: 2521 - DNA, 260 bp, Glycine max
  Clone ID: 700874946H1
gtttcttacaaggctctactctactgcttcaccttctgctctagaaaattcagtggtgatacatggcttcggctactctctctgtagccaaaccagcccttcaggcaaatgggaaaggcttctctgaattctctgacctccgcagctcatcaggcttccttcccttttctagaaaatcttcagaggatttccattctgtcattgccttccagacctatgcagttggaagcagtggaggatacaagaagggtgtgacagaa

SEQ ID NO: 2522 - DNA, 253 bp, Glycine max
  Clone ID: 700789664H2
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgt

SEQ ID NO: 2523 - DNA, 294 bp, Glycine max
  Clone ID: 700559731H1
ctagtttcttacaaggctctactctatgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataacggatttgga

SEQ ID NO: 2524 - DNA, 254 bp, Glycine max
  Clone ID: 701141680H1
ctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactg

SEQ ID NO: 2525 - DNA, 270 bp, Glycine max
  Clone ID: 700555668H1
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactga

SEQ ID NO: 2526 - DNA, 292 bp, Glycine max
  unsure (1)...(292): unsure at all n locations
  Clone ID: 700553965H1
ctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaaggnttg

SEQ ID NO: 2527 - DNA, 269 bp, Glycine max
  Clone ID: 700989276H1
accttctgctctagaaaatcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggatttgaaggattgg

SEQ ID NO: 2528 - DNA, 266 bp, Glycine max
  Clone ID: 701213488H1
ctcgagccggtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgaca

SEQ ID NO: 2529 - DNA, 264 bp, Glycine max
  Clone ID: 701120382H1
ctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgc

SEQ ID NO: 2530 - DNA, 276 bp, Glycine max
  Clone ID: 700740875H1
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttg

SEQ ID NO: 2531 - DNA, 255 bp, Glycine max
  Clone ID: 700741835H1
gtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtga

SEQ ID NO: 2532 - DNA, 265 bp, Glycine max
  unsure (1)...(265): unsure at all n locations
  Clone ID: 700995653H1
ctagtttcttacaagcctctactatactgcttcaccttctgctcnagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctntgcagttggaagcagtggaggatacaagaagggtgtgacagaagc

SEQ ID NO: 2533 - DNA, 268 bp, Glycine max
  Clone ID: 700906218H1
gtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccaaacctatgcagttggaagcagtggaggatacaagaagggtgtgacagaagcaaaact

SEQ ID NO: 2534 - DNA, 264 bp, Glycine max
  Clone ID: 700684347H1
actgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccagtctgtcattgccttccagacctatgcagttggaagcagtggaggatacaagaagggtgtgacagaagcaaaactgaaggttgccataaacgg

SEQ ID NO: 2535 - DNA, 270 bp, Glycine max
  Clone ID: 700728605H1
caaggctctactctactgcttcaccttctgctctagaaaatttagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattaccttccagacctatgcagttggaagcagtggaggatacaagaagggtgtgacagaagcaaaactgaaggttgcc

SEQ ID NO: 2536 - DNA, 252 bp, Glycine max
  Clone ID: 700789578H2
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagg

SEQ ID NO: 2537 - DNA, 278 bp, Glycine max
  Clone ID: 700787421H2
gtttcttacaagcctctactatactgcttcaccttctgctctagaaaattcagtgctgaaacatggcttcggctactctctctgtagccaaaccagcccttcaggcaaatgggaaaggcttctctgaattctatggcctccgaagctcatcaggcttccttcccttctctagaaaatcttcagaggatttccattctgtcattgccttccagacctatgcagttggaagcagtggaggatacaagaagggtgtgacagaagcaatactgaaggttgcc

SEQ ID NO: 2538 - DNA, 284 bp, Glycine max
  unsure (1)...(284): unsure at all n locations
  Clone ID: 700560934H1
agcctctactatactgcttcaccttctgctctaganaattcagtgcntccaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatatcagaagggtgtgacagaagcaaaactgaaggttgccatncagggtttggaa

SEQ ID NO: 2539 - DNA, 247 bp, Glycine max
  Clone ID: 700876650H1
actgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactg

SEQ ID NO: 2540 - DNA, 273 bp, Glycine max
  Clone ID: 700740868H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgatgctcatcaggcttccttcccttttctagaaaatcttcagaggatttccattctgtcattgccttccagacctatgcagttggaagcagtggaggatacaagaagggtgtgacagaagcaaaactga

SEQ ID NO: 2541 - DNA, 246 bp, Glycine max
  Clone ID: 700741374H1
gcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaa

SEQ ID NO: 2542 - DNA, 245 bp, Glycine max
  unsure (1)...(245): unsure at all n locations
  Clone ID: 700994074H1
tttcttacaagcctctactatactgcttcaccttctgctctagnaaattcagtnctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcngttggaagcagtggaggatacaaga

SEQ ID NO: 2543 - DNA, 267 bp, Glycine max
  Clone ID: 701109502H1
ctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaa

SEQ ID NO: 2544 - DNA, 252 bp, Glycine max
  Clone ID: 700875104H1
caaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcagtgccttccagacctatgcagttggaagcagtggaggatacaagaagggtgtgacagaa

SEQ ID NO: 2545 - DNA, 248 bp, Glycine max; identical to SEQ ID NO: 2518
  Clone ID: 700786270H2

SEQ ID NO: 2546 - DNA, 281 bp, Glycine max
  unsure (1)...(281): unsure at all n locations
  Clone ID: 700556484H1
tgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggntttccattctgtcattgccttccagacctatgcagttggaagcagtggaggatacangaagggtgtgacagaagcaaaactgaaggntgccataaagggtttggaaggatggaaggaa

SEQ ID NO: 2547 - DNA, 261 bp, Glycine max
  unsure (1)...(261): unsure at all n locations
  Clone ID: 700998979H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggnagcagtggaggatacaanaagggtgtgacag

SEQ ID NO: 2548 - DNA, 233 bp, Glycine max
  Clone ID: 701109358H1
agaaaattcagtgctgaaacatggcttcggctactctctctgtagccaaaccagcccttcaggcaaatgggaaaggcttctctgaattctctggcctccgaagctcatcaggcttccttcccttttctagaaaaccttcagaggatttccattctgtcattgccttccagacctatgcagttggaagcagtggaggatcaagaagggtgtgacagaagcaaaactgaaggttg

SEQ ID NO: 2549 - DNA, 312 bp, Glycine max
  Clone ID: 700763760H1
tattcagagagagtgcagacaatgagctcaagggaatcctctctgtgtgtgatgagccacttgtgtccgttgacttcaggtgcactgatgtgtcctcaaccctcaaaggcaaactcaatggcattgcactccgtgtgccaacaccgaacgtctcagtggtggacctcgtcgttcaggtctcaaagaagacctttgcagaagaagtgaatgcagcattcagagagagtgcagacaatgagctcaagggaatcctctctgtgtgtgatgagccacttgtgtccgttgacttcaggtgcactgatgtgtcctcaa

SEQ ID NO: 2550 - DNA, 267 bp, Glycine max
  Clone ID: 701001681H1
ctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttccctttctagaaaatcttcagaggatttccattctgtcattgccttccagacctatgcagttggaagcagtggaggatacaagaagggtgtgacagaagcaaaactgaaggttgccata

SEQ ID NO: 2551 - DNA, 274 bp, Glycine max
  unsure (1)...(274): unsure at all n locations
  Clone ID: 700991945H1
gtttcttacaagcctctactatactgcttcaccttctgctctagaaaattcagtgctgaaacatggcttcngcncctctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttnnaagcagtggaggatacaagaagggtgtgacagaagcaaaactganggt

SEQ ID NO: 2552 - DNA, 230 bp, Glycine max
  Clone ID: 700789781H1
caagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggagg

SEQ ID NO: 2553 - DNA, 279 bp, Glycine max
  unsure (1)...(279): unsure at all n locations
  Clone ID: 700554372H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtccattgcctccagacctatgcagttggnagcagtggaggatacaagaagggtgtgacagaagcaaaactgaaggttg

SEQ ID NO: 2554 - DNA, 251 bp, Glycine max
  unsure (1)...(251): unsure at all n locations
  Clone ID: 700993753H1
gtcattgccttccagacctatgcagttgnaagcagtggaggatactagaagggtgtgacatgaagcaaaactgaaggttgccataaacggatttggaaggattggaaggaacttcttgaggtgctggcacggtcgcaaagactcccctcttgatgtcattgccatcaacgacaccggtggcgtgaaacaagcctctcaccttctcaagtacgattcgatcctcggaaccttcgatgctgatgtcaagcctg

SEQ ID NO: 2555 - DNA, 239 bp, Glycine max
  Clone ID: 700876992H1
tctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacacgcagggtgtgacag

SEQ ID NO: 2556 - DNA, 275 bp, Glycine max
  Clone ID: 700960223H1
ctagtttcttacaaggctctactctactgcttcaccttctgctctagaaaattcagtggtgatacatggcttcggctactctctctgtagccaaaccagcccttcaggcaaatgtcgaaaggcttctctgaattctctggcctccgcagctcatctggcttccttcccttttctagaaaatcttcagaggatttccattctgtcattgccttccagacctatgcagttggaagcagtggaggatacaagaagggtgtgacagaagcaaaactgaa

SEQ ID NO: 2557 - DNA, 247 bp, Glycine max
  Clone ID: 700686495H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagtttaaagcagtggaggatacaa

SEQ ID NO: 2558 - DNA, 278 bp, Glycine max
  unsure (1)...(278): unsure at all n locations
  Clone ID: 700557711H1
ctgaaacatggcttcggctactctctctgtagccaaaccagcccttcaggcaaatgggaaaggctctctgaattctctggcctccgaagctcatcaggcttccttaccttttctagaaaatcttcagaggatttccattctgtcattgccttccagacctatgcagttggaagcagtggaggatacaagaagggtgtgncagaagcaaaactgaaggttgccataaacgggtttggaaggattggaagganttcttgaggtgctggcaggtcgcaaag

SEQ ID NO: 2559 - DNA, 300 bp, Glycine max
  unsure (1)...(300): unsure at all n locations
  Clone ID: 700984028H1
cttnaccttctgctctaganaattcngtgctgaaanatgggcttcggctaattctctctgtaggcaaaacnagcctttcaggcaaatggganaggcttctctgaattctctggcctccgaagctcatcaggcttccttcccttttctagaaaatcttcagaggatttccattctgtcatngccttccagacctatgcngttggaagcagtggaggatacaagnngggtgtgacagaagcaaaactgaaggttgccataaacgggtttggaaggattggaaggaattcttgaggtgctggc

SEQ ID NO: 2560 - DNA, 277 bp, Glycine max
  unsure (1)...(277): unsure at all n locations
  Clone ID: 700556584H1
tgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcatgccttccagacctatgcagttggaagcagtggaggatacaagaanggtgtgacagaagcaaaactgaaggttgccataaacgggtttggaaagatggaa

SEQ ID NO: 2561 - DNA, 233 bp, Glycine max
  Clone ID: 700870942H1
gcttcggctactctctctgtagccaaaccagcccttcaggcaaatgggcaaggcttctctgaattctctggcctccgcagctcatcaggcttccttcccttttcacgaaaatcttcagaggatttccattctgtcattgccttcccgacctatgcagttgtaagcagtggaggatacaagaagggtgtgacagaacaaaacctgaaggttccataaacggatttggaaggatt

SEQ ID NO: 2562 - DNA, 221 bp, Glycine max
  Clone ID: 700871710H1
tccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagcctctcaccttctcaaatacgattccatcctcggaaccttc

SEQ ID NO: 2563 - DNA, 238 bp, Glycine max
  Clone ID: 700738589H1
gtttcttacaagcctctactatactgcttcaccttctgctctagaaaattcagtgctgaaacatggcttcggctactctctctgtaaccaaaccagcccttcaggcaaatgggaaaggcttctctgaattctctggcctccgaagctcatcaggcttccttcccttttctagaaaatcttcagaggatttccattctgtcattgccttccagacctatgcagttaggaacagtggagg

SEQ ID NO: 2564 - DNA, 238 bp, Glycine max
  Clone ID: 700738856H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtgg

SEQ ID NO: 2565 - DNA, 274 bp, Glycine max
  unsure (1)...(274): unsure at all n locations
  Clone ID: 701002335H1
ctagtttcttacaagcctctactatactgcttcaccttctgctctagaaaattcagtgctgaaacatgggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcngttggaagcagtggaggatacaagaagggtgtgacagaagcaaaactga

SEQ ID NO: 2566 - DNA, 257 bp, Glycine max
  unsure (1)...(257): unsure at all n locations
  Clone ID: 701001628H1
ctatactgcttcaccttctgctctagaaaattcagtgctgaaacatgggcttcggctactctctctgtagccaaaccagcccttcaggcaaatgggaaaggcttctctgaattctctggcctccgaagctcatcaggcttccttcccttttctagaaaatcttcagaggatntccattctgtcattgccttccagacctatgcagttggaagcagtggaggatacaagaagggtgtgacagaagcaaaactgaaggt

SEQ ID NO: 2567 - DNA, 266 bp, Glycine max
  Clone ID: 700787485H2
ctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcataaggcttccttcccttttctagaaaatcttcagaggatttccattctgtcattgccttccagacctatgcagttggaagcagtggaggatacaagaagggtgtgacagaagca

SEQ ID NO: 2568 - DNA, 228 bp, Glycine max
  Clone ID: 700683818H1
gaagggtttgacagaagcaaaactgaaggttgccataaacggatttggaaggattggaaggaacttcttgaggtgctggcacggtcgcaaagactcccctcttgatgtcattgccatcaacgacaccattggcgtgaaacaagcctctcaccttctcaagtacgattcgatcttcggaaccttcgatgctgatgtcaagcctgttggcagcttcatcatctctgtcga

SEQ ID NO: 2569 - DNA, 285 bp, Glycine max
  unsure (1)...(285): unsure at all n locations
  Clone ID: 700554247H1
tagtttcttacaaggctctactctactgcttcaccttctgctcnagaaaattcagtggtgatacatggcttcggctactctctctgtagccaaaccagcccttcaggcaaatgggaaaggctctctgaattctctggcctccgcagctcatcaggcttccttcccttttctagaaaatcnccagaggatttccattctgtcattgccttccagaccaatgcagttggaagcagtggaggatacaagaagggtgtgacagaagcaaaactgaaggttgccataaac

SEQ ID NO: 2570 - DNA, 198 bp, Glycine max
  Clone ID: 700744021H1
gtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaaggg

SEQ ID NO: 2571 - DNA, 254 bp, Glycine max
  Clone ID: 700787533H1
gtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggctctcttcccttttctagaaaatcttcagaggatttccattctgtcattgcctaccagacctatgcagttggaagcagtggaggatacaagaagggtgtg

SEQ ID NO: 2572 - DNA, 260 bp, Glycine max
  unsure (1)...(260): unsure at all n locations
  Clone ID: 700985942H1
ctcgagcgtaactgcttcaccttctgctctagaaaattcagtgctgaaacatggctncngctactctctctgtagccaaaccagcccttcaggcaaatgggaaaggcttctctgaattctctggcctccgaagctcatcaggcttccttcccttttctagaaaatcttcagaggatttccattctgtcattgccttccagaccatgcagttggaagcngtggaggatacaagaagggtgtgacagaagcaaaactgaagg

SEQ ID NO: 2573 - DNA, 280 bp, Glycine max
  Clone ID: 701104728H1
gaaaattcagtgctgaaacatggcttcggctactctctcttaagccaaaccagcccttcaggcaaatgggaaaggcttctctgaattctctggcctccgaagctcatcaggcttccttcccttttctacaaaatcttcagaggatttccattctgtcattgccttccagacctatgcagttggaagcagtggaggatacaagaagggtgtgacagaagcaaaactgaaggttgccataaacgggtttggaaggattggaaggaacttcttgaggtgctgg

SEQ ID NO: 2574 - DNA, 284 bp, Glycine max
  unsure (1)...(284): unsure at all n locations
  Clone ID: 700988933H1
gtttctnacaagcctctactatactgcttcaccttctgctctagaaaattcagtgctgaaacatggcttcggctacttctctctgtagccaaaccagcccttcaggcaaatgggaaaggcttctctgaattctctggcctccgaagctcatcaggcttccttcccttttctagaaaatcttcagaggatttccattctgtcattgccttccanacctatgcagttgtaancagtggaggatacaagaagggtgtganagnagcaaaactgaaggttgccataaa

SEQ ID NO: 2575 - DNA, 266 bp, Glycine max
  Clone ID: 701109795H1
ctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgcca

SEQ ID NO: 2576 - DNA, 294 bp, Glycine max
  Clone ID: 700984329H1
ctagtttcttacaaggctctactctactgcttcaccttctgctctagaaaattcagtggtgatacatggcttcggctactctgctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggattt

SEQ ID NO: 2577 - DNA, 264 bp, Glycine max
  unsure (1)...(264): unsure at all n locations
  Clone ID: 701000601H1
tactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattcngtcattgccttccagacctatgcagttggaagcagtgggaggatacaagaagggtgtgacagaagcaaaactgaaggttgccataaac

SEQ ID NO: 2578 - DNA, 256 bp, Glycine max
  Clone ID: 700686572H1
ttcgagcgattcggctcactagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtgg

SEQ ID NO: 2579 - DNA, 239 bp, Glycine max
  Clone ID: 700791971H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtgga

SEQ ID NO: 2580 - DNA, 257 bp, Glycine max
  Clone ID: 700740621H1
ctctactctactgcttcaccttctgctctagaaaattcagtggtgatacatggcttcggctactctctctgtagccaaaccagcccttcaggcaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaa

SEQ ID NO: 2581 - DNA, 271 bp, Glycine max
  unsure (1)...(271): unsure at all n locations
  Clone ID: 700994492H1
cttacaaggctctactctactgcttcaccttctgctctagaaaattcagtggtgatacatggcttcggctactctctctgtagccaaaccngcccttcaggcaaatgggaaaggcttctctgaattctctggcctccgcagctcatcagggctccttncccttttctagaaaatcttcagaggatttccattctgtcattgccttccagacctatggcagttggaagcagtggaggatacaagaagggtgtgacagaagcaaaactgaagg

SEQ ID NO: 2582 - DNA, 247 bp, Glycine max
  Clone ID: 701108677H1
caaggctctactctacttcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaacggtgtga

SEQ ID NO: 2583 - DNA, 244 bp, Glycine max
  Clone ID: 700740371H1
ctttgcagaagaagtgaatgcaaaggtcttctttgagacctgaacaacgaggtccaccactgagacgtttgcagaagaagtgaatgcagcattcagagagagtgcagacaatgagctccagggaatcctctctgtgtgtgatgagccacttgtgtctgttgacttcaggtgcactgatgtgtcctcaaccgttgactcatcgttgaccatggtcatgggagatgacatggttaaggtgattgct

SEQ ID NO: 2584 - DNA, 260 bp, Glycine max
  Clone ID: 700737944H1
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagagaatcttcagaggatttccattctgtcattgccttccagacctatgcagttggaagcagtggaggttacaagaagggtgttacagaa

SEQ ID NO: 2585 - DNA, 226 bp, Glycine max
  Clone ID: 700788840H2
caaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtg

SEQ ID NO: 2586 - DNA, 247 bp, Glycine max
  Clone ID: 700741626H1
actgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtgaggatacaagaagggtgtgacagaagcaaaactga

SEQ ID NO: 2587 - DNA, 268 bp, Glycine max
  Clone ID: 700789225H2
gtttcttacaaggctctactctactgcttcaccttctgctctagaaaattcagtggtgatacatggcttcggctactctctctgtagccaaaccagcccttcaggcaaatgggaaaggcttctctgaattctctggctccgcagctcatcaggcttccttcccttttctagaaaatcttcagaggatttccattctgtcattgccttccagacctatgcagttggaagcagtggaggatacaagaagggtgtgacagaagcaaaactg

SEQ ID NO: 2588 - DNA, 269 bp, Glycine max
  Clone ID: 700548027H1
gtttcttacaaggctctactctactgcttcaccttctgctctagaaaattcagtggtgatacatggcttcggctactctctctgtagccaaaccagcccttcaggcaaatgggaaaggcttctctgaattctctggctccgcagctcatcaggcttccttcccttttctagaaaatcttcagaggatttccattctgtcattgccttccagacctatgcagttggaagcagtggaggtcaagaagggtgtgacagaagcaaaactgaag

SEQ ID NO: 2589 - DNA, 261 bp, Glycine max
  Clone ID: 701070385H1
ctctactgcttcaccttctgctctagaaaattcagtggtgatacatggcttcggctactctctctgtagccaaaccagcccttcaggcaaatgggaaaggcttctctgaattctctggcctccgcagctatcaggcttccttcccttttctagaaaatcttcagaggatttccattctgtcattgccttccagacctatgcagtcgcaagcagtggaggatacaagaacggtgtgacagaagcaaaactgaaggttgccat

SEQ ID NO: 2590 - DNA, 260 bp, Glycine max
  Clone ID: 700681469H2
gtttcttacaaggctctactctactgcttcaccttctgctctagaaaattcagtggtgatacatggcttcggctactctctctgtagcctaaccagcccttcaggcaaatgggcaaggcttctctgaattcctggcctccgcagctcatcaggcttccttcccttttctagaaaatcttcagaggatttccattctgtcattgccttccagacctatgcagttggaagcagtggaggatacaagaagggtgtgacagaag

SEQ ID NO: 2591 - DNA, 270 bp, Glycine max
  Clone ID: 700548037H1
gcttcggctactctctctgtagccaaaccagcccttcaggcaaatgggaaaggcttctctgaattctctggcctccgaagctcatcaggcttccttcccttttctagaaaatcttcagaggatttccattctgtcatgccttccagacctatgcagttggaagcagtggaggatacaagaagggtgtgacagaagcaaaactgaaggttgccataaacgggtttggaaggattggaagacttcttgaggtgctggcaggtcgcaaagact

SEQ ID NO: 2592 - DNA, 274 bp, Glycine max
  Clone ID: 700646084H1
cgttgactcctcgttgacatggtcatgggagatgacatggtgaaggtcattgcttggtatgacaatgaatggggctactcccaaagggttgtggatttggctgacattgttgccaacaaatggaagtgagagccaaacaaattctcattggtaattaaattattatgtatgtaccatgccattgtaattttgtatgcttactactactactaccactacaacacttgttgcttcatttttcttttaaacttgtactgagaaacagaaccatcaa

SEQ ID NO: 2593 - DNA, 234 bp, Glycine max
  Clone ID: 700752275H1
ctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagg

SEQ ID NO: 2594 - DNA, 232 bp, Glycine max
  Clone ID: 700683806H1
ctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaag

SEQ ID NO: 2595 - DNA, 271 bp, Glycine max
  unsure (1)...(271): unsure at all n locations
  Clone ID: 700654909H1
gtgaatgcagcattcagaganagtgcanncaatganctcaagggaatccncttctgtgtgtnatgagccacttgtntccgttgactncaggtganctnangtgtcctcaaccgttgactcctcgttnaccatggtcatgggagatgacatggtnaaggtcattgcttggtatgacaatgaatggggctactcccaaagggttntggatttggctnanattgtngccaacaaatggaagtnagagccaaacaaattctcattggtaattaaa

SEQ ID NO: 2596 - DNA, 267 bp, Glycine max
  unsure (1)...(267): unsure at all n locations
  Clone ID: 700986823H1
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggntttccattctgtcattgccttcnaganctnngcagtnggaagcantggnggntacaanaagggtntnacagaagcanacc

SEQ ID NO: 2597 - DNA, 259 bp, Glycine max
  Clone ID: 700741156H1
ctagtttcctacaaagctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaacggtgtgac

SEQ ID NO: 2598 - DNA, 246 bp, Glycine max
  Clone ID: 700906879H1
tacaaggctctactctactgcttcaccttctgctctagaaaattcagtggtgatacatggcttcggctactctctctgtagccaaaccagcccttcaggcaaatgggaaaggcttctctgaatctctggcctccgcagctcatcaggcttccttcccttttctagaaaatcttcagaggatttccattctgtcattgccttccagacctatgcagtctaaagcagtggaggatacaagaagggtgt

SEQ ID NO: 2599 - DNA, 169 bp, Glycine max
  Clone ID: 700875004H1
cataaacggatttggaaggattggaaggaacttcttgaggtgctggcacggtcgcaaagactcccctcttgatgtcattgccatcaacgacaccggtggcgtgaaacaagcctctcaccttctcaagtacgattcgatcctcggaaccttcgatgctgatgtcaagcct

SEQ ID NO: 2600 - DNA, 281 bp, Glycine max
  unsure (1)...(281): unsure at all n locations
  Clone ID: 700996131H1
gtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttgncaagcagtggaggatacaagaagggtgtgacagaagcaaaactgaaggttgccat

SEQ ID NO: 2601 - DNA, 232 bp, Glycine max
  Clone ID: 700873575H1
ctgcttcaccgtctgctctagaaaattcggtgctgaaacatgacttcggctactctctctgtagccaaaccagcccttcaggcaaatgggaaaggcttctctgaattctctggcctccgaagcgcatcaggcttccttcccttttactagaaaatcttcagaggatttccattctgtcattgccttccagacctatgcagttggaagcagtggaggatacaagaagggtgtg

SEQ ID NO: 2602 - DNA, 230 bp, Glycine max
  unsure (1)...(230): unsure at all n locations
  Clone ID: 700990142H1
gtttcttanaagcctctactatactgccttcaccttctgacctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttgncna

SEQ ID NO: 2603 - DNA, 227 bp, Glycine max
  unsure (1)...(227): unsure at all n locations
  Clone ID: 700981885H1
ggtgcactgatgtgtcctcaaccgttgactcatcgttgaccatggtcatgggagatgacatggttaaggtgattgcttggtatgacaatgagtggggctantcccaaagggttgtgganttggctgacattgttgccaacaannggaagtgagagccatcaaattctgaattggtanttcaattnttatatgtatgtaccatgccattgtagttttgtntgcttata

SEQ ID NO: 2604 - DNA, 248 bp, Glycine max
  Clone ID: 700874783H1
caagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagtttcgagcagtggaggatacaagaagggtgtgac

SEQ ID NO: 2605 - DNA, 259 bp, Glycine max
  Clone ID: 701110202H1
tttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttccctcttctagaaaatcatcagaggctttccattctgtcattgacttccagacatatgcagttggaagcagtcgcggatacaagcagggtgtgacagaa

SEQ ID NO: 2606 - DNA, 230 bp, Glycine max
  Clone ID: 700683388H1
ctagtttcttacaagcctctactatactgcttcaccttctgctctagaaaattcagtgctgaaacatggcttcggctactctctctatagccaaaccagcccttcaggcaaatgggaaaggcttctctgaattctctagcctccgaagctcatcaggcttccttcccttttctagaaaatcttcagaggatttccattctgtcattgccttccagacctatgcagttgga

SEQ ID NO: 2607 - DNA, 253 bp, Glycine max
  Clone ID: 700875643H1
ctgcttcaccttctgctctagataattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttgtaagcagtggaggatacaagaagggtgtgacagaagcaaaactgaaggttg

SEQ ID NO: 2608 - DNA, 278 bp, Glycine max
  unsure (1)...(278): unsure at all n locations
  Clone ID: 701001467H1
ctgcttcaccttctgctctagaaaattcagtgctgaaacatngcttcggctactctctctgtagccaaaccagcccttcaggcaaatgggaaaggcttctctgaattctctggcctccgaagctcatcaggcttccttccttttctagaaaatcttcagaggatttccattctgtcattgccttccagacctatgcagttggcaagcagtggaggatacaagaagggtgtgacagaagcaaaactgaaggttgccataaacgggtttggaaggattgg

SEQ ID NO: 2609 - DNA, 263 bp, Glycine max
  Clone ID: 700787152H2
ctagtttcttacaagcctctactatactgcttcaccttctgctctagaatattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagtcggaagcagtggaggatactagaagggtgtgacagaa

SEQ ID NO: 2610 - DNA, 257 bp, Glycine max
  Clone ID: 700683930H1
ctagtttcttacaaggctctactctactgcttcaccttctgctctagaaaattcagtggtgatacatggcttctggtactctctctgtagccaaaccagcccttcaggcaaatgggaaaggcttctctgaattctctggctccgcagctcatcaggcttccttcccttttctagaaaatcttcagaggatttccattctgtcattgccttccagacctatgcagtcgtaatcagtggaggccaagaaagggtgtgac

SEQ ID NO: 2611 - DNA, 236 bp, Glycine max
  Clone ID: 700740930H1
gtttcttacaagcctctactatactgcttcaccttctgctctagaaaattcagtgctgaaacatggcttcggctactctctctgtagccaaaccagcccttcaggcaaatgggaaaggcttctctgaattctctggcctcgaagctcatcaggcttccttcccttttctagaaaatcttcagaggatttccattctgtcattgccttccaaacctatgcagttggaagcagtggag

SEQ ID NO: 2612 - DNA, 266 bp, Glycine max
  Clone ID: 700787113H2
ctagtttcttacaaggctctactctactgcttcaccttctgctctagaaaattcagtggtgatacatggcttcggctactctctctgtagccaaaccagcccttcaggcaaatcggaaacgcttctctgaattctctggcctccgcagctcatcaggcttcactcccttttctagaaatcatacaaggatttccattctgtcattgccttccagacctatgcagttggaagcagtggaggatacaagaagggtgtgacagaagcaa

SEQ ID NO: 2613 - DNA, 223 bp, Glycine max
  Clone ID: 700739178H1
ttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttg

SEQ ID NO: 2614 - DNA, 268 bp, Glycine max
  unsure (1)...(268): unsure at all n locations
  Clone ID: 700986609H1
ttcttacaaggctctactctactgcttcaccttctgctctagaaaattcagtggtgatacatggctttcgggtaantctctctgtagccaaaccagcccttcaggcaaatgggaaaggcttctctgaattctctggcctccgcagctcatcaggcttccttcccttttctagaaaatcttcagaggatttccattctgtcattgccttccagaccncatgcagttggaagcagtggaggatacaagaagggtgtgacagaagcaaaac

SEQ ID NO: 2615 - DNA, 265 bp, Glycine max
  Clone ID: 700683409H1
ctcaaccgttgactcctcgttgaccatggtcatgggagatgaaatggtgaaggtcattgcttggtatgacaatgaatggggctactcccaaagggttgtggatttggctgacattgttgccaacaaatggaagtgagagccaaacaaattctcattggtaattaaattattatgtatgtaccatgccattgtaattttgtatgcttactactactactaccactacaacacttgttgcttcatttttcttttaaacttgtactga

SEQ ID NO: 2616 - DNA, 198 bp, Glycine max
  Clone ID: 700743479H1
ttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttg

SEQ ID NO: 2617 - DNA, 255 bp, Glycine max
  Clone ID: 700681635H1
caagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagagaatcttcagaggatttccattctgtcattgccttccagacctatgcagtatgaaggagtggaggatacaagaagggtgtacagaagcaa

SEQ ID NO: 2618 - DNA, 261 bp, Glycine max
  Clone ID: 701109104H1
actgatgtgtcctcaaccgacacacgccgctcatcacacacagtgaggattcccttgtactcccaaccctcaaaggcaaactcaatggcatacgcactccgtgtgccaacaccgaacgtctcagtggtggacctcgtcgttcaggtctcacagaagacctttgcagacgaagtgaatgcagcattcagagagagtgcagacaatgagctcaagggaatcctctctgtgtgtgatgagccacttgtgtgcgttgacttcagg

SEQ ID NO: 2619 - DNA, 215 bp, Glycine max
  Clone ID: 700871765H1
ctctagaaaattcagtgctgtaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgaaaaaacaaacagtggaggatacaagaagggtgt

SEQ ID NO: 2620 - DNA, 268 bp, Glycine max
  unsure (1)...(268): unsure at all n locations
  Clone ID: 700992456H1
ctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttcttcccttttctagaaaatcttcagaggatttccattcggtcatcgccttccaagaccnaangcaattngccaagcantggagggttcnaaaanggntngnnaannanncaacntctgggngtc

SEQ ID NO: 2621 - DNA, 290 bp, Glycine max
  unsure (1)...(290): unsure at all n locations
  Clone ID: 700554130H1
gcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcatgcctccagacctatgcagttgncaagcagtggaggatacaagaaggtgtggacagaagcaaaactgaaggttgccataaagggnttggaaggattggaangaattcttgagtg

SEQ ID NO: 2622 - DNA, 185 bp, Glycine max
  Clone ID: 700742575H1
ctctactctactgcttcaccttctgctctagaaaattcagtggtgatacatggcttcggctactctctctgtagccaaaccagcccttcaggcaaatgggaaaggcttctctgaattctctggcctccgcagctcatcaggctttcttcccttttctagaaaatcttcagaggatttccattctg

SEQ ID NO: 2623 - DNA, 137 bp, Glycine max
  Clone ID: 700875165H1
gaccaccactcactcctacaccggtgaccaaaggcttcttgatgcgagccaccgtgacctgaggcgtgcaagggcagcagcactcaacattgtccccacttcaacaggagcagcaaaggcagtggcccttgtcctcc

SEQ ID NO: 2624 - DNA, 264 bp, Glycine max
  Clone ID: 700686144H1
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagaaccgatcagtggaggatacaagaagggtgtgacagaagcaa

SEQ ID NO: 2625 - DNA, 276 bp, Glycine max
  unsure (1)...(276): unsure at all n locations
  Clone ID: 700990232H1
gtntcttncaaggcntctactcnantgnttcacgcttctgctctagaaaattcagtnggtgatacatggcttcggctactctctctgtagccaaaccagcccttcaggcaaatgggaaaggcntctctgaattctctggcctccgcagctcatcaggcttccttcccttttctagaaaatcttcagaggatttccattctgtcattgcctncccagacctatnnagnnactaancantggaggatncaanaagggtgtgacanangcaaaactgag

SEQ ID NO: 2626 - DNA, 247 bp, Glycine max
  unsure (1)...(247): unsure at all n locations
  Clone ID: 700657137H1
gtnctccnannnctacaagggcaanctcnatggcattgcantcccgtgtgccaacaccaaacgtctcagtggnggacctcgttgttcaggtctcaaagaagacctttgcagaagaagtgaatgcagcattcagagagagtgcagacaatgagctccagggaatcctctctgtgtgtgatgagccacttgtgtctgttgncttcaggnggcactgatgtgtnctcaaccgttgantcatcgttgacca

SEQ ID NO: 2627 - DNA, 263 bp, Glycine max
  Clone ID: 700731288H1
ctctactctactgcttcaccttctgctctagaaaattcagtggtgatacatggcttcggctactctctctgtagccaaaccagcccttcaggcaaatgggaaaggcttctctgaattctctggcttcggagattcattaaggtttcttccccttttctagaaaatcttcagaggatttccatactgtcattgccttccagacctatgcagttgtaagcagtggaggatacaagaagggtgtgacagaagcaaaactgaaggtt

SEQ ID NO: 2628 - DNA, 262 bp, Glycine max
  Clone ID: 700741126H1
tactgcttcaccttctgctctagaaaattcagtgctgaaacatggcttcggctactctctctgtagccaaaccagcccttcaggttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagctctcacttctca

SEQ ID NO: 2629 - DNA, 272 bp, Glycine max
  unsure (1)...(272): unsure at all n locations
  Clone ID: 700975280H1
gtttcttacaagcctctactatactgcttcaccttctgctctagaaaattcagtgctgaaacatggctcggctactctctctgtagccaaaccagcccttcaggcaaatgggaaaggcttctctgaattctctggcctccgaagctcatcaggcttccttcccttttctagaaaatcttcagaggatttccattctgtcattgcttccagacttanncagttnncaaccattggnggatnnaaaaggtntnaagangnaaattgaggtttgc

SEQ ID NO: 2630 - DNA, 261 bp, Glycine max
  Clone ID: 700788092H1
ctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacag

SEQ ID NO: 2631 - DNA, 254 bp, Glycine max
  Clone ID: 700683952H1
gattacagccctgatgaacctatcatcctcaatgcatcctgcaccactaactgccttgcaccctttgtcaaggtccttgatcagaaattcggtatcatcaagggtaccatgaccaccactcactcctacaccggcgacaaaggcttctcgacgcgagccaccgtgacctgaggcgcgccagggcggcagctctcaacattgtccccacttcaacaggagcagcaaaggcagtggcccttgtcctcccaaccctc

SEQ ID NO: 2632 - DNA, 204 bp, Glycine max
  Clone ID: 700992834H1
gtttcttacaagcctctactatactgcttcaccttctgctctagaaaataccagtgtgaaacatggcttcggctactctctctgtagccaaaccagcccttcaggcaaatgggaaaggcttctctgaattctctggcctccgaagctcataggcttccttcccttttctagaaaatcttcagaggatttccattctgtcattgc

SEQ ID NO: 2633 - DNA, 273 bp, Glycine max
  unsure (1)...(273): unsure at all n locations
  Clone ID: 700991505H1
ctagtttcttacaagcctctactatactgcttcaccttctgctctagaaaattcagtgctgaaacatgggcttcggctactctctctgncagccaaaccagcccttcaggcaaatgggaaaggcttctctgaattctctggcctccgaagctcatcaggcttccttcccttttctagaaaatcttcagnggntttccattctgtcatngccttccagactntgcagttgncaagcagnggannanaaanggggggtgnnaaaganccaatgnt

SEQ ID NO: 2634 - DNA, 253 bp, Glycine max
  Clone ID: 701110056H1
tgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttgaaagcagtggaggatacaagaagggtgtgacagaagcaaaactgaaggttgc

SEQ ID NO: 2635 - DNA, 264 bp, Glycine max
  Clone ID: 700679803H1
cggctcgagcaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctggtcattgccttcaagacctatgcagttggaagcagtggatgatacaagaagggtgtgcagaagca

SEQ ID NO: 2636 - DNA, 182 bp, Glycine max
  Clone ID: 700686648H1
gtttcttacaagcctctactatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttca

SEQ ID NO: 2637 - DNA, 288 bp, Glycine max
  unsure (1)...(288): unsure at all n locations
  Clone ID: 701000893H1
gtttcttacaagcctctactatactgctttcaccttctgctctagaanattcagtgctgaaacatggcntcggctactctctctgtagccaaaccagccttcaggcaaatgggaaaggcttctctgaattctctgggcctccgaagctcatcaggcttcccttcccttttctagaaaatcttcagaggatttccattctgtcattgccttccagacctatgcagttgncaagcagtggaggatacaagaagggtgtgacagaagcaaaatgaaggttgccataaacgg

SEQ ID NO: 2638 - DNA, 255 bp, Glycine max
  Clone ID: 700729743H1
gtttcttgcaagcctctactatactgcttcaccttctgctctagaaaattcagtgctgaaacatggcttcggctactctctctgtagccaaaccaaggcttcaggcaaatgggaaaggcttctctgaattctctggcctccgtagctcatcaggcttccttcccttttctagaaaatcctcagaggatttccattctgtcattgctctacagacctatgcagttggaagcagtggaggatgcaagaagggtgtga

SEQ ID NO: 2639 - DNA, 182 bp, Glycine max
  unsure (1)...(182): unsure at all n locations
  Clone ID: 700656983H1
gttnngcncnanaaaattcagtggtgatacatggnntcggcnactctctctgtagccaaaccagcccttccaggcaaatgggaaaggcttctctgaattctctggcctccgagctacatcaggcttccttcccttttctaganaatcttcagaggatttccattctgtcattgccttccaga

SEQ ID NO: 2640 - DNA, 200 bp, Glycine max
  Clone ID: 700742961H1
ctgtcattgccttccagacctatgcagttggaagcagtggaggatacaagaagggtgtgacagaagcaaaactgaaggttgccataaacgggtttggaaggattggaaggaacttcttgaggtgctggcacggtcgcaaagactcacctcttgatgtcattgccatcaacgacaccggcggcgtgaaacaagcctctcac

SEQ ID NO: 2641 - DNA, 268 bp, Glycine max
  unsure (1)...(268): unsure at all n locations
  Clone ID: 700995207H1
ctagtttcttacaagcctctactatactgcttcaccttctgctctagaaaattcagtgctgnaacatggcttcggctactctcctcctgtagccaaaccagcccttcaggcaaatgggaaaggcttctctgaattctctggcctccgaagctcatcaggcttccttccctttctagaaaatctgcagaggntttccattccggtcattggccttccagaaccnatgcagttggaagcagtggaggatacaagnagggtgnacanacgc

SEQ ID NO: 2642 - DNA, 202 bp, Glycine max
  Clone ID: 700960745H1
caaggctctactctactgcttcacattctgctctagaaaattcagtggtgacacacagcttcggctactctctctgtagccaaaccagcccttcaggcaaatgggaaaggcttctctgaattctctggcctctgcagctcatcaggcttccttcccttttctagaaaatcttaagaggatttccactctgccattgccttcc

SEQ ID NO: 2643 - DNA, 237 bp, Glycine max
  Clone ID: 700873668H1
cgaaccactcaggcttccttcccttttctggagaatcttcagaggatttccattctgtcattgccttccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtgcattgccatcaacgacaccggcggc

SEQ ID NO: 2644 - DNA, 124 bp, Glycine max
  unsure (1)...(124): unsure at all n locations
  Clone ID: 700991519H1
gactacagccctgatgaacccatcatcagcaatgcctcttgcaccactaactgccttgcaccctttgtcaaggtccttgatcagaaattcggtatcatnaagggtaccatggcnccactcactc

SEQ ID NO: 2645 - DNA, 169 bp, Glycine max
  Clone ID: 700743185H1
cttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttccctttttctag

SEQ ID NO: 2646 - DNA, 224 bp, Glycine max
  unsure (1)...(224): unsure at all n locations
  Clone ID: 700554408H1
ggctgacattgttgccaacaaatggaagtgagagccaaacaaattctcattggtaattaaattattatgtatgtaccatgccattgtaattttgtatgctnnnnnnnnnnnnnnnccactacaacacttgttgcttcatttttcttttaaactttactgagaaacagaaccatcaattttctctgccttctcattgtgcaataaaattcttaccttgaaatctg

SEQ ID NO: 2647 - DNA, 222 bp, Glycine max
  Clone ID: 700686096H1
caatgagtggggctactcccaaagggttgtggatttggctgacattgttgccaacaagtggaagtgagagccatcaaattctgaattggtaattcaattattatatgtatgtaccatgccattgtagttttgtatgcttactactactactactaccactacaaacacttgttgcttcatttttcattctaaaacttgtactgagaaacagaaccatcaatt

SEQ ID NO: 2648 - DNA, 134 bp, Glycine max
  Clone ID: 700739363H1
ctgcttcaccttctgctctagaaaattcagtgctgaaacatggcttcggctactctctctgtagccaaaccagcccttcaggcaaatgggaaaggcttctctgaattctctggcctccgaagctcatcaggctt

SEQ ID NO: 2649 - DNA, 264 bp, Glycine max
  unsure (1)...(264): unsure at all n locations
  Clone ID: 700996585H1
ctagtntcttacaagcctctactatactgcttcnccttctgctctagaaaattcagtgctgnaacatggnttcggctactctctctgtagccaaaccagcccttcaggcaaatgggaaaggcttctctgaattctctggcctccgaagctcatcaggcttccttccctttctaganaatcttcagaggatttccttctgtccatgccttcccaganntctgnnnaccnaancagtggaggntacaanannggtgtgacagaanc

SEQ ID NO: 2650 - DNA, 270 bp, Glycine max
  unsure (1)...(270): unsure at all n locations
  Clone ID: 700991823H1
ctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatccaggcttccttcccttttctagaaaatntnanggggnttccaatcnggnaatgcctcnaaaccttngntttggaanntggggggaaaaaaagggntgaaaaannaaatntggntnc

SEQ ID NO: 2651 - DNA, 268 bp, Glycine max
  unsure (1)...(268): unsure at all n locations
  Clone ID: 701000661H1
cttttctagaaaatcttcagaggatttccattctgtcattgccttccagacctatgcagttnagcagcagtggaggatacaagaagggtgtgacagaagcaaaactgaaggttnccataaacggatttggaaggattggaaggaattcttgaggtgctggcacggtcgaaaagacncccctctngatgtcatngccatnaacgacagcggggaganaaacaagnctnntcacnnncnnangnacgattncganccncnnncntnggtg

SEQ ID NO: 2652 - DNA, 155 bp, Glycine max
  Clone ID: 700606165H2
caagcctctactatactgcttcaacttctgctctagaaaattcagtgctgaaacatggcttcggctactctctctgtagccaaaccagcccttcaggcaaatgggaaaggcttctctgaattctctggcctccgaagctcataggcttccttccc

SEQ ID NO: 2653 - DNA, 273 bp, Glycine max
  unsure (1)...(273): unsure at all n locations
  Clone ID: 700999082H1
caaggntctactctactgcttcaccttctgctctagaaaattcagtggtgatacatggcttcggntactnctctctgtagccaaaccagcccttcaggcaaatgggaaaggcttcctgaattctctggcctccgcagctcatcaggcttccttcccttttctagaaaatcttcagaggatttccattctgtcattgccttccagacctatgcagttgncnaccagtggaggatacaagaagggtgtgacgaagcaaaatggaagttgccataa

SEQ ID NO: 2654 - DNA, 129 bp, Glycine max
  Clone ID: 700738051H1
gcttcaccttctgctctagaaaattcagtggtgatacatggcttcggctactctctctgtagccaaaccagcccttcaggcaaatgggaaaggcttctctgaattctctggcctccgcagctcatcagg

SEQ ID NO: 2655 - DNA, 143 bp, Glycine max
  Clone ID: 700740881H1
ctagtttcttacaagcctctactatactgcttcaccttctgctctagaaaattcagtgctgaaacatggcttcggctactctctctgtagccaaaccagcccttcaggcaaatgggaaaggcttctctgaattctctggcctc

SEQ ID NO: 2656 - DNA, 249 bp, Glycine max
  unsure (1)...(249): unsure at all n locations
  Clone ID: 700987548H1
ctagtttcttacaagcctctactancnctgcttcaccttctgctctagaaaattcagtgctgcaacatggcttcggctactctctctgtagccaaaccagcccttcaggcaaatgggaaaggcttctctgaattctctggctccgaagctcatcaggcttcttcccttttctagaaatcttcgagggnttccattcggnnatngccttcaancctntgnattgggaacnnngngntaaaaaanggggtt

SEQ ID NO: 2657 - DNA, 115 bp, Glycine max
  Clone ID: 700739359H1
ctgcttcaccttctgctctagaaaattcagtgctgaaacatggcttcggctactctctctgtagccaaaccagcccttcaggcaaatgggaaaggcttctctgaattctctggcc

SEQ ID NO: 2658 - DNA, 133 bp, Glycine max
  unsure (1)...(133): unsure at all n locations
  Clone ID: 700979451H1
gcttcaccttctgctctagaaaattcagtgctgaaacatncgcttcggctactctctctgtagccaaaccagcccttcaggcaaatgggaaaggcttctctgaattctctggcctccgaagcncatcaggctt

SEQ ID NO: 2659 - DNA, 277 bp, Glycine max
  unsure (1)...(277): unsure at all n locations
  Clone ID: 700991851H1
ctagtttcttacaaggntctactctactgcttcaccttntgntctagaaaattcagtggtgatacatggcttcngctactctcnctgtagcnaaaccancccttcaggcaaatgggaaaggcttctctgaattctntggcctccgcaggtcatcangctccttnccttntcnagnaaatcttcanaggatttccagtctgtcattgccttcgatanctaggncagttncgaccantggagtaganaggaggggtttgacagngngaanncnggggnt

SEQ ID NO: 2660 - DNA, 300 bp, Glycine max
  unsure (1)...(300): unsure at all n locations
  Clone ID: 700989348H1
tgctctagaaaattcagtgctgaaacatggcttcgggctactctctctgtagccaaaccagcccttcaggcaaatgggaaaggcttctctgaattctctgggcctccgaagcttcatcaggcttccttnccnnntctagaaaatctcagaggatttccattcngtnatggctttccagaacnaaggngnttntnagcnattggaaggatacaggaagggtgttgacagaagcaaaactgaaggtgnccttaancgggttggaagnntggaaggaattctnaggtgntggcaggtcgccaa

SEQ ID NO: 2661 - DNA, 267 bp, Glycine max
  unsure (1)...(267): unsure at all n locations
  Clone ID: 700558380H1
ctagtttcttacaaggctctactctactgcttcaccttctgctcnagaaaattcagtggtgatacatggcttcggctactctctctgtagccaaaccagcccttcaggcaaatgggaaaggctctctgaattctctggcctccgcagctcatcaggcttcttccctttctagaaaatcttcagaggatttccatctgtcattgccttccagactatgcattggaagcatggaggatacaanaagggtgtgacgaggcaaactgangt

SEQ ID NO: 2662 - DNA, 126 bp, Glycine max
  Clone ID: 700738070H1
gtttcttacaagcctctactatactgcttcacctaactgctctagaagattcagtgctgaaacatggcttcggctactctctctgtagccataccagcccttcaggcaaatgggaaaggcttctct

SEQ ID NO: 2663 - DNA, 246 bp, Glycine max
  unsure (1)...(246): unsure at all n locations
  Clone ID: 700992942H1
gtttcttanaagggctctactntactgcttcacnttctgctctagaaaattcagtggtgatacatggcntccggctactgctctctgtagccaaaccagcccttcaggcaaatgggaaaggcttctctgaattctnctggcctgccgcagtnatcaggnnnccntagctttnntagaaaatncttcagaggatttncantcngnattgcctncnanactnngcnnnaagcancannggaggnaaca

SEQ ID NO: 2664 - DNA, 110 bp, Glycine max
  Clone ID: 700986029H1
agcatacaacacttgttgcttcatttttcttttaaacttgtactgagaaacagaaccatcaattttctctgccttctcattgtgcaataaaattcttaccttgaaatctg

SEQ ID NO: 2665 - DNA, 177 bp, Glycine max
  Clone ID: 700743737H1
caaggctctactctactgcttcaccttctgctctagaaaattcagtggtgatacatggctacgtctactctctctgtagccaaaccagcccttcaggcaaatgggacaggcttctctgaattctctgggctccgcagctcatcaggcttcttcgcttttctcaaaaatcttcagagg

SEQ ID NO: 2666 - DNA, 341 bp, Glycine max
  Clone ID: 700680701H1
gccaaagggtggtggatttggcacacctagtagcaagcaagtggccaggggcagctaaagcagggagtggagacccattggaggaattctgcgagacaaaccctgctgatgaggaatgcaaagtatatgaatagaggagagcgcctttttatgatttgatgattaccattaccagcagcaaaccatttttactctttgccttgtgttaacgtatcatgtgaaaaagaaggaaattgttcgttcagacggtgtctgaggagagattttcaaagtttaacattatctgcagccaataataaattttggcgtgactgaaattcatgaatatcgcccatatatta

SEQ ID NO: 2667 - DNA, 251 bp, Glycine max
  Clone ID: 700874711H1
gatttggcacacctagtagcaagcaagtggccaggggcagctaaagcagggagtggagacccattggaggaattctgcgagacaaaccctgctgatgaggaatgcaaagtatatgaatagaggagagcgcctttttctgatttgatgattaccattaccagcagcaaaccatttttactctttgccttgtgttaacgtatcatgtgaaaaagaaggaaattgttcgttcagacggtgtctgaggagagatt

SEQ ID NO: 2668 - DNA, 278 bp, Glycine max
  Clone ID: 701051645H1
attttgatgtgaaggtgaaggactctaagacccttctctttggtgagaagcccgtcaccgtttttggaatcaggaaccctgaggaaattccatggggtgaggttggtgctgattatgttgttgagtcaactggtgtattcactgacaaggacaaggctgctgctcacttgaagggtggtgccaagaaggttgtcatctctgccccaagcaaagatgcacccatgtttgttgttggtgttaacgagaaggagtacaagccagagcttgacattgtttcc

SEQ ID NO: 2669 - DNA, 289 bp, Glycine max
  Clone ID: 700563915H1
cgtttttggaatcaggaaccctgaggaaattccatggggtgaggttggtgctgattatgttgttgagtcaactggtgtattcactgacaaggacaaggctgctgctcacttgaagggtggtgccaagaaggttgtcatctctgccccaagcaaagatgcacccatgtttgttgttggtgttaacgagaaggagtacaagccagagcttgacattgtttccaatgctagctgcactaccaattgtcttgctcccctcgccaaggttatcaacgacgatttggaattgtgg

SEQ ID NO: 2670 - DNA, 255 bp, Glycine max
  Clone ID: 701204320H2
ttttggaatcaggaaccctgaggaaattccatggggtgaggttggtgctgattatgttgttgagtcaactggtgtattcactgacaaggacaaggctgctgctcacttgaagggtggtgccaagaaggttgtcatctctgccccaagcaaagatgcacccatgtttgttgttggtgttaacgagaaggagtacaagccagagcttgacattgtttccaatgctagctgcactaccaattgtcttgctcccctcgc

SEQ ID NO: 2671 - DNA, 344 bp, Glycine max
  Clone ID: 700652968H1
taacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaagcccgtcaccgtttttggaatcaggaaccctgaggaaattccatggggtgaggttggtgctgattatgt

SEQ ID NO: 2672 - DNA, 251 bp, Glycine max
  Clone ID: 700748683H1
ctggtgtattcactgacaaggacaaggctgctgctcacttgaagggtggtgccaagaaggttgtcatctctgccccaagcaaagatgcacccatgtttgttgttggtgttaacgagaaggagtacaagccagagcttgacattgtttccaatgctagctgcactaccaattgtcttgctcccctcgccaaggttatcaacgaccgatttggaattgtggagggtcttatgaccactgttcatgccatcaca

SEQ ID NO: 2673 - DNA, 273 bp, Glycine max
  unsure (1)...(273): unsure at all n locations
  Clone ID: 700981771H1
ggactctaagacccttctctttggtgagaagcccgtcaccgtttttggaatcaggaaccctgaggaaattccatggggtgaggttggtgctgattatgttgttgagtcaactggtgtatncactgacaaaggacaaggctgctgctcacttgaagggtggtgccaaganggttgtcatctctgccccaagcaaagatgcacccatgtttgttgttggtgttaacgagaaggagtacaagccagagcttgacattgttccaatgctagtgcact

SEQ ID NO: 2674 - DNA, 312 bp, Glycine max
  unsure (1)...(312): unsure at all n locations
  Clone ID: 700605826H2
tgaacatgtatgtcatgtaatcagtggtgatgaaaggntcgttgacagcaacaagttcaagtacgacaccgttcatggccagtggaagcattttgatgtgaaggtgaaggactctaagacccttctctttggtgagaagcccgtcaccgtttttggaatcaggaccctgaggaaattccatggggtgaggttggtgctgattatgttgttgagtcaactggtgtattcactgacaaggacaaggctgctgctcacttgaagggtggtgccaagaaggttgtcatctctgccccaagcaaagatgcaccatgt

SEQ ID NO: 2675 - DNA, 246 bp, Glycine max
  Clone ID: 700666839H1
aaggactctaagacccttctctttggtgagaagcccgtcaccgtttttggtcaggaaccctgaggaaattccatggggtgaggttggtgctgattatgttgttgagtcaactggtgtattcactgacaaggacaaggctgctgctcacttgaagggtggtgccaagaaggttgtcatctctgccccaagcaaagatgcacccatgtttgttgttggtgttaacgagaaggagtacaagccagagct

SEQ ID NO: 2676 - DNA, 259 bp, Glycine max
  Clone ID: 700944037H1
gggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtgagaagcccgtcaccgtttttggattcaggaaccctgaggaaattccatggggtgaggttggtgctgattatgttgttgagtcaactggcgtattcactga

SEQ ID NO: 2677 - DNA, 242 bp, Glycine max
  Clone ID: 700969575H1
catcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtgagaagcccgtcaccgtttttggattcaggaaccctgaggaaattc

SEQ ID NO: 2678 - DNA, 283 bp, Glycine max
  Clone ID: 701118935H1
tttctatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtgagaagcccgtcaccgtttttgg

SEQ ID NO: 2679 - DNA, 267 bp, Glycine max
  Clone ID: 700725758H1
agattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaaccccgacaccgtttttggaatcaggacccctgaggaatttccatggggtgagg

SEQ ID NO: 2680 - DNA, 284 bp, Glycine max
  Clone ID: 701054027H1
tacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaagcccgtcaccgttt

SEQ ID NO: 2681 - DNA, 304 bp, Glycine max
  Clone ID: 700954591H1
tacactttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtgagaagcccgtcaccgttttggattca

SEQ ID NO: 2682 - DNA, 342 bp, Glycine max
  Clone ID: 700653724H1
cgctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaagccgtcaccgtttttggaatcaggaacctgaggaattcatgggtgaggttgtctgat

SEQ ID NO: 2683 - DNA, 276 bp, Glycine max
  Clone ID: 701052969H1
atttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaagcccgtcac

SEQ ID NO: 2684 - DNA, 260 bp, Glycine max
  Clone ID: 700836192H1
ttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggt

SEQ ID NO: 2685 - DNA, 277 bp, Glycine max
  Clone ID: 701014006H1
gctctctaattacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtga

SEQ ID NO: 2686 - DNA, 283 bp, Glycine max
  Clone ID: 700849014H1
gtattcgactcgagatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgag

SEQ ID NO: 2687 - DNA, 253 bp, Glycine max
  Clone ID: 700747177H1
catttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaaga

SEQ ID NO: 2688 - DNA, 271 bp, Glycine max
  Clone ID: 700733933H1
ctttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaa

SEQ ID NO: 2689 - DNA, 256 bp, Glycine max
  Clone ID: 701045883H1
cactttctatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagaccttctc

SEQ ID NO: 2690 - DNA, 282 bp, Glycine max
  unsure (1)...(282): unsure at all n locations
  Clone ID: 700561161H1
cgctctctaataacatttctaatctcattctccttctgttcaaacactctctctcatggnatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtga

SEQ ID NO: 2691 - DNA, 275 bp, Glycine max
  Clone ID: 701002757H2
ctctctaattacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtg

SEQ ID NO: 2692 - DNA, 254 bp, Glycine max
  Clone ID: 701150827H1
tacggctgcgagaagacgacagaagggggtgctgattatgttgttgagtcaactggcgtattcactgacaaggacaaggctgctgctcacttgaagggtggtgcaagaaggttgtcatctctgccccgagcacagatgcacctatgtttgttgttggtgttaacgagaaggagtacaagccagagcttgacattgtttctaatgctagctgcactaccaattgccttgctcccctcgccaaggttatcaacgac

SEQ ID NO: 2693 - DNA, 279 bp, Glycine max
  Clone ID: 701043855H1
cgctctctaattacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcatcactgattacatgacatacatgttcaagtacgacaccgttcatggccagtggaagcattttgatgtgaaggtgaaggactctaagacccttctctatggtgag

SEQ ID NO: 2694 - DNA, 260 bp, Glycine max
  Clone ID: 701138753H1
ggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcaatggaagcatttgatgtgaagctgaaggactctaagacccttctcttcggtgagaagcccgtcaccgttttt

SEQ ID NO: 2695 - DNA, 265 bp, Glycine max
  Clone ID: 700746913H1
gtaatctcattctccttctgttcaaacactgtctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgag

SEQ ID NO: 2696 - DNA, 265 bp, Glycine max
  Clone ID: 701004953H1
ctctaattacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttct

SEQ ID NO: 2697 - DNA, 267 bp, Glycine max
  Clone ID: 700900882H1
aacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttg

SEQ ID NO: 2698 - DNA, 270 bp, Glycine max
  Clone ID: 700987148H1
catttctaatctcattctccttctgttcaaacactctctctcatgggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagaccttctctttggtgag

SEQ ID NO: 2699 - DNA, 263 bp, Glycine max
  Clone ID: 701054872H1
tacattgctaatctcattctccttctgttcaaacactctcatggcatcagataagaagattaggatcggcatcaacggatttggaaagattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttg

SEQ ID NO: 2700 - DNA, 266 bp, Glycine max
  Clone ID: 701056763H1
cactttctatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtgag

SEQ ID NO: 2701 - DNA, 263 bp, Glycine max
  Clone ID: 700748607H1
ctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagac

SEQ ID NO: 2702 - DNA, 263 bp, Glycine max
  Clone ID: 700830473H1
cgctctctaattacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagac

SEQ ID NO: 2703 - DNA, 266 bp, Glycine max
  Clone ID: 700762033H1
cgctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcttttcatcaccactgattacatgacatacatgttcaagtacgacaccgttcatggccagtggaagcattttgatgtgaaggtgaaggactctaaga

SEQ ID NO: 2704 - DNA, 270 bp, Glycine max
  unsure (1)...(270): unsure at all n locations
  Clone ID: 700987949H1
ctctaattacactttctatctcatttccaatctcattttcgttcggttcaaacactctcatggcatcagacaagaagattangatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaaga

SEQ ID NO: 2705 - DNA, 248 bp, Glycine max
  Clone ID: 701135194H1
ctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagaccctt

SEQ ID NO: 2706 - DNA, 262 bp, Glycine max
  Clone ID: 700748676H1
atttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggcagcattttgatgtgaaggtgaaggactctaagacccttctctt

SEQ ID NO: 2707 - DNA, 266 bp, Glycine max
  Clone ID: 701046095H1
actttctatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtgaga

SEQ ID NO: 2708 - DNA, 274 bp, Glycine max
  Clone ID: 701045383H1
ctctaattacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggattctaagacccttctctttggtga

SEQ ID NO: 2709 - DNA, 244 bp, Glycine max
  Clone ID: 701052575H1
ctttctatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactcta

SEQ ID NO: 2710 - DNA, 255 bp, Glycine max
  unsure (1)...(255): unsure at all n locations
  Clone ID: 700667935H1
catttctantctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacc

SEQ ID NO: 2711 - DNA, 245 bp, Glycine max
  Clone ID: 701055287H1
gttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacccttctcttcggtg

SEQ ID NO: 2712 - DNA, 328 bp, Glycine max
  unsure (1)...(328): unsure at all n locations
  Clone ID: 700660946H1
aacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagaccttctcttggtgagaagcccgtcacgttttggaatcaggaacctgaggaaatccnggggtgagttgtgngtt

SEQ ID NO: 2713 - DNA, 252 bp, Glycine max
  Clone ID: 700891889H1
aacattctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaa

SEQ ID NO: 2714 - DNA, 259 bp, Glycine max
  Clone ID: 700670279H1
aattacactttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggac

SEQ ID NO: 2715 - DNA, 230 bp, Glycine max
  Clone ID: 700865105H1
aacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttc

SEQ ID NO: 2716 - DNA, 264 bp, Glycine max
  Clone ID: 700664974H1
ctctaattacactttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggact

SEQ ID NO: 2717 - DNA, 264 bp, Glycine max
  Clone ID: 700727084H1
ctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaaga

SEQ ID NO: 2718 - DNA, 271 bp, Glycine max
  Clone ID: 700748807H1
aacatttctaatctcattctccttctgttcaaacactctctctcatggcatcagataagaggattaggatcggcatcaactggtttggaacgattggccgtttggtggccagggttgcccttcaaaggaatgatgttgaacttgttgctgtcaacggtcctttcatcaccactgattacatgacatacatgttcaagtacgacaccgttcatggccagtggaagcattttgatgtgaaggtgaaggactctaagacgcttctctttggtga

SEQ ID NO: 2719 - DNA, 252 bp, Glycine max
  Clone ID: 700749971H1
tctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgagatacatgttcaagtacgacaccgttcatggccagtggaagcattttgatgtgaaggtgaagg

SEQ ID NO: 2720 - DNA, 261 bp, Glycine max
  unsure (1)...(261): unsure at all n locations
  Clone ID: 700664177H1
ctaattacactttctanctcanntccaatctcattttcgttcggnncaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaagact

SEQ ID NO: 2721 - DNA, 250 bp, Glycine max
  unsure (1)...(250): unsure at all n locations
  Clone ID: 700969206H1
ctctaattacactttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaancatttnnatgt

SEQ ID NO: 2722 - DNA, 260 bp, Glycine max
  Clone ID: 700668696H1
cacgctctaattacactttctatctcatttccaatctcattttcgttcggttcaaacactctcatgggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagc

SEQ ID NO: 2723 - DNA, 217 bp, Glycine max
  Clone ID: 700677777H1
aatgttttaaacgttgttacgttgattgttctggcagacatacatgttcaagtacgacaccgttcatgggcagtggaagcattttgatgtgaagctgaaggactctaagacccttctcttcggtgagaagcccgtcaccgtttttggattcaggaaccctgaggaaattccatggggtgaggttggtgctgatttgttgttgagtcaactggcgtat

SEQ ID NO: 2724 - DNA, 253 bp, Glycine max
  unsure (1)...(253): unsure at all n locations
  Clone ID: 700969506H1
cgctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacntgacatacatgttcaagtacgacaccgttcatggccagtggaagcattttgatgtgaaggtg

SEQ ID NO: 2725 - DNA, 251 bp, Glycine max
  unsure (1)...(251): unsure at all n locations
  Clone ID: 700667829H1
attacactttctatctcatttcgnaatctcattttcgtnacggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaag

SEQ ID NO: 2726 - DNA, 245 bp, Glycine max
  Clone ID: 700730321H1
cactttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaag

SEQ ID NO: 2727 - DNA, 246 bp, Glycine max
  Clone ID: 700972412H1
ctttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctg

SEQ ID NO: 2728 - DNA, 239 bp, Glycine max
  Clone ID: 701043160H1
ctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcatttt

SEQ ID NO: 2729 - DNA, 241 bp, Glycine max
  Clone ID: 700896562H1
cgctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcatttt

SEQ ID NO: 2730 - DNA, 234 bp, Glycine max
  Clone ID: 700678284H1
tttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaa

SEQ ID NO: 2731 - DNA, 248 bp, Glycine max
  Clone ID: 700674379H1
cgctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtga

SEQ ID NO: 2732 - DNA, 248 bp, Glycine max
  Clone ID: 700973321H1
cacgctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgt

SEQ ID NO: 2733 - DNA, 248 bp, Glycine max
  Clone ID: 700848568H1
actttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctga

SEQ ID NO: 2734 - DNA, 254 bp, Glycine max
  Clone ID: 700973272H1
ttacactttctatctcatttccaatctcattttcgttcggttcaaacactctcatggcatcagacaagaagattaggatcggcatcaacggatttggaaggattggccgtttggtggccagggttctcttcagaggaatgacgttgaacttgttgctgtcaacgatcctttcatcaccactgattacatgacatacatgttcaagtacgacaccgttcatgggcagtggaagcattttgatgtgaagctgaagg

SEQ ID NO: 2735 - DNA, 248 bp, Glycine max; identical to SEQ ID NO: 2731
  Clone ID: 700735988H1

SEQ ID NO: 2736 - DNA, 260 bp, Glycine max
  unsure (1)...(260): unsure at all n locations
  Clone ID: 701002533H1
tctaattacacttnctatctcatttccaatctcattttcgttcggttcaaacactcttcatggcatcagacaagaagattaggatcggcatcaacggatttggaaggattggccgtttggtggccagggttgctccttcagaggaatgacgttgaacttgttgctgtcaacgatcctttcatcnccactgattacatgacatacatgttcaagtacgacaccgttcatgggcagtggaagcattttgatgtgaagctgaa

SEQ ID NO: 2737 - DNA, 283 bp, Glycine max
  Clone ID: 700726201H1
ctctctaataacatttctaatctcattctccttctgttcaaaaactctctctcatggcatcagataagaagattaggatcggcatcaacgggtttggaaggttggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaag

SEQ ID NO: 2738 - DNA, 240 bp, Glycine max
  Clone ID: 701004758H1
tcggttcaaacactctcatggcatcagacaacaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaacctgaaggactctaagacccttctcttcg

SEQ ID NO: 2739 - DNA, 262 bp, Glycine max
  Clone ID: 701047055H1
ctctaattacactttctatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagaccct

SEQ ID NO: 2740 - DNA, 252 bp, Glycine max
  Clone ID: 700970781H1
ctctaattacactttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcaccactgattacatgacatacatgttcaagtacgacaccgttcatgggccagtggaagcattttgatgtg

SEQ ID NO: 2741 - DNA, 236 bp, Glycine max
  Clone ID: 700726274H1
ttctaatctcattctccttctgttcaaacactctctctcatggcatcagataagaagattaggatcggcatcaacgggtttggaaggattggccgtttcgcctccacggttgcccttcaaaggaatgatgttgaacttgttgctgtcaacgatcctttcatcaccactgattacatgacatacatgttcaagtacgacaccgttcatggccagtggaagcattttgatgtgaaggt

SEQ ID NO: 2742 - DNA, 272 bp, Glycine max
  Clone ID: 701011762H1
ctctaattacactttctatctcaattccaatctcattttcgttcggttcaaacactctcatggcatcagacacgaagattaggatcggcatcaacggatttggaaggattcgccgtttggtggacagggttgctcttcagaggaatgacgttgaacttgttgctgtcaacgatcctttcatcaccactgattacatgacatacatgttcaagtacgacaccgttcatgggcagtggaagcattttgatgtgaagctgaaggactctaagacc

SEQ ID NO: 2743 - DNA, 266 bp, Glycine max
  unsure (1)...(266): unsure at all n locations
  Clone ID: 700669086H1
tctctaataacatttctaatctcattctccttctgttcaaacactctctctcatggcatcagataagaagattaggancggcatcaacgggtttggaaggattggccgtttggtggccagggttgcccttcaaaggaatgatgttgaacttgttgctgtcaacgatcctttcatcaccactgattacatgactacatgttcaagtacgacaccgttcatggccagtggaagcatttgatgtgaaggtgaaggactctaagaccctt

SEQ ID NO: 2744 - DNA, 243 bp, Glycine max
  Clone ID: 700833089H1
cacgctctctaattacatttctaatctcattctccttctgttcaaacactctcatggcatcagataagaagattaggatcggcatcaacggatttgaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgt

SEQ ID NO: 2745 - DNA, 258 bp, Glycine max
  Clone ID: 700745795H1
cgctctctaataacatttctaatctcatactccttctgttcaaacactctctctcatggcatcagataagaagattaggatcggcatcaacgggtttggaatgattggccgtttggtggccagggttgcccttcaaaggaatgatgttgaacttgttgctgtcaacgatcctttcatcacatatgattacatgacatacatgttcaagtacgacaccgttcatggccagtggaagcattttgatgtgaaggtgaagga

SEQ ID NO: 2746 - DNA, 302 bp, Glycine max
  unsure (1)...(302): unsure at all n locations
  Clone ID: 700651350H1
tctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcaggcagggaacatttgattgaagtgaagctctaagacctccttggtgagagccgtcacgtttggatcaganctgagaattcaggtagtgtctgatagtgtgnt

SEQ ID NO: 2747 - DNA, 218 bp, Glycine max
  Clone ID: 700748761H1
ctctctaataacatttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgtt

SEQ ID NO: 2748 - DNA, 211 bp, Glycine max
  Clone ID: 701012075H1
cgctctctaattacatttctcatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacgaca

SEQ ID NO: 2749 - DNA, 169 bp, Glycine max
  unsure (1)...(169): unsure at all n locations
  Clone ID: 700564585H1
cnaagatgnacccatgtttgttgttggtgttaacgagaaggagtacaagccagagcttgacattgtttccaatgctagctgcnancaccaattgtcttgctcccctcgccaaggttatcaacgaccgatttggaattgtggagggtcttataaccantgttcatgccat

SEQ ID NO: 2750 - DNA, 195 bp, Glycine max
  Clone ID: 701051053H1
catttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttcaagtacg

SEQ ID NO: 2751 - DNA, 302 bp, Glycine max
  unsure (1)...(302): unsure at all n locations
  Clone ID: 700661104H1
ctctaattacactttctatctcatttccaatctcattttcgttcggttcaaacactctcatggcatcagacaagaagattaggatcggcatcaacggatttggaaggattggccgtttggtggccagggttgctcttcagaggaatgacgttgaacttgttgctgtcaacgatcctttcatcancactgattacatgacatacatgttcaagtagacaccgttcatggcagtggaacatttgatgtgaactgaaggntntagacctccgtcgggagagccgcacgtttggatcagactggag

SEQ ID NO: 2752 - DNA, 191 bp, Glycine max
  Clone ID: 701051845H1
tacatttctaatctcattctccttctgttcaaacactctcatggcatcagataagaagattaggatcggcatcaacggatttggaaggattggccgtttggtggccagggttgcccttcaaaggaatgatgttgaacttgttgctgtcaacgatcctttcatcaccactgattacatgacatacatgttca

SEQ ID NO: 2753 - DNA, 154 bp, Glycine max
  Clone ID: 700748992H1
tttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgat

SEQ ID NO: 2754 - DNA, 244 bp, Glycine max
  Clone ID: 700845656H1
agattacactttctatctcatttccaatctcattttcgttcggttcaacactctcatggcatcagacaagaagattaggatcggcatcaacggatttggaaggattagccgtttggtggccagggttgctcttcagaggaatgacgttgaacttgttgctgtcaacgatcctttcatcaccactgattacatgacatacatgttcaagtacgacaccgttcatgggacgtaggaacttttgatg

SEQ ID NO: 2755 - DNA, 283 bp, Glycine max
  unsure (1)...(283): unsure at all n locations
  Clone ID: 700988562H1
cgctctctaataacatttctaanctcantctccttctgttcanacactctctctcatggcatcagataagaagattaggatcnggcatcaacgggnttggaaggattggccgtttggtggccanggttgnnccgtcaaaggagtgatgttgancttgttgctgtcagcgatccttcatcaccactgattacntgacatacangttcaagtacgacaccgttcatggccagtggaagcattttnntgtgaaggtgagggactctaagacccttctctttggtga

SEQ ID NO: 2756 - DNA, 258 bp, Glycine max
  Clone ID: 701003233H1
ctctaattacatttctaatctcattctccttctgttcaaacactctcatggcatcagataagaagattaggatcggcatcaacggatttggacggattggccgtttggtggccagggttgcccttcaaaggaatgatgttgaacttgttgctgtcaacgatcctttcatcaccactgattacatgccatacatgttccagtacggcaacgttcaatggccagtgcaagaattttgatgtgaaggtgaaggcctctaag

SEQ ID NO: 2757 - DNA, 148 bp, Glycine max
  Clone ID: 701048025H1
ctctaattacactttctatctcattttcgttcggttcaaacactctcatggcatcagacaagaagattaggatcggcatcaacggatttggaaggattggccgtttggtggccagggttgctcttcagaggaatgacgttgaacttgt

SEQ ID NO: 2758 - DNA, 278 bp, Glycine max
  unsure (1)...(278): unsure at all n locations
  Clone ID: 700977778H1
ttgctcctgcgctgattgctggaaactccattgtgctcaagcctccaactcagggagctgtttctgctcttcatatggttcactgctttcacttggctggttttcccaaaggcctaatcaactgtgtcactggcaaaggctcagaaattggtgacttccttacaatgcatccaggagtgaactgtataagcttnactggtggtgatactggcattgcaatttcaaagaaggcaggcatgattcctctgcaaatggagttgggaggaaaagatgcctgc

SEQ ID NO: 2759 - DNA, 272 bp, Glycine max
  Clone ID: 700742004H1
actcaattgtgctcaagcctccaactcagggagctgtttctgctttgcacatggttcactgctttcacttggctggttttcccaaaggcctaatcaactgtgtcactggaaaaggctcagaaattggtgatttccttacaatgcatcaggagtgaactgtataagctttactggtggtgatactggcatttcaatttcaaagaaggcaggcatgattcctctgcaaatggagttaggaggaaaagatgcctgcattgtacttgaggatgctg

SEQ ID NO: 2760 - DNA, 246 bp, Glycine max
  Clone ID: 700962586H1
aaaattgctcctgcgctgattgctggaaactccattgtgctcaagcctccaactcagggagctgtttctgctcttcatatggttcactgctttcacttggctggttttcccaaaggcctaatcaactgtgtcactggcaaaggctcagaaattggtgacttccttacaatgcatccaggagtgaactgtataagctttactggtggtgatactggcattgcaatttcaaagaaggcaggcatgatt

SEQ ID NO: 2761 - DNA, 248 bp, Glycine max
  unsure (1)...(248): unsure at all n locations
  Clone ID: 700994796H1
atcttgctgttngcaaaattgnntcctgcggtggattgctggaaactncattgtgctcaagcctccaactcagggagctgtttctgcctcttcatatggttcactgctttcactnggctggntttcccaaaggcctaatccaactgtgtcactggcaaaggctcagaaattggtgacttccttacaatgcatccaggagtgaactgtataagctttactggtggtgatactggcattgcaatttcaaa

SEQ ID NO: 2762 - DNA, 349 bp, Glycine max
  unsure (1)...(349): unsure at all n locations
  Clone ID: 700680820H1
taacgagcacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctgcttcatttaacatcattcctagcagcactggagctgccaaggctgcttggaaagtcctccctgctttgaatgganaattgactggtatggcattccgtgttcccactgtggatgtctctgttgttgacctcacagtgaggctggagaag

SEQ ID NO: 2763 - DNA, 342 bp, Glycine max
  unsure (1)...(342): unsure at all n locations
  Clone ID: 700651027H1
gacaggtttggcattgttgagggtttgatgaccactgttcattccatcactgccacccagaagactgttgatgggccatcagccaaagactggagaggtggaagagctgcttcatttaacatcattcctagcagcactggagctgccaaggctgttggaaaagtccttcctgctttgaacggaaattgactggtatggcattccgtgttcccaccgtggatgtctctgttgttgacctcacagtgaggctggagaaggaagcctcctacgatgaaattaaaaatgctatcaaggaggaatcagagggcaagttgaanggnattcttngttacactgaagatg

SEQ ID NO: 2764 - DNA, 368 bp, Glycine max
  Clone ID: 700661720H1
cgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtgcaaaga

SEQ ID NO: 2765 - DNA, 334 bp, Glycine max
  Clone ID: 700653620H1
atgtttaaatacgacagtgttcacggacactggaagcatcacgatgtcaccgttaaggacgagaagacccttctcttcggtgacaaggcagtcactgtttttggacacagaaaccctgaagagatcccatgggggtcaacggagctgacatcattgttgagtccaccggagttttcaccgataaggacaaggctgccgcacatttgaagggtggtgccaagaaggttattatttctgcccccagtaaggatgcccccatgtttgttgttggtgttaatgagcacgagtacaagccagagcttgatattatttccaacgctagctgcacaaccaa

SEQ ID NO: 2766 - DNA, 283 bp, Glycine max
  Clone ID: 701212010H1
gctgccgcacatttgaagggtggtgcaaagaaggttattatttctgcccccagtaaggatgcccccatgtttgttgttggtgttaacgagcacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctg

SEQ ID NO: 2767 - DNA, 336 bp, Glycine max
  unsure (1)...(336): unsure at all n locations
  Clone ID: 700653624H1
atgtttaaatacgacagtgttcacggacactggaagcatcacgatgtcaccgttaaggacgagaagacccttctcttcggtgacaaggcagtcactgtttttggacacagaaaccctgaagagatcccatgggggtcaactgagctgacatcattgttgagtccaccggagttttcaccgataaggacaaggctgccgcacatttgaagggtggtgccaagaaggttattatttctgcccccagtaaggatgcccccatgtttgttgttggtgttaatgagcacgagtacaagccagagcttgatatnatttccnacgctagtgcacnacnaactg

SEQ ID NO: 2768 - DNA, 280 bp, Glycine max
  Clone ID: 700684013H1
gaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgactcctccttgactatggtcatgggagatgatatggttaaagtggttgcttggtatgacaatgaatggggttacagccaaagagtggtcgatttggcacatctagtagcaagcaagtggccaggggcacctaaagcgggg

SEQ ID NO: 2769 - DNA, 273 bp, Glycine max
  Clone ID: 701130927H1
tattatttctgcccccagtaaggatgcccccatgtttgttgttggtgttaacgagcacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctgcttcatttaacatcattcctagcag

SEQ ID NO: 2770 - DNA, 290 bp, Glycine max
  Clone ID: 701118656H1
cagctcgagagagcttgatattatttccaacgctagctgcacaaccaactgccttgctccactcgccaaggttatcaatgacaggtttggcattgttgagggtttgatgaccactgttcattccatcactgctacccagaagactgttgatgggccatcagccaaggactggagaggtggaagagctgcttcatttaacatcattcctagcagcactggagcttccaaggctgttgggaaagtccttcctgctttgaatggaaaattgactggtatggcattccgtgttc

SEQ ID NO: 2771 - DNA, 267 bp, Glycine max
  Clone ID: 701050807H1
ggctgccgcacatttgaagggtggtgccaagaaggttattatttctgcccccagtaaggatgcccccatgtttgttgttggtgttaatgagcacgagtacaagccagagcttgatattatttccaacgctagctgcacaaccaactgccttgctccactcgccaaggttatcaatgacaggtttggcattgttgagggtttgatgaccactgttcattccatcactgctacccagaagactgttgatgggccatcagccaaggactg

SEQ ID NO: 2772 - DNA, 261 bp, Glycine max
  Clone ID: 700900304H1
tacaagccagagcttgatattatttccaacgctagctgcacaaccaactgccttgctccactcgccaaggttatcaatgacaggtttggcattgttgagggtttgatgaccactgttcattccatcactgctacccagaagactgttgatgggccatcagccaaggactggagaggtggaagagctgcttcatttaacatcattcctagcagcactggagctgccaaggctgttgggaaagtccttcctgctttgaatgga

SEQ ID NO: 2773 - DNA, 293 bp, Glycine max
  Clone ID: 700560856H1
gggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctcaacattataagcaacgcttcctgcaccacaaactgtcttgctccctttgtgaagatcctggatgcagagtttggaattgtgaagggaaccatgacaaccacgcattcctacactggagaccagaggcttttggatgcttcaca

SEQ ID NO: 2774 - DNA, 260 bp, Glycine max
  Clone ID: 701127846H1
gcttgatattatttccaatgctagctgcacaaccaactgccttgccccacttgccaaggttatcaatgacaggtttggcattgttgagggtttgatgaccactgttcattccatcaccgctacccagaagactgttgatggaccatcagccaaggactggagaggtggaagagctgcttcatttaacatcattcctagcagcactggagctgccaaggctgttgggaaagtcctccctgctttgaatggaaaattgactg

SEQ ID NO: 2775 - DNA, 263 bp, Glycine max
  Clone ID: 700746107H1
caatgacaggtttggcattgttgagggtttgatgaccactgttcattccatcaccgctacccagaagactgttgatggacacatcagccaaggactggagaggtggaagagctgcttcatttaacatcattcctagcagcactggagctgccaaggctgttgggaaagtcctccctgctttgaatggaaaattgactggtatggcattccgtgttcccaccgtggatgtctctgttgttgacctcacagtgaggctggagaaa

SEQ ID NO: 2776 - DNA, 260 bp, Glycine max
  Clone ID: 700957321H1
ctaaggttattaatgacaggtttggcattgttgagggtttgatgaccactgttcattccatcactgccacccagaagactgttgatgggccatcagccaaagactggagaggtggaagagctgcttcatttaacatcattcctagcagtactggagctgccaaggctgttggaaaagtccttcctgctttgaacggaaaattgactggtatggcattccgtgttcccaccgtggatgtctctgttgttgacctcacagtg

SEQ ID NO: 2777 - DNA, 285 bp, Glycine max
  unsure (1)...(285): unsure at all n locations
  Clone ID: 700556167H1
gagacagtggccaagttgaaggtggcaatcaatggtttcggacgcattggtagaaacttccttcgctgctggcacggccgaaaagactcaccccttgangtcgttgttgtcaacgacagtggtggtgtcaagaatgcttcgcacctgcttaaatatgattccatgctgggaacttttaaagcagatgtgaaaatactggacaatgaaaccatcactgttgatggtaagcccatcaaggttgtttcaagcagggaccctcttaagcttccttgggctgaacttgga

SEQ ID NO: 2778 - DNA, 272 bp, Glycine max
  Clone ID: 700685605H1
aattgtgaagggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttgagaagaagggtcttactgctgaagatgtgaatg

SEQ ID NO: 2779 - DNA, 282 bp, Glycine max
  unsure (1)...(282): unsure at all n locations
  Clone ID: 700982024H1
ttcattccatcactgctacccagaagactgttgatgggccatcagccaaggactggagaggtggaagagctgcttcatttaacatcattcctagcagcactggagctgccaaggctgttgggaaagtccttcctgctttgaatggaaaattgactggtatggcattccgtgttcccaccgtggatgtctctgttgttgacctcacggtgaggctggagaaggaagcctcatatgatgaaattanaaatgctatcaaggaggaatcagagggcaagttgaagg

SEQ ID NO: 2780 - DNA, 272 bp, Glycine max
  Clone ID: 701136318H1
gcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctgcttcatttaacatcattcctagcagcactggagctgccaaggctgttggaaaagtcctccctgctttgaatggaaaattgactggtatggcattcc

SEQ ID NO: 2781 - DNA, 258 bp, Glycine max
  Clone ID: 701045985H1
ggttatcaatgacaggtttggcattgttgagggtttgatgaccactgttcattccatcaccgctacccagaagactgttgatggaccatcagccaaggactggagaggtggaagagctgcttcatttaacatcattcctagcagcactggagctgccaaggctgttgggaaagtcctccctgctttgaatggaaaattgactggtatggcattccgtgttcccaccgtggatgtctctgttgttgacctcacagtgag

SEQ ID NO: 2782 - DNA, 267 bp, Glycine max
  Clone ID: 700896756H1
ggataaggctgccgcacatttgaagggtggtgcaaagaaggttattatttctgcccccagtaaggatgcccccatgtttgttgttggtgttaacgagcacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaa

SEQ ID NO: 2783 - DNA, 263 bp, Glycine max
  Clone ID: 700738664H1
accacacattcctacacaggagaccagaggcttttggatgcttcacaccgtgacttgagaagagccagggctgcagcactgaacattgtcccaaccagcactggagctgccaaggctgtgtctctagtgttgccacagctgaagggcaagcttaatggaatagcgctccgtgtgcctacacccaatgtttcagttgttgaccttgttgtgaatgttgagaagaagggtcttactgctgaagatgtgaatgcagcattcagaaa

SEQ ID NO: 2784 - DNA, 278 bp, Glycine max
  Clone ID: 700982290H1
gatgaccactgttcattccatcactgccacccagaagactgttgatgggccatcagccaaagactggagaggtggaagagctgcttcatttaacatcattcctagcagcactggagctgccaaggctgttggaaaagtccttcctgctttgaacggaaaattgactggtatggcattccgtgttcccaccgtggatgtctctgttgttgacctcacagtgaggctggagaaggaagcctcctacgatgaaattaaaaatgctatcaaggaggaatcag

SEQ ID NO: 2785 - DNA, 265 bp, Glycine max
  Clone ID: 701039411H1
cacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctgcttcatttaacatcattcctagcagcactggagctgccaacgctgttggaaaagtcctccctgctttgaatg

SEQ ID NO: 2786 - DNA, 276 bp, Glycine max
  Clone ID: 700760151H1
gactgttgatggaccatcagccaaggactggagaggtggaagagctgcttcatttaacatcattcctagcagcactggagctgccaaggctgttgggaaagtcctccctgctttgaatggaaaattgactggtatggcattccgtgttcccaccgtggatgtctctgttgttgacctcacagtgaggctggagaaagaagcttcctacgatgaaattaaaaatgctatcaaggaggaatcagagggcaagttgaagggaattcttggttacactga

SEQ ID NO: 2787 - DNA, 278 bp, Glycine max
  Clone ID: 701037105H1
gtccaccggagttttcaccgataaggacaaggccgccgcacatttgaagggtggtgcgaagaaggttattatttctgcccccagtaaggatgcccccatgtttgttgttggtgttaacgagcacgagtacaagccagagcttgatattatttccaatgctagctgcacaaccaactgccttgctccacttgctaaggttattaatgacaggtttggcattgttgagggtttgatgaccatgttcattccatcactgccacccagaagactgttgatgg

SEQ ID NO: 2788 - DNA, 334 bp, Glycine max
  Clone ID: 700653646H1
ggttgcccatgtagacatacatgtttaaatacgacagtgttcacggggcactggaagcatcacgatgtcaccgttaaggatgagaagacccttctcttcggtgacaagccagtcactgttttggacacaggaaccctgagagatcccatggaagtcgactggagctgacatcattgttgagtccaccggagttttcaccgataaggataaggctgccgcacatttgaagggtggtgcaaagaaggttattatttctgcccccagtaaggatgcccccatgtttgttgttggtgttaacgagcacgagtacaagccagagcttgacattattcca

SEQ ID NO: 2789 - DNA, 284 bp, Glycine max
  Clone ID: 701003361H1
cgctataatttctgcccccagtaaggatgcccccatgtttgtagtcggtgttatcccagcacgagtacaagccagagcttgatattatttccaacgctatctgcacaaccaactgccatgctccactcgccaaggttatcaatgacaggtttggcattgttgagggtttgatgaccactgttcattccatcactgctacccagaagactgttgatgggccatcagccaaggactggagatgtggaagagctgcttcatttaacatcattcctagcagcactgga

SEQ ID NO: 2790 - DNA, 250 bp, Glycine max
  Clone ID: 700684871H1
gtgcaaagaaggttattatttctgcccccagtaaggatgcccccatgtttgttgttggtgtcaacgagcacgagtacaagccagagcttgatattatttccaatgctagctgcacaaccaactgccttgccccacttgccaaggttatcaatgacaggtttggcattgttgagggtttgatgaccactgttcattccatcaccgctacccagaagactgttgatggaccatcagccaaggactggagagg

SEQ ID NO: 2791 - DNA, 264 bp, Glycine max
  Clone ID: 700972333H1
cattgttgagggtttgatgaccactgttcattccatcactgccacccagaagactgttgatgggccatcagccaaagactggagaggtggaagagctgcttcatttaacatcattcctagcagcactggagctgccaaggctgttggaaaagtccttcctgctttgaacggaaaattgactggtatggcattccgtgttcccaccgtggatgtctctgttgttgacctcacagtgaggctggagaaggaagcctcctacgatga

SEQ ID NO: 2792 - DNA, 254 bp, Glycine max
  Clone ID: 700660117H1
gctgaagatgtgaatgcagcattcagaaaggcagctgagggtccactgaaaggtgtgttggacgtgtgtgatgttccacttgtgtctatcgacttccgctgctctgatgtttcctctactattgactcctccttgactatggtcatgggagatgacatggttaaggtggttgcttggtatgacaatgaatggggttacagccaaagggtggtggatttggcacacctagtagcaagcaagtggccaggggcagc

SEQ ID NO: 2793 - DNA, 258 bp, Glycine max
  Clone ID: 700681841H1
gtgcaaagaaggttattatttctgcccccagtaaggatgcccccatgtttgttgttggtgtcaacgagcacgagtacaagccagagcttgatattatttccaatgctagctgcacaaccaactgccttgccccacttgccaaggttcacaatgacaggtttggcattgttgagggtttgatgacacctgttcattccatcaccgctacccagaagactgttgatggaccatcagccaaggactggagaggtggaagag

SEQ ID NO: 2794 - DNA, 294 bp, Glycine max
  Clone ID: 701063487H1
cgaagagctgcttcatttaacatcattcctagcagcactggagctgccaaggctgttggaaaagtcctccctgctttgaatggaaaattgactggtatggcattccgtgttcccactgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgactttgtgggcgatagcagtcaagtatttttgatg

SEQ ID NO: 2795 - DNA, 286 bp, Glycine max
  Clone ID: 701118518H1
attatttccaatgctagctgcacaaccaactgccttgccccacttgccaaggttatcaatgacaggtttggcattgttgagggtttgatgaccactgttcattccatcaccgctacccagaagactgttgatggaccatcagccaaggactggagaggtggaagagctgcttcatttaacatcattcctagcagcactggagctgccaaggctgttgggaaagtcctccctgctttgaatggaaaattgactggtatggcattccgtgttcccaccgtggatgtct

SEQ ID NO: 2796 - DNA, 272 bp, Glycine max
  Clone ID: 700998228H1
cgagtacaagccagagcttgatattatttccaacgctagctgcacaaccaactgccttgctccactcgccaaggttatcaatgacaggtttggcattgttgagggtttgatgaccactgttcattccatcactgctacccagaagatgttgatgggccatcagccaaggactggagaggtggaagagctgcttcatttaacatcattcctagcagcactggagctgccaaggctgttgggaaagtcttcctgctttgaatggaaaattgact

SEQ ID NO: 2797 - DNA, 266 bp, Glycine max
  Clone ID: 700667222H1
agagatcccatgggggtcaactggagctgacatcattgttgagtccaccggagttttcaccgataaggacaaggccgccgcacatttgaagggtggtgcaaagaaggttattatttctgcccccagtaaggatgcccccatgtttgttgttggtgtcaacgagcacgagtacaagccagagcttgatattatttccaatgctagctgcacaaccaactgccttgccccacttgccaaggttatcaatgacaggtttggcattgttg

SEQ ID NO: 2798 - DNA, 276 bp, Glycine max
  Clone ID: 701205378H1
tctcgagccgaatcggctcgagcacgagtacaagccagagcttgatactatttccaatgctagctgtacaaccaactgccttgctccacttgctaaggttattaatgacaggtttggcattgttgagggtttgatgaccactgttcattccatcactgccacccagaagactgttgatgggccatcagccaaagactggagaggtggaagagctgcttcatttaacatcattcctagcagcactggagctgccaaggctgttggaaaagtccttcc

SEQ ID NO: 2799 - DNA, 288 bp, Glycine max
  Clone ID: 701109009H1
gaaagtcctccctgctttgaatggaaaattgactggtatggcattccgtgttcccaccgcggatgtctctgttgttgacctcacagtgaggctggagaaagaagcttcctacgatgaaattaaaaatgctatcaaggaggaatcagagggcaagttgaagggaattcttggttacactgaagatgatgtggtctccactgactttatcggcgatagcagatcaagtatttttgatgcaaaggctggaattgcattgaataagaactttgtgaagcttgtttcttggta

SEQ ID NO: 2800 - DNA, 264 bp, Glycine max
  Clone ID: 700902080H1
gttgccacagctgaagggcaagcttaatggaatagcgctccgtgtgcctacacccaatgtttcagttgttgaccttgttgtgaatgttgagaagaagggtcttactgctgaagatgtgaatgcagcattcagaaaggcagctgagggtccactgaaaggtgtgttggacgtgtgtgatgttccacttgtgtctatcgacttccgctgctctgatgtttcctctactattgactcctccttgactatggtcatgggagatgacat

SEQ ID NO: 2801 - DNA, 282 bp, Glycine max
  Clone ID: 701065402H1
cctggatgcagagtttggaattgtgaacggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttgagaagaagggtcttactgctgaaga

SEQ ID NO: 2802 - DNA, 265 bp, Glycine max
  Clone ID: 700905151H1
atcattgttgagtccaccggagttttcaccgataaggacaaggccgccgcacatttgaagggtggtgcgaagaaggttattatttctgcccccagtaaggatgcccccatgtttgttgttggtgttaacgagcacgagtacaagccagagcttgatattatttccaatgctagctgcacaaccaactgccttgctccacttgctaaggttattaatgacaggtttggcattgttgagggtttgatgaccactgttcattccatca

SEQ ID NO: 2803 - DNA, 250 bp, Glycine max
  unsure (1)...(250): unsure at all n locations
  Clone ID: 700660104H1
gctgaagatgtgaatgcagcattcagaaaggcagctgagggtccactgaaaggtgtgttggacgtgtgtgatgttccacttgtgtctancgacttccgctgctctgatgtttcctctactattgactcctccttgactatggtcatgggagatgacatggttaaggtggttgcttggtatgacaatgaatggggttacagccaaagggtggtggatttggcacacctagtagcaagcaagtggccagggg

SEQ ID NO: 2804 - DNA, 273 bp, Glycine max
  Clone ID: 701122747H1
aggctgttgggaaagtccttcctgctttgaatggaaaattgactggtatggcattccgtgttcccaccgtggatgtctctgttgttgacctcacggtgaggctggagaaggaagcctcatatgatgaaattaaaaatgctatcaaggaggaatcagagggcaagttgaagggaattcttggttacactgaagatgatgtggtctccaccgactctgttggtgataacagatcaagtatttttgatgcaaaggctggaattgcattgaataaga

SEQ ID NO: 2805 - DNA, 267 bp, Glycine max
  Clone ID: 700681958H1
cagcacaggagctgccaaggccgtgtctctatgtgttgccacagctgaagggcaagctcaatggaatagcgctccgtgtgcctacacccaatgtttcagttgttgaccttgttgtgaatgttgagaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgact

SEQ ID NO: 2806 - DNA, 268 bp, Glycine max
  Clone ID: 701045633H1
agctgcttcatttaacatcattcctagcagcactggagctgccaaggctgttggaaaagtccttcctgctttgaacggaaaattgactggtatggcattccgtgttcccaccgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgactttgtgggcgat

SEQ ID NO: 2807 - DNA, 254 bp, Glycine max
  Clone ID: 700870706H1
gagcacgagtacaagccagagcttgacattatttccaatgctagctgcacaaccaactgccttgccccgctcgtcaaggttatcaatgacaggtttggcattgttgagggtttgatgaccactgttcattccatcactgctacccagaagactgttgatgggccatcagccaaagactggagaggtggaagagctgcttcatttaacatcattcctagcagcactggagctgccaaggctgttggaaaagtcct

SEQ ID NO: 2808 - DNA, 257 bp, Glycine max
  Clone ID: 700957310H1
gttaacgagcacgagtacaagccagagcttgatattatttccaatgctagctgcacaaccaactgccttgctccacttgctaaggttattaatgacaggtttggcattgttgagggtttgatgaccactgttcattccatcactgccacccagaagactgttgatgggccatcagccaaagactggagaggtggaagagctgcttcatttaacatcattcctagcagcactggagctgccaaggctgttggaaaagt

SEQ ID NO: 2809 - DNA, 315 bp, Glycine max
  unsure (1)...(315): unsure at all n locations
  Clone ID: 700981914H1
cgggacactgggaagcatcacgatgtcaccgttaaggacgagaagacccttctcttcggtgacaagccagttcactgtttttggacacaggaaccctgaagagatcccatgggggtcaactggagctgatatcattgttgagtccaccggagttttcaccgataaggacaaggccgccgcacnatttgangggtggtgcgaagaaggttattatttctgcccccagtaaggatgcccccatgtttgttgttggtgttaacgagcacgagtacaagccagagcttgatattatttccatgctagctgcacaaccaa

SEQ ID NO: 2810 - DNA, 265 bp, Glycine max
  Clone ID: 700873416H1
gggtcttactgctgaagatgtgaatgcagcattcagaaaggcagctgagggtccactgaaaggtgtgttggacgtgtgtgatgttccacttgtgtctatcgacttccgctgctctgatgtttcctctactattgactcctcttgactatggtcatgggagatgacatggttaaggtggttgcttggtatgacaatgaatggggttacagccaaagggtggtggatttggcacacctagtagcaagcaagtggccaggggcagcta

SEQ ID NO: 2811 - DNA, 273 bp, Glycine max
  Clone ID: 700562964H1
agactgttgatgggccatcagccaaagactggagaggtggaagagctgcttcatttaacatcattcctagcagcactggagctgccaaggctgttggaaaagtccttcctgctttgaacggaaaattgactggtatggcattccgtgttcccaccgtggatgtctctgttgttgacctcacagtgaggctggagaaggaagcctcctaacgatgaaattaaaaatgctatcaaggaggaatcagagggcaagttgaagggaattcttggttac

SEQ ID NO: 2812 - DNA, 259 bp, Glycine max
  Clone ID: 700829678H1
gaagagctgcttcatttaacatcattcctagcagcactggagctgccaaggctgttgggaaagtccttcctgctttgaatggaaaattgactggtatggcattccgtgttcccaccgtggatgtctctgttgttgacctcacggtgaggctggagaaggaagcctcatatgatgaaattaaaaatgctatcaaggaggaatcagagggcaagttgaagggaattcttggttacactgaagatgatgtggtctccaccga

SEQ ID NO: 2813 - DNA, 270 bp, Glycine max
  unsure (1)...(270): unsure at all n locations
  Clone ID: 700668218H1
tgcagagtttggaattgtgaagggaaccatgacaaccacgcattcctacactggnnncnagaggcttttggatgcttcacaccgtgacttgagaagagccagggctgcagcacttaacattgtcccaaccagcacaggagctgccaaggccgtgtctctagtgttgccacagcncaagggctagctcaatggaatagcgctccgtgtgcctacacccaatgtttcagttgttgaccttgttgtgaatgttgagaagaagggttatgctga

SEQ ID NO: 2814 - DNA, 249 bp, Glycine max
  Clone ID: 701206845H1
cgagtacaagccagagcttgatattatttccaacgctagctgcacaaccaactgccttgctccactcgccaaggttatcaatgacaggtttggcattgttgagggtttgatgaccactgttcattccatcactgctacccagaagactgttgatgggccatcagccaaggactggagaggtggaagagctgcttcatttaacatcattcctagcagcactggagctgccaaggctgttgggaaagtcct

SEQ ID NO: 2815 - DNA, 257 bp, Glycine max
  Clone ID: 700835082H1
gagggtttgatgaccactgttcattccatcactgccacccagaagactgttgatgggccatcagccaaagactggagaggtggaagagctgcttcatttaacatcattcctagcagcactggagctgccaaggctgtcggaaaagtcctccctgctttgaacggaaaattgactggtatggcattccgtgttcccaccgtggatgtctctgttgttgacctcacagtgaggctggagaaggaagcctcctacgatga

SEQ ID NO: 2816 - DNA, 259 bp, Glycine max
  Clone ID: 701011483H1
aacgagcacgagtacaatccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctgcttcatttaacatcattcctagcagcactggagctgccaaggctgtcggaaaagtcctcc

SEQ ID NO: 2817 - DNA, 273 bp, Glycine max
  Clone ID: 700605436H2
aggttgtttcaagcagggaccctcttaagcttccatgggctgagcttggaattgacattgttattgagggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagcaacgcttcctgcaccacaaactgtcttgctccctttgtgaaga

SEQ ID NO: 2818 - DNA, 255 bp, Glycine max
  Clone ID: 700963428H1
agcgctccgtgtgcctacacccaatgtttcagttgttgaccttgttgtgaatgttgagaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgactcctccttgactatggtcatgggagatgatatggttaaagtggttgcttggtatga

SEQ ID NO: 2819 - DNA, 288 bp, Glycine max
  unsure (1)...(288): unsure at all n locations
  Clone ID: 700975672H1
ggtaagcccatcaaggttgtttcaagcagggaccctcttaagcttccttgggctgaacttggaattgacattgttattgagggaaccggagtgtttgtggatggccccggggctggtaaacacatccangcaggtgccaagaaagttattatcactgctcctgcaaagggtgctgatattccaacttatgttgttggtgtaaatganggggatacactgcatcagatctctaacatataagcnacgcttcctgcaccacaaactgtcttgctccctttgtgaagatcc

SEQ ID NO: 2820 - DNA, 245 bp, Glycine max
  Clone ID: 700907957H1
caagccagagcttgatattatttccaatgctagctgcacaaccaactgccttgctccacttgctaaggttattaatgacaggtttggcattgctgagggtttgatgaccactgttcattccatcactgccacccagaagactgttgatgggccatctaccaaagactggagaggtggaagagctgcttcatttaacatcattcctagcagcactggagctgccaaggctgttggaaagtccttcc

SEQ ID NO: 2821 - DNA, 255 bp, Glycine max
  Clone ID: 700960608H1
gttcattccatcactgccacccagaagactgttgatgggccatcagccaaagactggagaggtggaagagctgcttcatttaacatcattcctagcagcactggagctgccaaggctgttggaaaagtccttcctgctttgaacggaaaattgactggtatggcattccgtgttcccaccgtggatgtctctgttgttgacctcacagtgaggctggagaaggaagcctcctacgatgaaattaaaaatgctatc

SEQ ID NO: 2822 - DNA, 240 bp, Glycine max
  Clone ID: 700837794H1
caaggttatcaatgacaggtttggcattgttgagggtttgatgaccactgttcattccatcaccgctacccagaagactgttgatggaccatcagccaaggactggagaggtggaagagctgcttcatttaacatcattcctagcagcactggagctgccaaggctgttgggaaagtcctccctgctttgaatggaaaattgactggtatggcattccgtgttcccaccgtggatgtctc

SEQ ID NO: 2823 - DNA, 255 bp, Glycine max
  Clone ID: 701138460H1
aaggaggcttccttctccagcctcactgtgaggtcaacaacagagacgtgccacagtgggaacacggaatgccataccagtcaattttccattcaaagcagggaggacttttccaacagccttggcagctccagtgctgctaggaatgatgttaaatgaagcagctcttccacctctccagtctttggctgatggcccatcaacagtcttctgggtagcagtgatggaatgaacagtggtcatcaaaccctcaac

SEQ ID NO: 2824 - DNA, 292 bp, Glycine max
  Clone ID: 700646202H1
ctttaaggcagatgtgaaaatactagacaatgaaaccatcactgttgatggtaagtccatcaaggttgtttcaagcagggaccctcttaagcttccatgggctgagcttggaattgacattgttattgagggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagc

SEQ ID NO: 2825 - DNA, 240 bp, Glycine max
  Clone ID: 700874447H1
tataagcaacgcttcctgcaccacaaactgtcttgctccctttgtgaagatcctggatgaagagtttggaattgtgaagggaaccatgacaaccacacattcctacacaggagaccagaggcttttggatgcttcacaccgtgacttgagaagagccagggctgcagcactgaacattgtcccaaccagcactggagctgccaaggctgtgtctctagtgttgccacagctgaagggcaa

SEQ ID NO: 2826 - DNA, 250 bp, Glycine max
  Clone ID: 700667967H1
gcagagtttggaattgtgaagggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttg

SEQ ID NO: 2827 - DNA, 238 bp, Glycine max
  Clone ID: 701131790H1
gtatgcccccatgtttgttgttggtgtcaacgagcacgagtacaagccagagcttgatattatttccaatgctagctgcacaaccaactgccttgccccacttgccaaggttatcaatgacaggtttggcattgttgagggtttgatgaccactgttcattccatcaccgctacccagaagactgttgatggaccatcagccaaggactggagaggtggaagagctgcttcatttaac

SEQ ID NO: 2828 - DNA, 260 bp, Glycine max
  Clone ID: 700970954H1
ctgccacccagaagactgttgatgggccatcagccaaagactggagaggtggaagagctgcttcatttaacatcattcctagcagcactggagctgccaaggctgttggaaaagtccttcctgctttgaacggaaaattgactggtatggcattccgtgttcccaccgtggatgtctctgttgttgacctcacagtgaggctggagaaggaagcctcctacgatgaaattaaaaatgctatcaaggaggaatcagagggc

SEQ ID NO: 2829 - DNA, 262 bp, Glycine max
  Clone ID: 701120441H1
gcttcatttaacatcattcctagcagcactggagctgccaaggctgttggaaaagtcctccctgctttgaatggaaaattgactggtatggcattccgtgttcccactgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgactttgtgggcg

SEQ ID NO: 2830 - DNA, 284 bp, Glycine max
  Clone ID: 701120055H1
agaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataa

SEQ ID NO: 2831 - DNA, 301 bp, Glycine max
  Clone ID: 701001031H1
atggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaaggtggcaatcaatggtttcggacgcattggtagaaattcct

SEQ ID NO: 2832 - DNA, 352 bp, Glycine max
  Clone ID: 700652931H1
ctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactattttggacacagaaaccctgaagagatcccatgggggtcaactggagctgacatcatgttgagtccaccggagtttt

SEQ ID NO: 2833 - DNA, 312 bp, Glycine max
  unsure (1)...(312): unsure at all n locations
  Clone ID: 700981202H1
cagccaagggactggagaggtggaagagctgcttcatttaacatcattcctagcagcactggagctgccaaggctgttgggaaagtcctccctgctttgaatggaaaattgactggtatggcattccgtgttcccaccgtggatgtctctgttgttgacctcacagtgaggctggagaaanaagcttcctacgatgaaattaaaaatgctatcaaggaggaatcagagggcaagttgaagggaattcttggttacatgaagatgatgtggtctccatgactttatcggcgatanagatcaagtattttgatg

SEQ ID NO: 2834 - DNA, 271 bp, Glycine max
  Clone ID: 701142183H1
gactgttgatggaccatcagccaaggactggagaggtggacgagctgcttcatttaacatcattcctagcagcactggagctgccaaggctgttgggaaagtcctccctgctttgaatggaaaattgactggtatggcattccgtgttcccaccgtggatgtctctgttgttgacctcacagtgaggctggagaaagaagcttcctacgatgaaattcaaaaatgctatcaaggaggaatcagagggcaagttgaagggaattcttggtta

SEQ ID NO: 2835 - DNA, 272 bp, Glycine max
  Clone ID: 700978682H1
ggctgttggaaaagtccttcctgctttgaacggaaaattgactggtatggcattccgtgttcccaccgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgactttgtgggcgatagcagatcaagtatttttgatgcaaaggctggaattgcattgaataaga

SEQ ID NO: 2836 - DNA, 261 bp, Glycine max
  Clone ID: 701122065H1
tggagctgccaaggctgttgggaaagtccttcctgctttgaatggaaaattgactggtatggcattccgtgttcccaccgtggatgtctctgttgttgacctcacggtgaggctggagaaggaagcctcatatgatgaaattaaaaatgctatcaaggaggaatcagagggcaagttgaagggaattcttggttacactgaagatgatgtggtctccaccgactttgttggtgataacagatcaagtatttttgatgcaaa

SEQ ID NO: 2837 - DNA, 281 bp, Glycine max
  unsure (1)...(281): unsure at all n locations
  Clone ID: 700558895H1
gagacagtggccaagttgaaggtggcaatcaatggtttcggacgcattggtagaaacttccttcgctnctggcacggccgaaaagactcaccccttgangtcgttgttgtcaacgacagtggtggtgtcaagaatgcttcgcacctcttaaatatgattccatgctgggaacttttaaagcagatgtgaaaatactggacaatgaaaccatcactgttgatggtaagcccatcaaggttgtttcaagcagggaccctcttaagcttcctgggctgacttgg

SEQ ID NO: 2838 - DNA, 265 bp, Glycine max
  Clone ID: 700686234H1
aattgtgaagggaaccatgacaaccacgcattcctacactggagaccagaggcttttggatgcttcacaccgtgacttgagaagagccagggctgcagcacttaacattgtcccaaccagcacaggagctgccaaggccgtgtctctagtgttgccacagctgaagggcaagctcaatggaatagcgctccgtgtgcctacacccaatgtttcagttgttgaccttgttgtgaatgttgagaagaagggtcttactgctgaagat

SEQ ID NO: 2839 - DNA, 289 bp, Glycine max
  unsure (1)...(289): unsure at all n locations
  Clone ID: 700566271H1
ttcacgatgtcaccgttaaggacgagaagacccttctcttcggtgacaagccagtncactatttttggacacagaaaccctgaagagatcccatgggggtcaactggagctgacatcattgttgagtccaccggagttttcaccgataaggacaaggccgccgcacatttgaagggtggtgcaaagaaggttattatttctgcccccagtaaggatgcccccatgtttgttgttggtgtcaacgagcacgagtacaagccagagcttgatattatttccaatgctagct

SEQ ID NO: 2840 - DNA, 289 bp, Glycine max
  unsure (1)...(289): unsure at all n locations
  Clone ID: 700558604H1
cacccacgcggctcttgcttctacaaggatcccttcanacacaaggttcccatccaaggcctctcactctttcccaacccaatgcgccttaaagagacttgaggtgacagaattctctgggcttagatccacttcatgtgtcacatatgctaacagtgctagagaatcttccttttttgatcntgtagcttcccaactcactcccaagaccaatggatcaactcctgtgaggggagagacagtggccaagttgaaggtggcaatcaatggtttcggacgcattggtaga

SEQ ID NO: 2841 - DNA, 258 bp, Glycine max
  Clone ID: 700684166H1
cagaaaccctgaagagatcccatgggggtcaactggagctgacatcattgttgagtccaccggagttttcaccgataaggacaaggccgccgcacatttgaagggtggtgcaaagaaggttattatttctgcccccagtaaggatgcccccatgtttgttgttggtgtcaacgagcacgagtacaagccagagcttgatattatttccaatgctagctgcacaaccaactgccttgccccacttgccaaggttatcaa

SEQ ID NO: 2842 - DNA, 249 bp, Glycine max
  Clone ID: 700873924H1
gtttgatgaccactgttcattccatcactgctacccagaagactgttgatgggccatcagccaaagactggagaggtggaagagctgcttcatttaacatcattcctagcagcactggagctgccaaggctgttggaaaagtcctccctgctttgaatggaaaattgactggtatggcattccgtgttcccactgtggatgtctctgttgttgacctcacagtgaggctggagaaggaagcctcctacg

SEQ ID NO: 2843 - DNA, 243 bp, Glycine max
  Clone ID: 700738880H1
aatagcgctccgtgtgcctacacccaatgtttcagttgttgaccttgttgtgaatgttgagaagaagggtcttactgctgaagatgtgaatgcagcattcagaaaggcagctgagggtccactgaaaggtgtgttggacgtgtgtgatgttccacttgtgtctatcgacttccgctgctctgatgtttcctctactattgactcctccttgactatggtcatgggagatgacatggttaaggt

SEQ ID NO: 2844 - DNA, 257 bp, Glycine max
  Clone ID: 700741816H1
gtgcctacacccaatgtttcagttgttgaccttgttgtgaatgttgagaagaagggtcttactgctgaagatgtgaatgcagcattcagaaaggcagctgagggtccactgaaaggtgtgttggacgtgtgtgatgttccacttgtgtctatcgacttccgctgctctgatgtttcctctactattgactcctccttgactatggtcatgggagatgacatggtaaaggtggtcccttggtatgacaatgaatgggg

SEQ ID NO: 2845 - DNA, 249 bp, Glycine max
  Clone ID: 700892371H1
ccggagttttcaccgataaggacaaggccgccgcacatttgaagggtggtgcgaagaaggttattatttctgcccccagtaaggatgcccccatgtttgttgttggtgttaacgagcacgagtacaagccagagcttgatattatttccaatgctagctgcacaaccaactgccttgctccacttgctaaggttattaatgacaggtttggcattgttgagggtttgatgaccactgttcattccatca

SEQ ID NO: 2846 - DNA, 328 bp, Glycine max
  unsure (1)...(328): unsure at all n locations
  Clone ID: 700560702H1
gncatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagtncatcttccttttttgatcttgtagcttcccaactcactcccaagaccaatggatcaactcctgtgaggggagagacagtggccaagttgaaggtggcaatcaatggtttcggacgcattggtagaaattccttcgctgctggcaggccgaaaagat

SEQ ID NO: 2847 - DNA, 248 bp, Glycine max
  Clone ID: 700968331H1
ccgtgacttgagaagagccagggctgcagcactgaacattgtcccaaccagcactggagctgccaaggctgtgtctctagtgttgccacagctgaagggcaagcttaatggaatagcgctccgtgtgcctacacccaatgtttcagttgttgaccttgttgtgaatgttgagaagaagggtcttactgctgaagatgtgaatgcagcattcagaaaggcagctgagggtccatgaaagtgtgttggac

SEQ ID NO: 2848 - DNA, 282 bp, Glycine max
  Clone ID: 701063318H1
agaagacccttctcttcggtgacaagccagtcactgtttttggacacaggaaccctgaagagatcccatggaagtcgactggagctgacatcattgttgagtccaccggagttttcaccgataaggataaggctgccgcacatttgaagggtggtgcaaagaaggttattatttctgcccccagtaaggatgcccccatgtttgttgttggtgttaacgagcacgagtacaagccagagcttgacattatttccaatgctagctgcacaaccaactgccttg

SEQ ID NO: 2849 - DNA, 280 bp, Glycine max
  unsure (1)...(280): unsure at all n locations
  Clone ID: 700996472H1
gttattatcactgctcctgcaaagggtgctgatattccaacttatgttgttggtgtaaatgaaggggactacactcatcagatctctaacattataagcaacgcttcctgcaccacaaactgtcttgctccctttgtgaagatcctggatgaagagtttggaattgtgaagggaaccatgacaaccacacattcctacacaggagaccagaggcttttgggatgctttcacaccgtgacttgagaagagccagggctgcagcactgaacattgtcccanc

SEQ ID NO: 2850 - DNA, 278 bp, Glycine max
  Clone ID: 701065057H1
tcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatc

SEQ ID NO: 2851 - DNA, 253 bp, Glycine max
  Clone ID: 700863670H1
tggcattgttgagggtttgctgaccactgttcattccatcactgctacccagaagactgttgatgggccatcagccaaagactggagaggtggaagagctgcttcatttaacatcattcctagcagcactggagctgccaaggctgttggaaaagtcctccctgctttgaatggaaaattgactggtatggcattccgtgttcccactgtggatgtctctgttgttgacctcacagtgaggctggagaagaag

SEQ ID NO: 2852 - DNA, 293 bp, Glycine max
  Clone ID: 701212013H1
cactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatggaagt

SEQ ID NO: 2853 - DNA, 298 bp, Glycine max
  Clone ID: 701012801H1
ctttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatggaagtcgactgg

SEQ ID NO: 2854 - DNA, 277 bp, Glycine max
  Clone ID: 701004406H1
cccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatggc

SEQ ID NO: 2855 - DNA, 252 bp, Glycine max
  Clone ID: 700751116H1
ggatgcccccatgtttgttgttggtgttaacgagcacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctgcttcatttaacatcattcctagcag

SEQ ID NO: 2856 - DNA, 236 bp, Glycine max
  Clone ID: 700675491H1
cacgagtacaagccagagcttgatattatttccaatgctagctgcacaaccaactgccttgccccacttgccaaggttatcaatgacaggtttggcattgttgagggtttgatgaccactgttcattccatcaccgctacccagaagactgttgatggaccatcagccaaggactggagaggtggaagagctgcttcatttaacatcattcctagcagcactggagctgccaaggc

SEQ ID NO: 2857 - DNA, 271 bp, Glycine max
  Clone ID: 701131360H1
cggacactggaagcatcacgatgtcaccgttaaggacgagaagacccttctcttcggtgacaagccagtcactgtttttggacacaggaaccctgaagagatcccatgggggtcaactggagctgatatcattgttgagtccaccggagttttcaccgataaggacaaggccgccgcacatttgaagggtggtgcgaagaaggttattatttctgcccccagtaaggatgcccccatgtttgttgttggtgttaacgagcacgagtacaag

SEQ ID NO: 2858 - DNA, 298 bp, Glycine max
  Clone ID: 700562740H1
tcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatggaagtcgactggagc

SEQ ID NO: 2859 - DNA, 257 bp, Glycine max
  Clone ID: 701099556H1
cggtggtgcaaagaaggttattatttctgcccccagtaaggatgcccccatgtttgttgttggtgttaacgagcacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagctggagaagtgg

SEQ ID NO: 2860 - DNA, 290 bp, Glycine max
  Clone ID: 700558534H1
gcggctcttgcttctacaaggatcccttcaaacacaaggttcccatccaaggcctcttcactctttcccaacccaatgcgccttaaagagacttgaggtgacagaattctctgggcttagatccacttcatgtgtcacatatgctaacagtgctagagaatctccttttttgatcttgtagcttcccaactcactcccaacaccaatggatcaactcctgtgaggggagagacagtggccaagttgaaggtggcaatcaatggtttcggacgcattggtagaaacttcct

SEQ ID NO: 2861 - DNA, 257 bp, Glycine max
  unsure (1)...(257): unsure at all n locations
  Clone ID: 700565245H1
tttatcaatgacaggtttgggcattgttgagggtttgatgaccactgttcattccatncaccgctacccagaagactgttgatggaccatcagncaaggactggagatgtggaagagctgcttcatttaacatcattcctagcagcactggagctgccaaggctgttgggaaagtcctccctgctttgaatggaaaattgactggtatggcattccgtgttcccaccgtggattctctgttgttgacctcacagtga

SEQ ID NO: 2862 - DNA, 265 bp, Glycine max
  Clone ID: 700944452H1
gaaaccctgaagagatcccatgggggtcaactggagctgacatcattgttgagtccaccggagttttcacccataaggacaaggccgccgcacatttgaagggtggtgcaaagaaggttattatttctgcccccagtaaggatgcccccatgtttgttgttggtgtcaacgagcacgagtacaagccagagcttgatattatttccaatgctagctgcacaaccaactgccttgccccacttgccaaggttatcaatgacaggtt

SEQ ID NO: 2863 - DNA, 273 bp, Glycine max
  Clone ID: 701009629H1
gacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggctgccgcacatttgaagggtggtgccaagaaggttattatttctgcccccagtaaggatgcccccatgtttgttgttggtgttaatgagcac

SEQ ID NO: 2864 - DNA, 267 bp, Glycine max
  Clone ID: 700725661H1
gctgcttcatttaacatcattcctagcagcactggagctgccaaggctgttggaaaagtcctccctgctttgaatggaaaattgactggtatggcattccgtgttcccactgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgattttgtgggcgat

SEQ ID NO: 2865 - DNA, 248 bp, Glycine max
  Clone ID: 701066885H1
gacaggtttggcattgttgagggtttgatgaccactgttcattccatcactgctacccagaagactgttgatgggccatcagccaaggactggagaggtggaacagctgcttcatttaacatcattcctagcagcactggagctgccaacgctgttgggaaagtccttcctgctttgaatggaaaattgactggtatggcattccgtgttcccaccgtggatgtctctgttgtagacctccacggtga

SEQ ID NO: 2866 - DNA, 274 bp, Glycine max
  Clone ID: 701009856H1
cggacactcgaagcatcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggctgccgcacatttgaagggtggtgccaagaaggttactatttctccccccagtaaggatgcccccatgtttgttgttggtgttaatgagcacgagtacaagcca

SEQ ID NO: 2867 - DNA, 311 bp, Glycine max
  unsure (1)...(311): unsure at all n locations
  Clone ID: 700560569H1
cactttcttttttcccgcagtcatggggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggntgagaagacccttctcttcggtgacaagccagtcactgtttttggacacaggaaccctgaagagatcccatggaagngactggagctgacatca

SEQ ID NO: 2868 - DNA, 277 bp, Glycine max
  Clone ID: 700867802H1
tttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatccc

SEQ ID NO: 2869 - DNA, 273 bp, Glycine max
  Clone ID: 701117421H1
agactcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggct

SEQ ID NO: 2870 - DNA, 263 bp, Glycine max
  Clone ID: 700963317H1
caagaccaatggatcaactcctgtgaggggagagttagtggccaagttgaaggtggcaatcaatggtttcggacgcattggtagaaacttccttcgctgctggcacggccgaaaagactcaccccttgaagtcgttgttgtcaacgacagtggtggtgtcaagaatgcttcgcacctgctgaaatatgatcctatgctgggaacctttaaggaaatgttgaaatactagacaattgaaccatcactgttgatggtaatccatc

SEQ ID NO: 2871 - DNA, 281 bp, Glycine max
  Clone ID: 700646149H1
cttcacaccgtgacttgagaaggccagggctgcagcactgaacattgtcccaaccagcactggagctgccaaggctgtgtctctagtgttgccacagctgaagggcaagcttaatggaatagcgctccgtgtgcctacacccaatgtttcagttgttgaccttgttgtgaatgttgagaagaagggtcttactgctgaagatgtgaatgcagcattcagaaaggcagctgagggtccactaaagtgtgttggactgtgtgatgttcccttgtgtctatcga

SEQ ID NO: 2872 - DNA, 267 bp, Glycine max
  unsure (1)...(267): unsure at all n locations
  Clone ID: 701002213H1
cttttaaagcagatgtgaaaatactggacaatgaaaccatcactgntgatggtaagcccatcaaggttgtttcaagcagggaccctcttaagctnccttgggctgaacttggaattgacattgttattgagggaaccggagtgtttnnggatggccctggggctggtnaacacatccaagcaggtgccaagaaagttattatcactgctcctgcaaagggtgctgatattcccaacttatgttgttggtgtaaatgcaggggatncc

SEQ ID NO: 2873 - DNA, 286 bp, Glycine max
  unsure (1)...(286): unsure at all n locations
  Clone ID: 700999509H1
ccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttcctttnttgatcttgtagcttcccaactcactcccaagaccaatggatcaactcctgtgaggggagagacagtggccaagttgaaggtggcaatcaatggtttcggacg

SEQ ID NO: 2874 - DNA, 288 bp, Glycine max
  Clone ID: 701003210H1
ctttcttttttcccgcagtcatgggcaacgtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatgga

SEQ ID NO: 2875 - DNA, 246 bp, Glycine max
  Clone ID: 700738832H1
aatagcgctccgtgtgcctacacccaatgtttcagttgttgaccttgttgtgaatgttgagaagaagggtcttactgctgaagatgtgaatgcagcattcagaaaggcagctgagggtccactgaaaggtgtgttggacgtgtgtgatgttccacttgtgtctatcgacttccgctgctctgatgtatcctctactattgactcctccttgactatggtcatgggagatgacatggttaaggtggt

SEQ ID NO: 2876 - DNA, 272 bp, Glycine max
  Clone ID: 701212329H1
caagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatgggggtcaactggagctga

SEQ ID NO: 2877 - DNA, 266 bp, Glycine max
  Clone ID: 700683783H1
atcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagc

SEQ ID NO: 2878 - DNA, 252 bp, Glycine max
  Clone ID: 700874828H1
gcttcccaactcactcccaagaccaatggatcaactcctgtgaggggagagacagtggccaagttgaaggtggcaatcaatggtttcggacgcattggtagaaacttccttcgctgctggcacggccgaaaagactcaccccttgaagtcgttgttgtcaacgacagtggtggtgtcaagaatgcttcgcacctgctgaaatatgattctatgctgggaacctttaaggcagatgtgaaaatactagacaat

SEQ ID NO: 2879 - DNA, 236 bp, Glycine max
  Clone ID: 700839986H1
gaccactgttcattccatcaccgctacccagaagactgttgatggaccatcagccaaggactggagaggtggaagagctgcttcatttaacatcattcctagcagcactggagctgccaaggctgttgggaaagtcctccctgctttgaatggaaaattgactggtatggcattccgtgttcccaccgtggatgtctctgttgttgacctcacagtgaggctggagaaagaagctt

SEQ ID NO: 2880 - DNA, 327 bp, Glycine max
  unsure (1)...(327): unsure at all n locations
  Clone ID: 700661155H1
cncaacttccgctacttcctactccnaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtntaaatacgacagtgttcacgggcactggaagcatcacgatgtcaccgttaaggatgagaagacccttctcttcggtgacaagccagtcactgtttttgganacaggaaccctgaagagatcccatggaagtngactt

SEQ ID NO: 2881 - DNA, 257 bp, Glycine max
  Clone ID: 700686453H1
tgtaaatgaaggggactacactcatcagatctctaacattataagcaacgcttcctgcaccacaaactgtcttgctccctttgtgaagatcctggatgaagagtttggaattgtgaagggaaccatgacaaccacacattcctacacaggagaccagaggcttttggatgcttcacaccgtgacttgagaagagccagggctgcagcactgaacattgtcccaaccagcactggagctgccaaggctgtgtctctag

SEQ ID NO: 2882 - DNA, 286 bp, Glycine max
  Clone ID: 701104636H1
tctaaatgaatggcatggatcaggcaaggtcaagatcggaatcaacggatttggaagaattggccgtttggttgccagaatcgctctgcaaagagacgatgttgaactcgttgccgttaacgaccctgtcattaccaccgattacatgacatacatgtttaaatacgacagtgttcacggacactggaagcatcacgatgtcaccgttaaggacgagaagacccgtctcttcggtgacaaggcagtcactgtttttggacacagaaaccctgaagagatcccatgg

SEQ ID NO: 2883 - DNA, 256 bp, Glycine max
  Clone ID: 700682277H1
cccaatgtttcagttgttgaccttgttgtgaatgttgagaagaagggtcttactgctgaagatgtgaatgcagcattcagaaaggcagctgagggggcgctcaaaggtgtattggacgtgtgtgatgttccacttgtgtctatcgacttccgctgctctgatgtttcctctactattgactcctccttgactatggtcatgggagatgatatggttaaagtggttgcttggtatgacaatgaatggggttacagcc

SEQ ID NO: 2884 - DNA, 293 bp, Glycine max
  Clone ID: 700556648H1
ggccacccacgcggctcttgcttctacaaggatcccttcaaacacaaggttcccatccaaggcctctcactctttcccaacccaatgcgccttaaagagacttgaggtgacagaattctctgggcttagaaccacttcatgtgtcacatagctaacagtgctagagaatcttccttttttgatcttgtagcttcccaactcactcccaagaccaatggatcaactcctgtgaggggagagacagtggccaagttgaaggtggcaatcaatggtttcggacgcattggtagaaa

SEQ ID NO: 2885 - DNA, 273 bp, Glycine max
  Clone ID: 701133126H1
atcgaacgagaagacccttctcttcggtgacaaggcagtcactgattttggacacagaaaacctgaagagatcccatgggggtcaactggagctgacatcattgttgagtccaccggagttttcaacgataaggacaaggctgccgcacatttgaagggtggtgccaagaaggttattatttctgcccccagtaaggatgcccccatgtttgtagttggtgttaatgagcacgagtacaagccagagcttgatattatttccaacgctagctg

SEQ ID NO: 2886 - DNA, 260 bp, Glycine max
  unsure (1)...(260): unsure at all n locations
  Clone ID: 700659056H1
gtntgttgttggtgttaacgagcacgagtacaagccagagcttgatattatttccaatgctagctgcacaaccaactgcctgctccacttgctaaggttattaatgacaggtttggcattgttgagggtttgatgaccacngttcattccatcactgccacccagaagactgttgatgggccatcagccaaagactggagaggtggaagagctgcttcatttaacatcatcctagcagcactggagctgccaagctgttg

SEQ ID NO: 2887 - DNA, 238 bp, Glycine max
  Clone ID: 701009405H1
aaccaactgccttgccccacttgccaaggttatcaatgacaggtttggcattgttgagggtttgatgaccactgttcattccatcaccgctacccagaagactgttgatggaccatcagccaaggactggagaggtggaagagctgcttcatttaacatcattcctagcagcactggagctgccaaggctgttgggaaagtcctccctgctttgaatggaaaattgactggtatggca

SEQ ID NO: 2888 - DNA, 291 bp, Glycine max
  Clone ID: 700554721H1
cacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagaccctctcttcggtgacaagccagtcactatttttggacacagaaaccctgaagagatcccatgggggt

SEQ ID NO: 2889 - DNA, 259 bp, Glycine max
  Clone ID: 700833925H1
atcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggctgccgcacatttgaagggtggtgccaagaaggttattatttctgcccccagtaaggatgcccccatgtttgttgttggtgttaatgagcacgagtacaagcc

SEQ ID NO: 2890 - DNA, 257 bp, Glycine max
  Clone ID: 700848119H1
tgtctctgttgttgacctcacagtgaggctggagaaagaagcttcctacgatgaaattaaaaatgctatcaaggaggaatcagagggcaagttgaagggaattcttggttacactgaagatgatgtggtctccactgactttatcggcgatagcagatcaagtatttttgatgcaaaggctggaattgcattgaataagaactttgtgaagcttgtttcttggtacgacaacgagtggggatacagctcacgtgtca

SEQ ID NO: 2891 - DNA, 293 bp, Glycine max
  Clone ID: 700559336H1
ctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagat

SEQ ID NO: 2892 - DNA, 290 bp, Glycine max
  Clone ID: 701207095H1
gacctcacggtgaggctggagaaggaagcctcatatgatgaaattaaaaatgctatcaaggaggaatcagagggcaagttgaagggaattcttggttacactgaagattttgtggtctccaccgactttgttggtgataacagatcaagtatttttgatgcaaaggctggaattgcattgaataagaattttgtgaagcttgtctcttggtatgacaacgagtggggatacagttcacgtgtcattgacctgcttgtaatcgttgccaagaagtctttttaattaaggtg

SEQ ID NO: 2893 - DNA, 268 bp, Glycine max
  Clone ID: 701125617H1
caattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagat

SEQ ID NO: 2894 - DNA, 259 bp, Glycine max
  Clone ID: 700756418H1
tgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagat

SEQ ID NO: 2895 - DNA, 235 bp, Glycine max
  Clone ID: 700738263H1
tgaaaccatcactgttgatggtaagcccatcaaggttgtttcaagcagggaccctcttaagcttccttgggctgaacttggaattgacattgttattgagggaaccggagtgtttgtggatggccctggggctggtaaacacatccaagcaggtgccaagaaagttattatcactgctcctgcaaagggtgctgatattccaacttatgttgttggtgtaaatgaaggggactac

SEQ ID NO: 2896 - DNA, 260 bp, Glycine max
  Clone ID: 700743026H1
gctttgaatggaaaattgactggtatggcattccgtgttcccaccgtggatgtctctgttgttgacctcacggtgaggctggagaaggaagcctcatatgatgaaattaaaaatgctatcaaggaggatcagagggcaagttgaagggaattcttggttacactgaagatgatgtggtctccaccgactttgttggtgataacagatcaagtatttttgatgcaaaggctggaattgcattgaataagaattttgtgaag

SEQ ID NO: 2897 - DNA, 278 bp, Glycine max
  unsure (1)...(278): unsure at all n locations
  Clone ID: 700978803H1
gccagggtggctctgcagagagncgatgttgaactcgttgccgttnacgatcctttcattaccaccgattacntgncntacatgtttaaatacgacagtgttcacgggcactggaagcntcacgatgtcaccgttaaggatgagaagacccttctcttcggtgacaagccagtcactgtttttggncacaggaaccctgaagagatcccatggaagtcgactggngctgacatcnttgttgagtccaccggagttttcaccgataaggataaggctgc

SEQ ID NO: 2898 - DNA, 243 bp, Glycine max
  Clone ID: 700852390H1
gaagggcaagctcaatggaatagcgctccgtgtgcctacacccaatgtttcagttgttgaccttgttgtgaatgttgagaagaagggtcttactgctgaagatgtgaatgcagcattcagaaaggcagctgaggggccgctcaaaggtgtattggacgtgtgtgatgttccacttgtgtctatcgacttccgctgctctgatgtttcctctactattgactcctccttgactatggtcatggg

SEQ ID NO: 2899 - DNA, 264 bp, Glycine max
  Clone ID: 700681390H2
tgaagatcctggatgaagagtttggaattgtgaagggaaccatgacaaccacacattcctacacaggagaccagtggcttttggatgcttcacaccgtgacttgcgaagagccagggctgcagcactgacattgtcccagccagcactggagctgccaaggctgtgtctctagtgttgccacagctgaagggcaagcttaatggaatagcgctccgtgtgcctacacccaatgtttcagttgttgaccttgttgtgaatgttga

SEQ ID NO: 2900 - DNA, 292 bp, Glycine max
  unsure (1)...(292): unsure at all n locations
  Clone ID: 700554330H1
gcggctcttgcttctacaaggatcccttcaaacacaaggttcccattccanggcctctacacttctttcccaacccaatgcgccttaaagagacttgaggtgacagaattctctgggcttagatccacttcatgtgtcacatatgctaacagtgctagagaatcttccttttttgatcttgtagcttcccaactcactcccaacaccaatggatcaactcctgtgaggggagagacagtggccaagttgaaggtggcaatcaatggtttcggacgcattggtagaaattccc

SEQ ID NO: 2901 - DNA, 236 bp, Glycine max
  Clone ID: 700746738H1
gagatcccatgggggtcaactggagctgacatcattgttgagtccaccggagttttcaccgataaggacaaggccgccgcacatttcaagggtggtgcaaagaaggttattatttctgcccccagtaaggatgcccccatgtttgttgttggtgtcaacgagcacgagtacaagccagagcttgatattatttccaatgctagctgcacaaccaactgccttgccccacttgccaa

SEQ ID NO: 2902 - DNA, 250 bp, Glycine max
  Clone ID: 700962884H1
gcagcactggagctgccaaggctgttggaaaagtccttcctgctttgaacggaaaattgactggtatggcattccgtgttcccaccgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgactttgtgggcgatacagatca

SEQ ID NO: 2903 - DNA, 274 bp, Glycine max
  Clone ID: 700683756H1
tggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaaggtggcaatcaatgg

SEQ ID NO: 2904 - DNA, 240 bp, Glycine max
  Clone ID: 700898676H1
gttgttggtgttaacgagcacgagtacaagccagagcttgacattatttccaatgctagctgcacaaccaactgccttgccccgctcgccaaggttatcaatgacaggtttggcattgttgagggtttgatgaccactgttcattccatcactgctacccagaagactgttgatgggccatcagccaaagactggagaggtggaagagctgcttcatttaacatcattcctagcagcact

SEQ ID NO: 2905 - DNA, 251 bp, Glycine max
  Clone ID: 700685076H1
tgtaaatgaaggggactacactcatcagatctctaacattataagcaacgcttcctgcaccacaaactgtcttgctccctttgtgaagatcctggatgaagagtttggaattgtgaagggaaccatgacaaccacacattcctacacaggagaccagaggcttttggatgcttcacaccgtgacttgagaagagccagggctgcagcactgaacattgtcccaaccagcactggagctgccaaggctgtgt

SEQ ID NO: 2906 - DNA, 261 bp, Glycine max
  Clone ID: 700836262H1
ttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaa

SEQ ID NO: 2907 - DNA, 232 bp, Glycine max
  Clone ID: 700674865H1
cacgagtacaagcgagagcttgatattattataaatgctagctgcacaactaactgccttgccccacttgccaaggttatcaatgacaggtttggcattgttgagggtttgatgaccactgttcattccataccgctacccagtagactgttgatggaccatcagccaaggactggagaggtggaagagctgcttcatttaacatcattcctagcagcactggagctgccaa

SEQ ID NO: 2908 - DNA, 270 bp, Glycine max
  Clone ID: 700967318H1
acggctgcgagaagacgacagaaggggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagcaacgcatcctgcaccacaaactgtcttgctccctttgtgaagatcctggatgcagagtttggaattgtgaagggaccatgaca

SEQ ID NO: 2909 - DNA, 248 bp, Glycine max
  Clone ID: 700955044H1
caagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagaga

SEQ ID NO: 2910 - DNA, 233 bp, Glycine max
  Clone ID: 700755131H1
gatcttgtagcttcccaactcactcccaagaccaatggatcaactcctgtgaggggagagacagtggccaagttgaaggtggcaatcaatggtttcggacgcattggtagaaacttccttcgctgctggcacggccgaaaagactcaccccttgaagtcgttcttgtcaacgacagtggtggtgtcaagaatgcttcgcacctgctgaaatatgattctatgctgggaacctt

SEQ ID NO: 2911 - DNA, 254 bp, Glycine max
  Clone ID: 700743643H1
aatattccaacttatgttgtcggagtaaatgaaggggactacactcatgagatctctaacattataagcaacgcttcctgcaccacaaactgtcttgctccctttgtgaagatcctggatgcagagtttggaattgtgaagggaaccatgacaaccacgcattcctacactggagaccagaggcttttggatgcttcacaccgtgacttgagaagagccagggctgcagcacttaacattgtcccaaccagcac

SEQ ID NO: 2912 - DNA, 251 bp, Glycine max
  unsure (1)...(251): unsure at all n locations
  Clone ID: 700979861H2
anaggatgnccccatgtttgttgttggtgttaacgagcacgagtacaagccagagcttgacattatttgccaatgctagctgcacaaccaactgccttgccccgctcgccaaggttatcaatgacaggttnggcattntttgagggtttgatgaccactgttcattccatcactgctacccagncagactgttgatgggccatcagccaaagactggagaggtggaagagctgcttcatttnacatcattc

SEQ ID NO: 2913 - DNA, 254 bp, Glycine max
  Clone ID: 700907981H1
ggatgtctctgttgttgacctcacagtgaggctggagaaagaagcttcctacgatgaaattaaaaatgctatcaaggaggaatcagagggcaagttgaagggaattcttggttacactgaagatgatgtggtctccactgactttatcggcgatagcagatcaagtatttttgatgcaaaggctaaaattgcattgaataagaactttgtgaagcttgtttcttggtacgacaacgagtgggatacagctcacg

SEQ ID NO: 2914 - DNA, 290 bp, Glycine max
  Clone ID: 701001058H1
ccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaatcaatggtttcggacgc

SEQ ID NO: 2915 - DNA, 276 bp, Glycine max
  unsure (1)...(276): unsure at all n locations
  Clone ID: 700547949H1
cgnaggggactacactcatcagatctctaacattataagcnaacgcttcctgcaccacaaactgtccttgctccctttgtgaanatcctggatgaagantttggaattgtgaagggaaccatgacaaccacacattcctacacaggagancagaggcttttggatgcttcacaccgtgacttgagaagagccanggctgcagcactgaacattgtcccaaccagcactggagctgccaaggctgtgtctcnagtgttgccacagctgaagggcaag

SEQ ID NO: 2916 - DNA, 265 bp, Glycine max
  Clone ID: 700678780H1
tgttaacgagcacgagtacaagccagagcttgatattatttccaatgctagctgcacaaccaactgccttgctccacttgctaaggttattaatgacaggtttggcattgttgagggtttgatgaccactgttcattccatcactgccacccagaagactgttgatgggccatcagccaaagactggagaggtggaagagctgcttcatttaacatcattcctagcagcactggagctgccaaggctgttggaaaagtccttcct

SEQ ID NO: 2917 - DNA, 241 bp, Glycine max
  Clone ID: 700851960H1
gttcccaccgtggatgtctctgttgttgacctcacagtgaggctggagaaagaagcttcctacgatgaaattaaaaatgctatcaaggaggaatcagagggcaagttgaagggaattcttggttacactgaagatgatgtggtctccactgactttatcggcgatagcagatcaagtatttttgatgcaaaggctggaattgcattgaataagaactttgtaaagcttgtttcttggtacg

SEQ ID NO: 2918 - DNA, 249 bp, Glycine max
  Clone ID: 701099668H1
tggcagcatcacgatgtcaccgttaaggacgagaagacccttctcttcggtgacaaggcagtcactgtttttggacacagaaaccctgaagagatcccatgggggtcaactggagctgacatcattgttgagtcaccggagttttcaccgataaggacaaggctgccgcacatttgaagggtggtgccaagaaggttattatttctgcccccagtaaggatgcccccatgtttgttgttggtgttaatg

SEQ ID NO: 2919 - DNA, 288 bp, Glycine max
  Clone ID: 701103733H1
ccacagtgaggctggagaaggaagcctcctacgatgaaattaaaaatgctatcaaggaggaatcagagggcaagttgaagggaattcttggttacactgaagatgatgtggtctccaccgactttgtgggcgatagcagatcaagtatttttgatgcaaaggctggaattgcattgaataagaactttgtgaagcttgtctcttggtatgacaacgagtggggatacagctcacgtgtcattgacctgcttgtattcgttgccaagaagtctttttaaggttgtactg

SEQ ID NO: 2920 - DNA, 283 bp, Glycine max
  Clone ID: 700985604H1
gctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggaca

SEQ ID NO: 2921 - DNA, 245 bp, Glycine max
  Clone ID: 700849622H1
cggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggt

SEQ ID NO: 2922 - DNA, 267 bp, Glycine max
  Clone ID: 700752648H1
gactctggaagcatcacgatgtcaccgttaagacgagaagacccttctcttcggtgacaagccagtcactgtttttggacacaggaaccctgaagagatcccatgggggtcaactggagctgatatcattgttgagtccaccggagttttcaccgataaggacaaggcagccgcacatttgaagggtggtgcgaagaaggttattatttctgcccccagtaaggatgcccccatgtttgttgttggtgttaacgagcacagtacaag

SEQ ID NO: 2923 - DNA, 238 bp, Glycine max
  Clone ID: 700952882H1
ttgttattgagggaacgggagtgtttgtggatggccctggggctggcaaacacatccaagcaggtgctaagaaggttatcatcactgctccagcaaagggtgctgatattccaacttatgttgtcggagtaaatgaaggggactacactcatgagatctctaacattataagcaacgcttcctgcaccacaaactgtcttgctccctttgtgaagatcctggatgcagagtttggaat

SEQ ID NO: 2924 - DNA, 233 bp, Glycine max
  Clone ID: 701006721H1
gccagtcactgtttttggacacaggaaccctgaagagatcccatgggggtcaactggagctgatatcattgttgagtccaccggagttttcaccgataaggacaaggccgccgcacatttgaagggtggtgcgaagaaggttattatttctgcccccagtaaggatgcccccatttttgttgttggtgttaacgagcacgagtacaagccagagcttgatattatttccaatg

SEQ ID NO: 2925 - DNA, 244 bp, Glycine max
  Clone ID: 700895879H1
gttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggaca

SEQ ID NO: 2926 - DNA, 258 bp, Glycine max
  Clone ID: 700740632H1
ggatcatcaactcctgtgaggggagagacagtggccaagttgaaggtggcaatcaatggtttcggacgcattggtagaaacttccttcgctgtggcacggccgaaaagactcaccccttgaggtcgttgttgtcaacgacagtggtggtgtcaagaatgcttcgcacctgcttaaatatgattccatgctgggaacttttaaagcagatgtgaaaatactggacaatgaaaccatcactgttgatggtaagcccatca

SEQ ID NO: 2927 - DNA, 283 bp, Glycine max
  Clone ID: 700981723H1
gccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaatcaatggtt

SEQ ID NO: 2928 - DNA, 262 bp, Glycine max
  unsure (1)...(262): unsure at all n locations
  Clone ID: 700657114H1
agagctgcttcatttaacatcattcctagcagcactggagctgccaaggctgttggaaaagtcntccctgctttgaatggaaaattgactggtatggcattccgtgttcccactgtggatgtctctgttgttgacctcacagtgaggctggagaaggaagcctcctacgatgaaattaaaaatgctatcaaggaggaatcagagggcaagttgaagggaatcttgttcactgaagatcatcnggctcacgacttttggcgaa

SEQ ID NO: 2929 - DNA, 335 bp, Glycine max
  unsure (1)...(335): unsure at all n locations
  Clone ID: 700661319H1
gaaggaagcctcatatgatgaaattaaaaatgctatcaaggaggaatcagagggcaanttgaagggaattcttggttacactgaagatgatgtggtctccaccgactttgttggtgataacagatcaagtatttttgangcaaaggctggaattgcattgaataagaattttgtgaagcttgtctcttggtatgacaacgagtggggatacagttcacgtgtcattgacctgcttgtaatcgttgccaagaagtcttttaattaaggtggttctaacattagtgctggtcagctgcgatttagtgtctgctcgtgcaaaaattgagaagtatgaa

SEQ ID NO: 2930 - DNA, 280 bp, Glycine max
  Clone ID: 700987848H1
gctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttgg

SEQ ID NO: 2931 - DNA, 246 bp, Glycine max
  Clone ID: 700664376H1
cggtgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatggaagtcgactggagctgacatcattgttgagtccaccggagttttcaccgataagga

SEQ ID NO: 2932 - DNA, 253 bp, Glycine max
  Clone ID: 700848760H1
cggatttggaagaattggccgtttggttgccagattcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactgga

SEQ ID NO: 2933 - DNA, 225 bp, Glycine max
  Clone ID: 700734932H1
tcggcgattcggctcacaaggttatcaatgacaggattggcattgttgagggtttgatgaccactgttcattccatcaccgctacccagaagactgttgatggaccatcagccaaggactggagaggtggaagagctgcttcatttaacatcattcctagcagcactggagctgccaaggctgttgggaaagtcctccctgctttgaatggaaaattgactggta

SEQ ID NO: 2934 - DNA, 243 bp, Glycine max
  Clone ID: 700894550H1
gaagacccttctcttcggtgacaaggcagtcactgtttttggacacagaaaccctgaagagatcccatgggggtcaactggagctgacatcattgttgagtccaccggagttttcaccgataaggacaaggctgccgcacatttgaagggtggtgccaagaaggttattatttctgcccccagtaaggatgcccccatgtttgttgttggtgttaatgagcacgagtacaagcagagcttgat

SEQ ID NO: 2935 - DNA, 294 bp, Glycine max
  Clone ID: 700754237H1
tgggcaaggtcaagatcggaatcaacggatttggaagaattggccgtttggtggccagggtggctctgcagagagacgatgttgaactcgttgccgttaacgatcctttcattaccaccgattacatgacctacatgtttaaatacgacagtgttcacgggcactggaagcatcacgatgtcaccgttaaggatgagaagacccttctcttcggtgacaagccagtcactgtttttggacacaggaaccctgaagagatcccatggaagtcgactggagctgacatcattgttg

SEQ ID NO: 2936 - DNA, 269 bp, Glycine max
  unsure (1)...(269): unsure at all n locations
  Clone ID: 700654194H1
gctccgcaattatcatgggcaaggtcnagatcggaatcaacggatttggaagaattggccgtttggtagccagagtggctctgcagagagacgatgttgaactcgttgccgttaacgaccctttcatcaccaccgttacatgaagnacatgtttaaatacgacagtgttcatggacactggaagcatcacgatgtcaccgttaaggacgagaagacccttctcttcggtgacaagccagtcactatttttggacacagaaaccctgaag

SEQ ID NO: 2937 - DNA, 251 bp, Glycine max
  unsure (1)...(251): unsure at all n locations
  Clone ID: 701002119H1
tttaaagcagatgtgaaaatactggacaatgaaaccatgcactgttgatggtaagaccatcaaggttgtttcaagcagggaccctcttaagcttccttgggctgaacttggaattgacattgttattgagggaaccggagtgtttgtgncatggccctggggctggtaaacacatccaancaggtgccaagaaagttattatcactgctcctgcaaagggtgctgatattccaattatgttgttggtgtaa

SEQ ID NO: 2938 - DNA, 242 bp, Glycine max
  Clone ID: 700899445H1
ctcctgtgaggggagagacagtggccaagttgaaggtggcaatcaatggtttcggacgcattggtagaaacttccttcgctgctggcacggccgaaaagactcaccccttgatgtcgttgttgcaacgacagtggtggtgtcaagaatgcttcgcacctgcttaaatatgattccatgctgggaacttttaaagcagatgtgaaaatactggacaatgaaaccatcactgttgatggtaagc

SEQ ID NO: 2939 - DNA, 363 bp, Glycine max
  unsure (1)...(363): unsure at all n locations
  Clone ID: 700648324H1
gtctcaacttctgctcttccaactcctacaacgcttttctctgcactcatgggcaaggtcaagatcggaatcaacggatttggaagaattgggccgtttggttgccagantcgctctgcaaagagacgatgttgaactcgttgccgttaacgaccctttcattaccaccgattacatgacatacatgtttaaatacgacancgttcacggacactggaagcatcacgatgtcacggttaaggcnaagagncccntctnctcggtgacnaaggnagtaatgtttttggacacagaaacctgaagagatcccatgggggtcaactggagctgacatcattgttgagtccaccggagttttcaccg

SEQ ID NO: 2940 - DNA, 252 bp, Glycine max
  Clone ID: 700897837H1
caaggctgttgggaaagtcctccctgctttgaatggaaaattgactggtatggcattccgtgttcccaccgtggatgtctctgttgttgacctcacagtgaggctggagaaagaagcttcctacgatgaaattaaaaatgctatcaaggaggaatcagagggaagttgaagggaattcttggttacactgaagatgatgtggtctccactgactttatcggcgatagcagatcaagtattttgatgcaaagg

SEQ ID NO: 2941 - DNA, 299 bp, Glycine max
  Clone ID: 701056234H1
caacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaaacccttctcttcggtgacaagccagtcactatttttggacacagaaa

SEQ ID NO: 2942 - DNA, 242 bp, Glycine max
  Clone ID: 700906196H1
gccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatcccatgggggtcaactggagctgatatcattgttga

SEQ ID NO: 2943 - DNA, 261 bp, Glycine max
  Clone ID: 701002126H1
catggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaa

SEQ ID NO: 2944 - DNA, 244 bp, Glycine max
  Clone ID: 700853304H1
atcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggac

SEQ ID NO: 2945 - DNA, 230 bp, Glycine max
  Clone ID: 701015618H1
agacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtgcaaagaaggttattatttctgcccccagtaaggatgcccccatgtttgttgttggtgtcaacgagcacgagtacaag

SEQ ID NO: 2946 - DNA, 245 bp, Glycine max
  Clone ID: 700875928H1
cggctcgagccttgatgggcttaccatcaaggttgtttcaagcagggaccctcttaagcttcattgggctgaacttggaattgacattgttattgagggaaccggagtgtttgtggatggccctggggctggtaaacacatccaagcaggtgccaagaaagttattatcactgctcctgcaaagggtgctgatattccaacttatgttgttggtgtaaatgaaggggactacactcatcagatct

SEQ ID NO: 2947 - DNA, 245 bp, Glycine max
  Clone ID: 700676860H1
cgacagtgttcatggacactggaagcatcacgatgtcaccgttaaggacgagaagacccttctcttcggtgacaagccagtcactatttttggacacagaaaccctgaagagatcccatgggggtcactggagctgacatcattgttgagtccaccggagttttcaccgataaggacaaggccgccgcacatttgaagggtggtgcaaagaaggttattatttctgcccccagtaaggatgcccc

SEQ ID NO: 2948 - DNA, 291 bp, Glycine max
  unsure (1)...(291): unsure at all n locations
  Clone ID: 700983517H1
gcattgttgagggtttgatgaccactgttcattccatcactgccacccagaagactgttgatgggccatcagccaaagactggagaggtggaagagctgcttcatttaacatcattcctagcagcactggagctgccaaggctgttggaaaagtcttcctgctttgaacggaaaattgactggtatggcattccgtgttcccaccgtggatgtctctgttgttgaccttcacagtgaggcnggagaaggnagctcctaagatggaatnanaatgntattcnaggnngaatt

SEQ ID NO: 2949 - DNA, 253 bp, Glycine max
  Clone ID: 700841881H1
attccgtgttcccaccgtggatgtctctgttgttgacctcacagtgaggctggagaaagaagcttcctacgatgaaattaaaaatgctatcaaggaggaatcagagggcaagttgaagggaattcttggttacactgaagatgatgtggtctccactgactttatcggcgatagcagatcaagtatttttgatgcaaaggctggaattgattgaataagaactttgtgaagcttgtttcttggtacgacaacg

SEQ ID NO: 2950 - DNA, 253 bp, Glycine max
  Clone ID: 700853082H1
cttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacacttgaagcatcacgatgtcaccgttaaggacgagaagacccttctcttcggtgacaagccagtcactgtttttg

SEQ ID NO: 2951 - DNA, 277 bp, Glycine max
  Clone ID: 701106263H1
gatattccaacttatgttgttggtgtaaatgaaggggactacactcatcaggtctctaacattataagcaacgcttcctgcaccacaaactgtcttgctccctttgtgaagatcctggatgaagagtttggaattgtgaagggaaccatgacaaccacacattcctacacaggagaccagaggcttttggatgcttcacaccgtgacttgagaagagccagggctgcagcactgaacattgtcccaaccagcactggagctgccaaggctgtgtctc

SEQ ID NO: 2952 - DNA, 242 bp, Glycine max
  Clone ID: 700678241H1
tggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtgcaaagaaggttattatttctgcccccagtaaggatgcccccatgtttgttgttgg

SEQ ID NO: 2953 - DNA, 272 bp, Glycine max
  Clone ID: 701133107H1
gctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcact

SEQ ID NO: 2954 - DNA, 281 bp, Glycine max
  unsure (1)...(281): unsure at all n locations
  Clone ID: 700976170H1
gctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatnncatacatgtttaaatacgacagtgttcatggacactggaagcatcacgatgtcaccgttaaggacgagaagacccttctcttcggtgacaagccagtcactatttttggt

SEQ ID NO: 2955 - DNA, 287 bp, Glycine max
  Clone ID: 700646259H1
aaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaaggtggcaata

SEQ ID NO: 2956 - DNA, 268 bp, Glycine max
  Clone ID: 700682750H1
cactttcttttttcccgcagtcatgggcaaggtcaagatcggaatcaacggatttggaagaattggccgtttggtggccagggtggctctgcagagagacgatgttgaactcactgccgttaacgatcctttcattatcaccgattacatgacatacatgtttaaatacgacagtgttcacgggcactggaagcatcacgatgtcaccgttaaggctgagaagacccttctcttcggtgacaagccagtcactgtttttggacacagg

SEQ ID NO: 2957 - DNA, 288 bp, Glycine max
  Clone ID: 700556141H1
tagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaat

SEQ ID NO: 2958 - DNA, 234 bp, Glycine max
  Clone ID: 700870652H1
gaaggggactacactcatcagatctctaacattataagcaacgcttcctgcaccacaaactgtcttgctccctttgtgaagatcctggatgaagagtttggaattgtgaagggaaccatgacaaccacacattcctacacaggagaccagaggcttttggatgcttcacaccgtgacttgagaagagccagggctgcagcactgaacattgtcccaaccagcactggagctgcc

SEQ ID NO: 2959 - DNA, 237 bp, Glycine max
  Clone ID: 700893834H1
caagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaa

SEQ ID NO: 2960 - DNA, 278 bp, Glycine max
  unsure (1)...(278): unsure at all n locations
  Clone ID: 700970819H1
ccgcacttctgctccgcaattatcatgggcaaggtcaagatcggaatcaacggatttngaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagttcactatttttggacacagaaaccctg

SEQ ID NO: 2961 - DNA, 252 bp, Glycine max
  Clone ID: 700890650H1
ccagaagactgttgatgggccatcagccaaagactggagaggtggaagagctgcttcatttaacatcattcctagcagcactggagctgccaaggctgttggaaaagtcctccctgctttgaatggaaaattgactggtatggcattccgtgttcccactgtggatgtctctgttgttgacctcacagtgaggctggagaaggaagctcctacgtggaaattaaaaatgtatcaaggaggaatcagagggca

SEQ ID NO: 2962 - DNA, 253 bp, Glycine max
  Clone ID: 701122211H1
gcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggccaca

SEQ ID NO: 2963 - DNA, 274 bp, Glycine max
  unsure (1)...(274): unsure at all n locations
  Clone ID: 700980742H1
cttctgctcttccaactcctacaacgcttttctctgcactcatggncaaggtcaagatcggaatcaacggatttggaagaattggccgtttggttgccagantcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgt

SEQ ID NO: 2964 - DNA, 264 bp, Glycine max
  Clone ID: 701137606H1
ctcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttg

SEQ ID NO: 2965 - DNA, 257 bp, Glycine max
  Clone ID: 700682612H2
ggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttga

SEQ ID NO: 2966 - DNA, 282 bp, Glycine max
  Clone ID: 700971830H1
caacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcat

SEQ ID NO: 2967 - DNA, 280 bp, Glycine max
  Clone ID: 700909405H1
aacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtca

SEQ ID NO: 2968 - DNA, 293 bp, Glycine max
  Clone ID: 700981291H1
cttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcatatttttggacacagaaaccctgaaga

SEQ ID NO: 2969 - DNA, 239 bp, Glycine max
  Clone ID: 700953564H1
ccgttaaggacgagaagacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtgcaaagaaggttattatttctgcccccagtaaggatgcccccaagttggtggtgggtgtcaacgagcacgag

SEQ ID NO: 2970 - DNA, 245 bp, Glycine max
  Clone ID: 700747612H1
cccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttt

SEQ ID NO: 2971 - DNA, 255 bp, Glycine max
  unsure (1)...(255): unsure at all n locations
  Clone ID: 700975021H1
ggacgagaagacccttctcttcggtgacaagccagtcactatttttggacacagaaaccctgaagagatcccatgggggtcaactggagctgacatcattgttgagtccaccggagttttcaccgataaggcaaggccgccgcacatttgaagggtggtgcaaagaaggttattatttctgcccccagtaaggatgcccccatgtttgttgttggtgtcaacgagcacgagtacaagccaganttgntattattc

SEQ ID NO: 2972 - DNA, 257 bp, Glycine max
  Clone ID: 700729321H1
ctcgagccgtttgtggatggccctggggctggtacacacatccacgcaggtgccaagaaagttattatcactgctcctgcaaagggtgctgatattccaacttatgttgttggtgtaaatgaaggggactacactcatcagatctctaacattatcagcaacgcttcctgcaccacaaactgtcttgctccctttgtgaagatcctggatgaagagtttggaattgtgaagggaaccatgacaaccacacattccta

SEQ ID NO: 2973 - DNA, 279 bp, Glycine max
  Clone ID: 701001137H1
cagccatggccacccacgcggctctagcttctacaaggatccccactaacaccaagttccccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaatc

SEQ ID NO: 2974 - DNA, 277 bp, Glycine max
  unsure (1)...(277): unsure at all n locations
  Clone ID: 700554280H1
ctgaacattgtcccaaccagcactggagctgccaaggctgtgtcactagtgttgccacagctgaagggcaagcttaatggaatagcgctccgtgtgcctacacccaatgtttcagttgttgaccttgttgngaatgttgagaagaagggtctactgctgaagatgtgaatgcagcattcagaaaggcagctgagggtccactgaaaggtgtgttggactgtgtgatgttccactgtgtctatcgactccgctgctctgagtttcctctatattgact

SEQ ID NO: 2975 - DNA, 255 bp, Glycine max
  Clone ID: 701135387H1
ggaagaattggccgtttggtggccagggtggctctgcagagagacgatgttgaactcgttgccgttaacgatcctttcattaccaccgattacatgacatacatgttccaatacgacagtgttcacgggcactggaagcatcacgatgtcaccgttaaggatgagaagacccttctcttcggtgacaagccagtcactgtttttggacacaggaaccctgaagagatcccatggaagtcgactggagctgacatc

SEQ ID NO: 2976 - DNA, 262 bp, Glycine max
  Clone ID: 700655905H1
aagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtgcaaagaagttattatttctgcccccagtaaggatgcccccatgtttgttgttggtgtcaagagcacgagtacaagcca

SEQ ID NO: 2977 - DNA, 259 bp, Glycine max
  Clone ID: 701048613H1
cttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaag

SEQ ID NO: 2978 - DNA, 280 bp, Glycine max; identical to SEQ ID NO: 2930
  Clone ID: 701062603H1

SEQ ID NO: 2979 - DNA, 252 bp, Glycine max
  Clone ID: 700741884H1
ctcgagccgaatcggctcgagcggatttggaagaattggccgtttcgtagccagagtggctatgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagagaccctgaaga

SEQ ID NO: 2980 - DNA, 288 bp, Glycine max
  Clone ID: 701014048H1
gctggtcgacggctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcac

SEQ ID NO: 2981 - DNA, 272 bp, Glycine max
  Clone ID: 700556774H1
ttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggc

SEQ ID NO: 2982 - DNA, 273 bp, Glycine max
  Clone ID: 701212143H1
acaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagc

SEQ ID NO: 2983 - DNA, 284 bp, Glycine max
  unsure (1)...(284): unsure at all n locations
  Clone ID: 700977724H1
acaacttctgctacttcctactccaaccgcactncctgctccgcaattatcatgggcaaggtcaagatcggtatcaacggatttggaagaattggccgtttggtagccagagtggctctgcagagagacgatgttgaactcgttgccgttaacgaccctttcatcaccaccgattacatgacatacatgtttaaatacgacagtnttcatggacactggaagcatcacgatgtcaccgttaaggacgagaagacccttctcttcggtgacaagccagtcactat

SEQ ID NO: 2984 - DNA, 254 bp, Glycine max
  Clone ID: 701052505H1
cactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactg

SEQ ID NO: 2985 - DNA, 267 bp, Glycine max
  Clone ID: 701048090H1
ggagaaggaagcctcatatgatgaaattaaaaatgctatcaaggaggaatcagagggcaagttgaagggaattcttggttatactgaagatgatgtggtctccaccgactttgttggtgataacagatcaagtatttttgatgcaaaggctggaattgcattgaataagaattttgtgaagcttgtctcttggtatgacaacgagtggggatacagttcacgtgtcattgacctgcttgtaatcgttgccaagaagtctttttaatt

SEQ ID NO: 2986 - DNA, 240 bp, Glycine max
  Clone ID: 700850111H1
gtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtacaaagaaggttattatttctccccc

SEQ ID NO: 2987 - DNA, 219 bp, Glycine max
  Clone ID: 700748768H1
gcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggactcgaagacccttctcttcggtgacaagc

SEQ ID NO: 2988 - DNA, 257 bp, Glycine max
  Clone ID: 701215404H1
ccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtt

SEQ ID NO: 2989 - DNA, 264 bp, Glycine max
  Clone ID: 700686206H1
aagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagt

SEQ ID NO: 2990 - DNA, 273 bp, Glycine max
  unsure (1)...(273): unsure at all n locations
  Clone ID: 701137704H1
ctcttcttccaagtccaancacgcttttctctacagtcatgggcaaggtcaagatcggaatcaacggatttggaagaattggccgtttggttgccagantcgctctgcaaagagacgatgtggagctcgttgccgttaacgaccctnncattaccaccgattacatgacatacatgtttaaatacgacagtgttcacggacactggaagcatcacgatgtcaccgttaaggacgagaagacccttctcttcggtgacaagccagtcactgttt

SEQ ID NO: 2991 - DNA, 237 bp, Glycine max
  Clone ID: 700876594H1
gagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttg

SEQ ID NO: 2992 - DNA, 195 bp, Glycine max
  Clone ID: 700743816H1
ttttaaagcagatgtgaaaatactggacaatgaaaccatcactgttgatggtaagcccatcaaggttgtttcaagcagggaccctcttaagcttccttgggctgaacttggaattgacattgttattgagggaaccggagtgtttgtggatggccctggggctggtaaacacatccaagcaggtgccaagaaagt

SEQ ID NO: 2993 - DNA, 275 bp, Glycine max
  Clone ID: 701037342H1
ctttcttttttcccgcagtcatgggcaaggtcaagatcggaatacacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacagaaccctgaag

SEQ ID NO: 2994 - DNA, 236 bp, Glycine max
  Clone ID: 700853152H1
gagatcccatgggggtcaactggagctgacatcattgttgagtccaccggagttttcacccgtaaggacaaggccgccgcacatttgaagtgtagtgcaaagaaggttattatttctgcccccagtaaggatgcccccatgtttgttgttggtgtcaacgagcacgagtacaagccagagcttgatattatttccaatgctagctgcacaaccaactgccttgccccacttgccaa

SEQ ID NO: 2995 - DNA, 252 bp, Glycine max
  Clone ID: 700905876H1
gctccgcaattatcatgggcaaggtcaagatcggaatcaacggatttggaagaattggccgtttggtagccagagtggctctgcagagagacgatgttgaactcgttgccgttaacgaccctttcataccaccgattacatgacatacatgtttaaatacgacagtgttcatggacactggaagcatcacgatgtcaccgttaaggatgagaagacccttctcttcggtgacaagccagtcactatttttgg

SEQ ID NO: 2996 - DNA, 254 bp, Glycine max
  Clone ID: 700790719H1
ccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaatcatcacgatgtcaccgttaaggatgagaagacccttctcttcggtgacaagccagtcactgtttttggacacagg

SEQ ID NO: 2997 - DNA, 266 bp, Glycine max
  Clone ID: 701106994H1
aacaacttctgctactttctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcgg

SEQ ID NO: 2998 - DNA, 232 bp, Glycine max
  Clone ID: 700752366H1
ctccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaaga

SEQ ID NO: 2999 - DNA, 259 bp, Glycine max
  Clone ID: 700952951H1
aaaaatgctatcaaggaggaatcagagggcaagttgaagggaattcttggttacactgaagatgatgtggtctccaccgactttgttggtgataacagatcaagtatttttgatgcaaaggctggaattgcattgaataagaattttgtgaagcttgtctcttggtatgacaacgagtggggatacagttcacgtgtcattgacctgcttgtaatcgttgccaagaagtctttttaattaaggtggttctaacattatg

SEQ ID NO: 3000 - DNA, 272 bp, Glycine max
  unsure (1)...(272): unsure at all n locations
  Clone ID: 700998563H1
cagggaccctcttaagcttccttgggctgaacttggaattgacattgttattgagggaaccggagtgtttgtggatggccctggggctggtaaacacatccaagcaggtgccaagaaagttattatcactgctcctgcaaagggtgctgatattccaacttatgttgttggtgtaaatgaaggggactacactcatcagatctctaancttattnagcnacgcttcctgcacccacaaanggtcttgccccccttgggaaccccccggaaaa

SEQ ID NO: 3001 - DNA, 258 bp, Glycine max
  Clone ID: 700840245H1
ctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcgg

SEQ ID NO: 3002 - DNA, 286 bp, Glycine max
  unsure (1)...(286): unsure at all n locations
  Clone ID: 700556140H1
caacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacanacatgtttaaatacgacagtgttcatggacactggaagcatcacgatgtcaccgttaaggacgagaagacccttctcttcggngacaagccagtcactattttt

SEQ ID NO: 3003 - DNA, 266 bp, Glycine max
  Clone ID: 701056981H1
ctctgctcttccaactcctacaacgctcttctctgcactcatgggcaaggtcaagatcggaatcaacggatttggaagaattggccgtttggacgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcag

SEQ ID NO: 3004 - DNA, 245 bp, Glycine max
  Clone ID: 700953045H1
aaaaatgctatcaaggaggaatcagagggcaagttgaagggaattcttggttacactgaagatgatgtggtctccaccgactttgttggtgataacagatcaagtatttttgatgcaaaggctggaattgcattgaataagaattttgtgaagcttgtctcttggtatgacaacgagtggggatacagttcacgtgtcattgacctgcttgtaatcgttgccaagaagtctttttaataaggtgg

SEQ ID NO: 3005 - DNA, 264 bp, Glycine max
  Clone ID: 701137408H1
tcttccaactcctacaacgcttttctctgcactcatgggcaaggtctagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcac

SEQ ID NO: 3006 - DNA, 268 bp, Glycine max
  Clone ID: 700972258H1
aacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtg

SEQ ID NO: 3007 - DNA, 270 bp, Glycine max
  Clone ID: 700980774H1
gaagactgttgatgggccatcagccaaagactgggtggcagtgatggaatgaacagtggtcatcaaaccctcaacaatgccacccagaagactgttgatgggccatcagccaaagactggagaggtggaagagctgcttcatttaacatcattcctagcagcactggagctgccaaggctgtcggaaaagtccttcctgctttgaacggaaaattgactggtatggcattccgtgttcccaccgtggatgtctctgttgttgacctcaca

SEQ ID NO: 3008 - DNA, 265 bp, Glycine max
  Clone ID: 700972064H1
caacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggt

SEQ ID NO: 3009 - DNA, 256 bp, Glycine max
  Clone ID: 700685812H1
acttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtga

SEQ ID NO: 3010 - DNA, 245 bp, Glycine max
  Clone ID: 700740477H1
cactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagc

SEQ ID NO: 3011 - DNA, 253 bp, Glycine max
  Clone ID: 701062012H1
actttcttttttcccgcagtcatgggcaaggtcaagatcggaatcaacggatttggaagaattggccgtttggtggccagggtggctctgcagagagacgatgttgaactcgttgccgttaacgatcctttcattacaccgattacatgacatacatgtttaaatacgacagtgttcacgggcactggaagcatcacgatgtcaccgttaaggatgagaagacccttctcttcggtgacaagccagtcactgt

SEQ ID NO: 3012 - DNA, 256 bp, Glycine max
  Clone ID: 701108736H1
accaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaatcaatggtttcggacgcattggtagaaact

SEQ ID NO: 3013 - DNA, 261 bp, Glycine max
  Clone ID: 701104521H1
tgaggctggagaaggaagcctcctacgatgaaattaaaaatgctatcaaggaggaatcagagggcaagttgaagggaattcttggttacactgaagatgatgtggtctccaccgactttgtgggcgatagcagatcaagtatttttgatgcaaaggctggaattgcattgaataagaactttgtgaagcttgtctcttggtatgacaacgagtggggatacagctcacgtgtcattgacctgcttgtattcgttgccaaga

SEQ ID NO: 3014 - DNA, 262 bp, Glycine max
  Clone ID: 700659833H1
agcttcctacgatgaaattaaaaatgctatcaaggaggaatcagagggcaagttgaagggaattcttggttacactgaagatgatgtggtctccactgactttatcggcgatagcagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgtt

SEQ ID NO: 3015 - DNA, 241 bp, Glycine max
  Clone ID: 700786076H2
ggcaagttgaagggaattcttggttacactgaagatgatgtggtctccactgactttatcggcgatacagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttacttcaaagtagcttgtcttcacatt

SEQ ID NO: 3016 - DNA, 266 bp, Glycine max
  unsure (1)...(266): unsure at all n locations
  Clone ID: 700666231H1
atgaaattaaaaatgctatcaaggaggaatcagagggcaagttgaagggaatnccttggttacactgaagatgatgtggtctccactgactttatcggcgatagcagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttacttcaaagtagct

SEQ ID NO: 3017 - DNA, 279 bp, Glycine max
  Clone ID: 700556330H1
gaaagttgttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggagagacagtggcc

SEQ ID NO: 3018 - DNA, 268 bp, Glycine max
  Clone ID: 700964614H1
ctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagcca

SEQ ID NO: 3019 - DNA, 276 bp, Glycine max
  Clone ID: 700985844H1
aacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagcca

SEQ ID NO: 3020 - DNA, 256 bp, Glycine max
  Clone ID: 701126134H1
cttcttccaagtccaaccacgcttttctctacagtcatgggcaaagtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgaca

SEQ ID NO: 3021 - DNA, 259 bp, Glycine max
  Clone ID: 700968036H1
ctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcttcacgatgtcaccgttaaggacgagaagaccttctcttcg

SEQ ID NO: 3022 - DNA, 263 bp, Glycine max
  Clone ID: 701110182H1
ctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtg

SEQ ID NO: 3023 - DNA, 264 bp, Glycine max
  Clone ID: 700995174H1
ctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtga

SEQ ID NO: 3024 - DNA, 268 bp, Glycine max
  Clone ID: 701044955H1
ggaggaatcagagggcaagttgaagggaattcttggttacactgaagatgatgtggtctccactgactttatcggcgatagcagatcaagtatttttgatgcaaaggctggaattgcattgaataagaactttgtgaagctgtttcttggtacgacaacgagtggggatacagctcacgtgtcattgatcttcttgtattcgttgccaagaagtctctttaaggtgttacttcaaagtagcttgtcttcacattattaccgtatgttt

SEQ ID NO: 3025 - DNA, 244 bp, Glycine max
  Clone ID: 701203714H2
tattcttggttacactgaagatgatgtggtctccaccgactttgtgggcgatagcagatcaagtatttttgatgcaaaggctggaattgcattgaataagaactttgtgaagcttgtctcttggtatgacaacgagtggggatacagctcacgtgtcattgacctgcttgtattcgttgccaagaagtctttttaaggttgtactgaaaaaaaagtagcttgtctagacattatgtgctggtgt

SEQ ID NO: 3026 - DNA, 243 bp, Glycine max
  Clone ID: 700847062H1
cccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgttctccaatacgacagtgttcacgggcactggaagcatcacgatgtcaccgttaaggatgagaagacccttctcttcggtgacaagccagtcactg

SEQ ID NO: 3027 - DNA, 249 bp, Glycine max
  Clone ID: 700876923H1
tggaagcttaagagggaacgggagtgtttgtggatggccctggggctggcaaacacatccaagcaggtgctaagacggtgatcatcactgctccagcaaagggtgctgatattccaactgatgttgtcggagtaaatgaaggggactacactcatgagatctctaacattataagcaacgcttcctgcaccacaaactgtcttgctccctttgtgaagatcctggatgcagagtttggaattgtgaagg

SEQ ID NO: 3028 - DNA, 245 bp, Glycine max
  Clone ID: 700738183H1
ctaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaatcaatggtttcgga

SEQ ID NO: 3029 - DNA, 289 bp, Glycine max
  Clone ID: 701001383H1
aaagttgttgtaaagccttgttgctgccatggccacccacgcggctcttgcttctacaaggatcccttcaaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagcagaccaatggatcaactcctgtgaggggagagacagtggccaagtt

SEQ ID NO: 3030 - DNA, 277 bp, Glycine max
  Clone ID: 700877113H1
cgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggca

SEQ ID NO: 3031 - DNA, 290 bp, Glycine max
  unsure (1)...(290): unsure at all n locations
  Clone ID: 700562672H1
ctagtctcaacttctgctcttccaactcctacaacgctnttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccttaaggacgagaagacccttctcttcggtgacaaggcagtcatgtttttggac

SEQ ID NO: 3032 - DNA, 247 bp, Glycine max
  Clone ID: 700956242H1
taaaaatgctatcaaggaggaatcagagggcaagttgaagggaattcttggttacactgaagatgatgtggtctccactgactttatcggcgtgagcagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttact

SEQ ID NO: 3033 - DNA, 284 bp, Glycine max
  Clone ID: 701058012H1
gatgaaattaaaaatgctatcaaggaggaatcagagggcaagttgaagggaattcttggttacactgaagatgatgtggtctccactgactttatcggcgatagcagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttacttcaaagtagcttgtcttcacattattacc

SEQ ID NO: 3034 - DNA, 252 bp, Glycine max
  Clone ID: 701070207H1
gtggtctccactgactttatcggcgatagagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttacttcaaagtagcttgtcttcacattattaccgtatgtttatgtttagctgcgatttagtgtcttgctcgagcaaa

SEQ ID NO: 3035 - DNA, 248 bp, Glycine max
  Clone ID: 700901724H1
gggaattcttggttacactgaagatgatgtggtctccactgactttatcggcgatagcagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttacttcaaagtagcttgtcttcacattattaccgtatgtttatg

SEQ ID NO: 3036 - DNA, 284 bp, Glycine max
  Clone ID: 700792920H1
caccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggcaagcagcctgttttgga

SEQ ID NO: 3037 - DNA, 266 bp, Glycine max
  Clone ID: 700964732H1
caccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcgg

SEQ ID NO: 3038 - DNA, 280 bp, Glycine max
  unsure (1)...(280): unsure at all n locations
  Clone ID: 700994809H1
cttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatncatgtttaaatacgacagtgttcacggacactggaagcatcacgatgtcaccgttaaggacgagaagacccttctcttcggtg

SEQ ID NO: 3039 - DNA, 271 bp, Glycine max
  Clone ID: 700987118H1
acaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaa

SEQ ID NO: 3040 - DNA, 266 bp, Glycine max
  Clone ID: 701007268H2
tcgaaccgcacttctgtaacgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggacgcatcacgatgtcaccgttaaggacgagaagacccttctcttcggtgacgagccagtcactattttt

SEQ ID NO: 3041 - DNA, 181 bp, Glycine max
  Clone ID: 700650971H1
catgtttgttgttggtgtcaacgagcacgagtacaagccagagcttgatattatttccaatgctagctgcacaaccaactgccttgccccacttgccaaggttatcaatgacaggtttggcattgttgagggtttgatgaccactgttcattccatcaccgctacccagaagactgttgat

SEQ ID NO: 3042 - DNA, 258 bp, Glycine max
  Clone ID: 700964742H1
ctcaacttctgctcttccaactcctacaacgcttttctctgcactcatgggcaaggtcaagatcggaatcaacggatttggaagaattggccgtttggttgacagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctctt

SEQ ID NO: 3043 - DNA, 262 bp, Glycine max
  Clone ID: 700662524H1
aacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctct

SEQ ID NO: 3044 - DNA, 253 bp, Glycine max
  Clone ID: 700895349H1
tccaacttatgttgttggtgtaaatgaaggggactacactcatcagatctctaacattatgagcaacgcttcctgcaccacaaactgtcttgctccctttgtgaagatcctggatgaagagtttggaattgtgaagggaaccatgacaaccacacattcctacacaggagaccagaggcttttggatgcttcacaccgtgacttgagaagagccagggctgcagcactgaacattgtcccaaccagcactgga

SEQ ID NO: 3045 - DNA, 265 bp, Glycine max
  Clone ID: 701008593H1
ccactttctattttcccgcagtcatgggcaacgtcaagatcggaatcaacggatttggaagaattggccgtttggtggccagggtggctcttcagagagacgatgttgaactcgttgccgttaacgatcctttcattaccaccgattacatgacatacatgtttcaatacgacagtgttcacgggcactggaagcatcacgatgtcaccgttaaggatgagaagacccttctcttcggtgacaagccagtcactgtttttggaca

SEQ ID NO: 3046 - DNA, 267 bp, Glycine max
  Clone ID: 701004062H1
ggtagccagagtggctctgcagagagacgatgttgaactcgttgccgttaacgaccctttcatcaccaccgattacacgacatacatgtttcaataccacagtgttcatggacactggaagcatcacgatgtcaccgttaaggacgagcagacccttctcttcggtgacaagccagtcactatttttggacacagaaaccccgaagagatcccatgggggtcaactggagctgacatcattgttgagtccaccggagttttcaccga

SEQ ID NO: 3047 - DNA, 265 bp, Glycine max
  Clone ID: 700731710H1
ttcttttttcccgcagtcatgggcaaggtcaagatcggaatcaacggatttggaagaattggccgtttggtggccagggtggctctgcagagagacgatgttgaactcgttgccgttaacgatcctttcattaccaccgatacatgacatacatgtttaaatacgacagtgttcacgggcactggaagcatcacgatgtcaccgttaaggatgagaagacccttctcttcggtgacaagccagtcactgtttttggacacaggaa

SEQ ID NO: 3048 - DNA, 254 bp, Glycine max
  Clone ID: 700742019H1
ctcgagccgtttcttttttcccgcagtcatgggcaaggtcaagatcggaatcaacggatttggaagaattggccgtttggtggccagggtggctctgcagagagacgatgttgaactcgttgccgttaagatcctttcattaccaccgattacatgacatacatgtttaaatacgacagtgttcacgggcactggaagcatcacgatgtcaccgttaaggatgagaagacccttctcttcggtgacaagccagt

SEQ ID NO: 3049 - DNA, 246 bp, Glycine max
  Clone ID: 700944396H1
tttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagt

SEQ ID NO: 3050 - DNA, 269 bp, Glycine max
  Clone ID: 701139717H1
tcctactccaaacagtttcttttttcccgcagtcatgggcaaggtcaagatcggaatcaacggatttggaagaatataagtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttt

SEQ ID NO: 3051 - DNA, 297 bp, Glycine max
  Clone ID: 700555467H1
cttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatccaactcctgtgaaggggagagacagtggccaagttgaaggtggcatcaatggtttcgg

SEQ ID NO: 3052 - DNA, 269 bp, Glycine max
  Clone ID: 701041622H1
cttggttacactgaagatgatgtggtctccactgactttatcggcgatagcagatcaagtatttttgatgcaaaggctggaattgcattgaataagaactttgtgaagcttgtttcttggtacgacaacgagtggggatacagctcacgtgtcattgatcttcctgtattcgttgccaagaagtctctttaaggtgttacttcaaagtatcttgtcttcacattattaccgtatgtttatgtttagctgcgatttagtgtcttgctcga

SEQ ID NO: 3053 - DNA, 247 bp, Glycine max
  Clone ID: 700736350H1
aaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctctcggtgacaagc

SEQ ID NO: 3054 - DNA, 277 bp, Glycine max
  Clone ID: 700996720H1
tttctcaacaacttctgctacttcctactccaaccgcacttctgctccgcaattatcatgggcaaggtcaagatccgaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgaca

SEQ ID NO: 3055 - DNA, 283 bp, Glycine max
  unsure (1)...(283): unsure at all n locations
  Clone ID: 700987832H1
gctacttcctaactccaaccgcacttctgntccgcaattatcatgggcaaggtcaagatcggaatcancggatttggaagaattngncgtttggtagccagagtggctctgcagagagacgatgttgaactcgttgccgttaacgaccctttcatcaccaccgattacatgacatacatgtttaaatacgacagtgttcatgganactgnnngcatcacgatgtcaccgttancgnnnagangacncttctcttcggtgncaagcccgtcactntttttngag

SEQ ID NO: 3056 - DNA, 246 bp, Glycine max
  Clone ID: 700841935H1
tgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgagggg

SEQ ID NO: 3057 - DNA, 256 bp, Glycine max
  Clone ID: 700808443H1
aacttctgctcttccaactcctagaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgccatacatgtttaaatacgacattgttcacggacactggaagcatcaggatgtcaccgttaaggacgagaagacccttctcttc

SEQ ID NO: 3058 - DNA, 281 bp, Glycine max
  Clone ID: 700959733H1
aacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcac

SEQ ID NO: 3059 - DNA, 279 bp, Glycine max
  Clone ID: 700646537H1
ccactttcttttttcccgcagtcatgggcaaggtcaagatcggaatcaacggatttggaagaattggccgtttggtggccagggtggctctgcagagagacgatgttgaactcgttgccgttaacgatcctttcattaccacgattacatgacatacatgtttaaatacgacagtgttcacgggcactggaagcatcacgatgtcaccgttaaggatgagaagacccttctcttcggtgacaagccagtcactgtttttggacacaggaacctgaagag

SEQ ID NO: 3060 - DNA, 264 bp, Glycine max
  Clone ID: 701006244H2
ctcaacttctgctcttccaactcctacaacgcttttctctgcactcatgggcaaggtcaagatcggaatcaacggatttggaagaattggccgtttggttgccagagtcgctctgcaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgac

SEQ ID NO: 3061 - DNA, 268 bp, Glycine max
  Clone ID: 701059852H1
agagggcaagttgaagggaattcttggttacactgaagatgatgtggtctccactgactttatcggcgatagcagatcaagtatttttgatgcaaaggctggaattgcattgaataagaactttgtgaagcttgtttcttggtacgacaacgagtggggatacagctcacgtgtcattgatcttcttgtattcgttgccaagatctctctttaaggtgttacttcaaagtagcttgtcttcacattattaccgtatgtttatgtttag

SEQ ID NO: 3062 - DNA, 248 bp, Glycine max
  Clone ID: 700876815H1
cttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgt

SEQ ID NO: 3063 - DNA, 263 bp, Glycine max
  Clone ID: 700749752H1
ctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttct

SEQ ID NO: 3064 - DNA, 252 bp, Glycine max
  Clone ID: 700736445H1
caacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttc

SEQ ID NO: 3065 - DNA, 295 bp, Glycine max
  Clone ID: 700990431H1
atccacttcatgtgtgacatatgctaacgatgctagagaatcttccttttttgatcttgtagcttcccaactcactcccaagcagaccaatggatcatcaactcctgtgaggggagagacagtggccaagttgaaggtggcaatcaatggtttcggacgcattggtagaaacttccttcgctgctggcacggccgaaaagactcaccccttgacgtcgttgttgtcaacgacagtggtggtgtcaagaatgcttcgcacctgcttaaatatgattccatgctgggaattttaaag

SEQ ID NO: 3066 - DNA, 295 bp, Glycine max
  unsure (1)...(295): unsure at all n locations
  Clone ID: 700990414H1
tcatgtgtgacatatgctaacgatgctaganaatcttccttttttgatcttgtagcttcccaactncactcccaagaccaatggatcatcaactcctgtgaggggagagacagtggccaagttgaaggtggcaatcaatggtttcggacgcattggtagaaacttccttcgctgctggcacggccgaaaagactcaccccttgangtcgttgttgtcaacgacagtggtggtgtcaagaatgcttcgcacctgcttaaatatgattccatgctgggaattttaaagcagattgtg

SEQ ID NO: 3067 - DNA, 238 bp, Glycine max
  Clone ID: 700740171H1
cactttcttttttcccgcagtcatgggcaaggtcaagatcggaatcaacggatttggaagaattggccgtttggtggccagggtggctctgcagagagacgatgttgaactcgttgccgttaacgatcctttcattaccatcgattacatgacatacatgtttaaatacgacagtgttcacgggcactggaagcatcacgatgtcaccgttaaggatgagaagacccttctcttcggt

SEQ ID NO: 3068 - DNA, 248 bp, Glycine max
  unsure (1)...(248): unsure at all n locations
  Clone ID: 700875936H1
cggctcgatgcttgatgggtttaccatcgaggttgtttcaagcagggagcctcttaagcttccatcgggctagnatcttggaatgtgacatgtgttattgagtggaaccggagtgtttgtggatggccctgtggctggtaaacacatccaagcaggtgccaagaaagttattatcactgctcctgcaaagggtgctgatattccaacttatgttgttggtgtagatgaaggggactacactcagcaga

SEQ ID NO: 3069 - DNA, 258 bp, Glycine max
  Clone ID: 701132471H1
ttccaactcctacaacgcttttctctgaactcatgggcaaggtcaagatcggaatcaacggatttggaagaattggccgtttggttgccagactcgctctgcaaagagacgatgttgaactcgttgccgtaacgaccctttcattaccaccgattacatgacatacatgtttaaatacgacagtgttcacggacactggcagcatcacgatgtcaccgttaaggacgagaagacccttctcttcggtgacaaagcagt

SEQ ID NO: 3070 - DNA, 271 bp, Glycine max
  Clone ID: 701064163H1
cggctcgagttctagtttcccgcagtcatgggcaatgtcaagatcggaatcaacggatttggaagaattggccgtttggtggccagggtggctctgcagagagacgatgttgaactcgttgccgttaacgatcctttcattaccaccgattacatgacatacatgttccaatactcacagtgttcacgggcactggaagcatcacgatgtcaccgttaaggatgagaagacccttctcttcggtgacaagccagtcactgtttttggacac

SEQ ID NO: 3071 - DNA, 277 bp, Glycine max
  Clone ID: 701120529H1
gagaacttctgctacccactctcttcttccaagtccaaccacgctgttctcgacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgac

SEQ ID NO: 3072 - DNA, 279 bp, Glycine max
  Clone ID: 700787014H2
tttctcaacaacttctgctacgtcctactccaaccgcactctgttccgcaattatcatgggcaaggtcaagatcggaatcaacggatttagaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtacaagcc

SEQ ID NO: 3073 - DNA, 272 bp, Glycine max
  Clone ID: 701214833H1
aacttctgctacttcctactccaaccggacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagaccttctcttcggtgacaagcca

SEQ ID NO: 3074 - DNA, 267 bp, Glycine max
  Clone ID: 700741593H1
gtctcaacttctgctcttccaactcctacaacgcttttctctgcactcatgggcaaggtcaagatcggaatcaacggatttggaagaattggccgtttggttgccagattcgctctgcaaagagacgatgttgaactcgttgccgttaacgaccctttcattaccaccgattacatgacatacatgtttaaatacgacagtgttcacggacactggaagcatcacgatgtcaccgttaaggacgagaagaccttctcttcggtgaca

SEQ ID NO: 3075 - DNA, 239 bp, Glycine max
  Clone ID: 700792328H1
tgcaaaggctggaattgcattgaataagaactttgtgaagcttgtttcttggtacgacaacgagtggggatacagctcacgtgtcattgacctgcttgtattcgttgccaagaagtctttttaaggtggtgtactgcaaagttgcttgtctacacattatgtgcttgtctagttgcgatttagtgtcttgctcgtgcaaaaaatgagaggtctgaataaatcggtttctggaaccagtg

SEQ ID NO: 3076 - DNA, 250 bp, Glycine max
  Clone ID: 700838427H1
caacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgag

SEQ ID NO: 3077 - DNA, 254 bp, Glycine max
  Clone ID: 700985453H1
agtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagaccc

SEQ ID NO: 3078 - DNA, 291 bp, Glycine max
  Clone ID: 700732002H1
gcgtacgtacgctcgcacagcgactcgagcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagaccttctct

SEQ ID NO: 3079 - DNA, 239 bp, Glycine max
  Clone ID: 700906172H1
ttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaagga

SEQ ID NO: 3080 - DNA, 274 bp, Glycine max
  unsure (1)...(274): unsure at all n locations
  Clone ID: 701137118H1
cttaactcaacttctgctacccacttctcttcttccaagtcncaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacntgtttaaatacgacagtgttcacggacactggaagcatcacgatgtcaccgttaaggacgagaagacccttctc

SEQ ID NO: 3081 - DNA, 266 bp, Glycine max
  Clone ID: 701013823H1
ctcaacttctgctcttccaactcctacaacgcttttctctgcactcatgggcaaggtccagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgaca

SEQ ID NO: 3082 - DNA, 188 bp, Glycine max
  Clone ID: 700686616H1
gcatgtgtttgtgtagaggcttttggatgcttcacaccgtgacttgagaagagccagggctgcagcactgaacattgtcccaaccagcactggagctgccaaggctgtgtctctagtgttgccacagctgaagggcaagcttaatggaatagcgctccgtgtgcctacacccaatgtttcagttgttg

SEQ ID NO: 3083 - DNA, 249 bp, Glycine max
  Clone ID: 700962944H1
caacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaa

SEQ ID NO: 3084 - DNA, 257 bp, Glycine max
  Clone ID: 700945903H1
atttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgaga

SEQ ID NO: 3085 - DNA, 249 bp, Glycine max
  Clone ID: 700863880H1
acaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgaga

SEQ ID NO: 3086 - DNA, 243 bp, Glycine max
  Clone ID: 700754937H1
gctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaaga

SEQ ID NO: 3087 - DNA, 255 bp, Glycine max
  Clone ID: 701059066H1
aacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagagacccttc

SEQ ID NO: 3088 - DNA, 259 bp, Glycine max
  Clone ID: 700757083H1
ttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagac

SEQ ID NO: 3089 - DNA, 229 bp, Glycine max
  Clone ID: 701043292H1
ccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagaccct

SEQ ID NO: 3090 - DNA, 241 bp, Glycine max
  Clone ID: 700839971H1
ccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtg

SEQ ID NO: 3091 - DNA, 272 bp, Glycine max
  Clone ID: 700897536H1
gctaacgatgctagagaatcttccttttttgatcttgtagcttcccaactcactcccaagaccaatggatcatcaactcctgtgaggggagagacagtggccaagttgaaggtggcaatcaatggtttcggacgcattggtagaaacttccttcgctgctggcacggccgaaaagactcaccccttgaggtcgttgttgtcaacgacagtggtggtgtcaagaatgcttcgcacctgcttaaatatgattccatgctgggaacttttaaagc

SEQ ID NO: 3092 - DNA, 216 bp, Glycine max
  Clone ID: 700748758H1
gcaaggtcaagatctgaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgaca

SEQ ID NO: 3093 - DNA, 253 bp, Glycine max
  Clone ID: 700737167H1
aaggaagcctcctacgatgaaattaaaaatgctatcaaggaggaatcagagggcaagttgaagggaattcttggttacactgaagatgatgtggtctccaccgactttgtgggcgatagcagatcaagtatttttgatgcaaaggctggaattgcattgaataagaactttgtgaagcttgtttcttggtacgacaacgagtggggatacagctcacgtgtcattgacctgcttgtattcgttgccaagaagt

SEQ ID NO: 3094 - DNA, 258 bp, Glycine max
  Clone ID: 700792472H1
ctcaacttctgctcttccaactcctacaacgcttttctctgcactcatgggcaaggtcaagatcggaatcaacggatttggaagaattggccgtttggttgccagagtcgctctgcaaagagacgatgttaactcgttgccgttaacgaccctttcattaccaccgattacatgacatacatgtttaaatacgacagtgttcacggacactggaagcatcacgatgtcaccgttaaggacgagaagacccttctcttc

SEQ ID NO: 3095 - DNA, 269 bp, Glycine max
  Clone ID: 701002831H1
ctcaacaacttctgctacttcctactccaaccgcacttctgttccgcaattatcatgggcaaggtcaagatcggaatcaacggatttggaagaattggccgtttggtagccagagtggctctgcagagagacgatgtgaactcgttgccgttaacgaccctttcatcaccaccgattacatgacatacatgtttaaatacgacagtgttcatggacactggaagcatcacgatgtcaccgttaaggacgagaagacccttctcttcggt

SEQ ID NO: 3096 - DNA, 274 bp, Glycine max
  Clone ID: 701147120H1
tctcgagccgaatcggctcgagtacggctgcgagaagacgacagaagggggtggaagagctgagttcatttaacatcattcctagcagcactggagctgccaaggctgttgggaaagtccttcctgctttgaatggaaaattgactggtatggcattccgtgttcccaccgtggatgtctctgttgttgacctcacggtgaggctggagaaggaagcctcatatgatgaaattaaaaatgctatcaaggaggaatcagagggcaagttgaaggg

SEQ ID NO: 3097 - DNA, 279 bp, Glycine max
  unsure (1)...(279): unsure at all n locations
  Clone ID: 700993103H1
acttctgctacttcctactccaaccgcacttctgttccgcaattatcatgggccaggtcaagatcggaatcaacggatctggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagaccttctcttcggcgacaagccagtcantnt

SEQ ID NO: 3098 - DNA, 276 bp, Glycine max
  Clone ID: 700681212H1
ctcaagaccaatggatcatcaactcctgtgaggggagagacagtggccaagttgatggtggcattaatggtttcggacgcattggtagaaacttccttcgctgctggcacggtcgagaagactcacgccttgatgtcgttgttgtcaacgacagtggtggtgtcaataatgcttcgcacctgcttaaatatgattccatgctgggaactgctaaagcagatgtgaagatactggacgatcgaaccatcactgttgatggtacgcccatcaaggttg

SEQ ID NO: 3099 - DNA, 266 bp, Glycine max
  Clone ID: 700787050H2
gttgtaaagccttgttgctgccatggccaccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgagggagagaca

SEQ ID NO: 3100 - DNA, 253 bp, Glycine max
  Clone ID: 700964087H1
acaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacc

SEQ ID NO: 3101 - DNA, 252 bp, Glycine max
  Clone ID: 701131690H1
tcctactccaaccactttcttttttcccgcagtcatgggcaaggtcaagatcggaatcaacggatttggaagaattggccgtttggtggccagggtggctccgcagagagacgatgttgaactcgttgccgttaacgatcctttcattaccaccgattacatgacatacatgttccaatacgacagtgttcacgggcactggaagcatcacgatgtcaccgttaaggatgagaagaccttctcttcggtgac

SEQ ID NO: 3102 - DNA, 290 bp, Glycine max
  Clone ID: 701013216H1
cctatctcactcactcactcacaccgttccatttctcaacaacttctgctacttcctactccaatcgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaaga

SEQ ID NO: 3103 - DNA, 239 bp, Glycine max
  Clone ID: 700752307H1
cttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaagg

SEQ ID NO: 3104 - DNA, 242 bp, Glycine max
  Clone ID: 700963986H1
caacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaagg

SEQ ID NO: 3105 - DNA, 258 bp, Glycine max
  Clone ID: 700945596H1
tctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgaattcaccgttaaggacgagaagac

SEQ ID NO: 3106 - DNA, 252 bp, Glycine max
  Clone ID: 700786782H2
caacaacttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaa

SEQ ID NO: 3107 - DNA, 261 bp, Glycine max
  Clone ID: 700686279H1
ctcgagccgctcgagccgtggccacccacgcggctcttgcttctacaaggatcccttcaaacacaaggttacccatccaaggcctctcactctttcccaacccaatgcgccttaaagagacttgaggtgacagaatctctgggcttagatccacttcatgtgtcacatatgctaacagtgctagagaatcttccttttttgatcttgtagcttcccaactcactcccaagaccaatggatcaactcctgtgaggggagaga

SEQ ID NO: 3108 - DNA, 294 bp, Glycine max
  unsure (1)...(294): unsure at all n locations
  Clone ID: 700558939H1
gccatggccacccacgcggtctctagcttctacaaggancgccactaacagcnaangtnancatgccaagngcttgcacantcttncccaacccaatgcgcctcaaagagacttgaggtgacagaattctctgggctaagatccacttcatgtgtgacatatgctaacgatgctagagaatctncctttnttgntcttgtagcttcccaactcactcccaagancaatggatcatcaactcctgtgaggggaganacagtggccaagttgaangtggcaatcaatggtttcgga

SEQ ID NO: 3109 - DNA, 260 bp, Glycine max
  Clone ID: 701118441H1
attggccgtttggttgccagagtcgctctgcaaagagacgatgtggagctcgttgccgttaacgaccctttcattaccaccgattacatgacatacatgtttaaatacgacagtgttcacggacactggaagcatcacgattcaccgttaaggacgagaagacccttctcttcggtgacaagccagtcactgtttttggacacaggaaacctgaagagatcccatgggggtcaactggagctgatatcattgttgagtcc

SEQ ID NO: 3110 - DNA, 275 bp, Glycine max
  Clone ID: 701046150H1
ctatctctcaccaacttccgctacttcctactccaaccacttacttttttcccgcagtcatgggcaaggtcaagatcggaatcaacggatttggaagaattggccgtttggtggccagggtggctctgcagatagacgatgttgaactcgttgccgttaacgatcctttcattaccaccgattacatgacatacatgtttaaatacgacagtgttcacgggcactggaagcatcacgatgtcaccgttaaggatgagaagaccttctcttcggtg

SEQ ID NO: 3111 - DNA, 251 bp, Glycine max
  Clone ID: 700876929H1
acgccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagcagaccaatggatcaactcctg

SEQ ID NO: 3112 - DNA, 256 bp, Glycine max
  Clone ID: 700945352H1
gaaaccagtggtgttacttgttggaggagcattagctcttttttggacttttgatgttttctcttgtggagacaagctactttgaagtaacaccttaaagagacttcttggcaacgaatacaagaagatcaatgacacgtgagctgtatccccactcgttgtcgtaccaagaaacaagcttcacaaagttcttattcaatgcaattccagcctttgcatcaaaaatacttgatctgctatcgccgataaagtcagt

SEQ ID NO: 3113 - DNA, 257 bp, Glycine max
  Clone ID: 700725046H1
gtctccaccgactttgttggtgataacagatcaagtatttttgatgcaaaggctggaattgcattgaataagaattttgtgaagcttgtctcttggtatgacaacgagtggggatacagttcacgtgtcattgacctgcttgtaatcgttgccaagaagtctttttaattaaggtggttctaacattatgtgctggtcaagctgcgatttagtgtcttgctcgtgcaaaaattgagaagtatgaataaatcggtttc

SEQ ID NO: 3114 - DNA, 235 bp, Glycine max
  Clone ID: 700869271H1
gactttgttggtgataacagatcaagtatttttgatgcaaaggctggaattgcattgaataagaattttgtgaagcttgtctcttggtatgacaacgagtggggatacagttcacgtgtcattgacctgcttgtaatcgttgccaagaagtctttttaattaaggtggttctaacattatgtgctggtcaagctgcgatttagtgtcttgctcgtgcaaaaattgagaagtatga

SEQ ID NO: 3115 - DNA, 252 bp, Glycine max
  Clone ID: 700841465H1
acaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaaga

SEQ ID NO: 3116 - DNA, 262 bp, Glycine max
  Clone ID: 701213349H1
cctaaaccctatctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggat

SEQ ID NO: 3117 - DNA, 258 bp, Glycine max
  Clone ID: 700726069H1
caacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagaccct

SEQ ID NO: 3118 - DNA, 261 bp, Glycine max
  Clone ID: 701055733H1
acaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctct

SEQ ID NO: 3119 - DNA, 238 bp, Glycine max
  Clone ID: 700663235H1
aacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgtta

SEQ ID NO: 3120 - DNA, 243 bp, Glycine max
  Clone ID: 700963289H1
caccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaag

SEQ ID NO: 3121 - DNA, 263 bp, Glycine max
  Clone ID: 700686557H1
caaaaccctatctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatga

SEQ ID NO: 3122 - DNA, 255 bp, Glycine max
  Clone ID: 701127887H1
gctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcg

SEQ ID NO: 3123 - DNA, 249 bp, Glycine max
  Clone ID: 700833351H1
ctcaacttctgctcttccaactcctacaacgcttttctctgcactcatgggcaaggtcaagatcggaatcaacggatttggaagaattggccgtttggttgccacgagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaaga

SEQ ID NO: 3124 - DNA, 258 bp, Glycine max
  unsure (1)...(258): unsure at all n locations
  Clone ID: 700975879H1
tacaagncagagcttgatattattnccnctgctagctgcacnaaccaactggcttgctnccacttgctaaggttattaatgacaggtttggcatgttgagggtttgatgaccactgttcattccatcactgccacccagaagactgttgatgggccatcagccaaagactggagaggtggaanagctgttcatttaacatcatcctagcagcactggagctgccaaggctgttggnaaagtccttcctgtttgaacgg

SEQ ID NO: 3125 - DNA, 242 bp, Glycine max
  Clone ID: 700731970H1
ctggaattgcattgaataagaactttgtgaagcttgtttcttggtacgacaacgagtggggatacagctcacgtgtcattgacctgcttgtattcgttgccaagaagtctttttaaggtggtgtactgcaaagttgcttgtctacacattatgtgcttgtctagttgcgatttagtgtcttgctcgtgcaaaaaatgagaggtctgaataaatcggtttctggaaccagtggatttaccttg

SEQ ID NO: 3126 - DNA, 255 bp, Glycine max
  Clone ID: 700750149H1
caaaaccctatctctcaccaacttccgctacttcctactccaacacatttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgtt

SEQ ID NO: 3127 - DNA, 245 bp, Glycine max
  Clone ID: 700953068H1
caacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcacgttaaggacga

SEQ ID NO: 3128 - DNA, 252 bp, Glycine max
  Clone ID: 700847286H1
acaacttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagcaga

SEQ ID NO: 3129 - DNA, 249 bp, Glycine max
  Clone ID: 701043647H1
aacaacttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtccccgttaaggacgag

SEQ ID NO: 3130 - DNA, 245 bp, Glycine max
  unsure (1)...(245): unsure at all n locations
  Clone ID: 700985440H1
ttttcccgcagtcatgggcaaggtcaagatcggaatcaacggatttggaagnnttggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagnccttctcttnggtganangccagtcattnt

SEQ ID NO: 3131 - DNA, 253 bp, Glycine max
  Clone ID: 701204172H1
aacaacttctgctacttcctagtccaatcgcacttctgcttcgcaattatcatgggcaaggtcaagatcggaatcaacggatttggaagaattggccgtttggtagccagagtggctctgcagagagacgatgttgaactcgttgccgttgacgaccctttcatcaccaccgattacatgacatacatgtttaaatacgacagtgttcatggacactggaagcatcacgatgtcaccgttaaggacgagaaga

SEQ ID NO: 3132 - DNA, 258 bp, Glycine max
  Clone ID: 700944204H1
cgctcgagcgaatcggctcgagcaacaacttctgctacttcctactccaaccgcacttcagctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtca

SEQ ID NO: 3133 - DNA, 251 bp, Glycine max
  Clone ID: 700906132H1
ctatctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaag

SEQ ID NO: 3134 - DNA, 308 bp, Glycine max
  Clone ID: 701145287H1
tagtagctcggaatcggtcgacggacacaccgtttgttctattcttaactcaacttctgctacccactctcttcttccaagtccaaccacgcttttctctacagtcgtgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgatcacggacactggaagcatcacgatgtcaccgttaaggacgagaaga

SEQ ID NO: 3135 - DNA, 261 bp, Glycine max
  Clone ID: 700748555H1
cttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagaccttctcttcggt

SEQ ID NO: 3136 - DNA, 259 bp, Glycine max
  Clone ID: 700791357H1
caacttctgctcttccaactcctacaacgctaatctctgctctcatgggcaaggtcaagatcggaatcaacggatttggaagaattggccgtttggttgacagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccgtctcttcgg

SEQ ID NO: 3137 - DNA, 249 bp, Glycine max
  Clone ID: 701132090H1
gctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaag

SEQ ID NO: 3138 - DNA, 270 bp, Glycine max
  unsure (1)...(270): unsure at all n locations
  Clone ID: 700998663H1
gttgttgtaaagccttgttgctgccatggccacccacgcggctcttgcttctacaaggatcccttcaannaaaggttcccatccaagggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagaa

SEQ ID NO: 3139 - DNA, 245 bp, Glycine max
  Clone ID: 701060890H1
tcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacatgttcacgggcactggagcatcacgatgtcaccgttaaggagagaagacccttctcttcggtgacaagccagtcactgtttttggacacagg

SEQ ID NO: 3140 - DNA, 289 bp, Glycine max
  unsure (1)...(289): unsure at all n locations
  Clone ID: 700986781H1
gtctcaaacttctgctctntccaacttcctacaacgctttttctctgcactcatgggcaaggtcaagatncggaattcaacggatttggaagaattggccgtttggttgccagagtcgtctgcaaagagacgatgttgaactcgttgccgttaacgaccctttcattaccaccgattacatgacatacatgtttaaatacgacagtgttcacggacactggaagcatcacgatgtcaccgttaaggacgagaagaccctctcttcggtgacaaggcagtcactgttttt

SEQ ID NO: 3141 - DNA, 261 bp, Glycine max
  Clone ID: 700953335H1
caacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagctcacgatgtcaccgttaaggacgagaagacccttctcttc

SEQ ID NO: 3142 - DNA, 287 bp, Glycine max
  Clone ID: 701014706H1
ctacaacttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactattt

SEQ ID NO: 3143 - DNA, 192 bp, Glycine max
  Clone ID: 701119782H1
attcttggttacactgaagatgatgtggtctccaccgactttgttggtgataacagatcaagtatttttgatgcaaaggctggaattgcattgaataagaattttgtgaagcttgtctcttggtatgacaacgagtggggatacagttcacgtgtcattgacctgcttgtaatcgttgccaagaagtctttt

SEQ ID NO: 3144 - DNA, 248 bp, Glycine max
  Clone ID: 701108783H1
gtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttacttcaaagtagcttgtcttcacattattaccgtatgtttatgtttagctgcgatttagtgtcttgctcgagcaaaaaatgagaggtctgaataaatcggtttctgaa

SEQ ID NO: 3145 - DNA, 241 bp, Glycine max
  Clone ID: 700866439H1
gaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgtt

SEQ ID NO: 3146 - DNA, 250 bp, Glycine max
  Clone ID: 700762316H1
cccctatctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtctaaatacgacagtgttcacgggcactggaagcatcacgatgtcaccgt

SEQ ID NO: 3147 - DNA, 140 bp, Glycine max
  Clone ID: 700901056H1
gctgatatcattgttgagtccaccggagttttcaccgataaggacaaggccgccgcacatttgaagggtggtgcgaagaaggttattatttctgcccccagtaaggatgcccccatgtttgttgttggtgttaacgagca

SEQ ID NO: 3148 - DNA, 254 bp, Glycine max
  Clone ID: 701104412H1
gttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggaga

SEQ ID NO: 3149 - DNA, 243 bp, Glycine max
  Clone ID: 700738192H1
cagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtga

SEQ ID NO: 3150 - DNA, 257 bp, Glycine max
  Clone ID: 700752442H1
gccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggc

SEQ ID NO: 3151 - DNA, 245 bp, Glycine max
  Clone ID: 700740385H1
acccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagt

SEQ ID NO: 3152 - DNA, 240 bp, Glycine max
  Clone ID: 701137084H1
acttcctactccaaccactttcttttttcccgcagtcatgggcaacgtcaagatcggaatcaacggatttggaagaattggccgtttggtggccagggtggctctgcagagagacgatgttgaactcgttgccgttaacgatcctttcattaccaccgattacatgacatacatgtttcaataccacagtgttcacgggcactggaagcatcacgatgtcaccgttaaggatgagaagac

SEQ ID NO: 3153 - DNA, 241 bp, Glycine max
  Clone ID: 701010003H2
caccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgtta

SEQ ID NO: 3154 - DNA, 247 bp, Glycine max
  Clone ID: 700833047H1
aacaacttctgctacttcctactccaaccgcacttctgttccgcaattatcatgggataggtcaagatcggaatcaacggatttggaagaattggccgttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacga

SEQ ID NO: 3155 - DNA, 254 bp, Glycine max
  Clone ID: 700855933H1
caacaacttctgctacttcctactccaaccgcacttctgttccgcaattatcatgggctaggtcaagatcggaatcaacggatttggaagaattggccgtttgtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagac

SEQ ID NO: 3156 - DNA, 270 bp, Glycine max
  Clone ID: 701014245H1
tctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtctaaatacgacagtgttcaggacactggaagcatcacgatgtcaccgttaaggacgagaaga

SEQ ID NO: 3157 - DNA, 281 bp, Glycine max
  Clone ID: 700762962H1
caacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtca

SEQ ID NO: 3158 - DNA, 272 bp, Glycine max
  unsure (1)...(272): unsure at all n locations
  Clone ID: 700975559H1
ttgcattgaataagaactttgtgaagcttgtttcttggtacgacaacgagtggggatacagctcacgtgtcattgacctgcttgtattcgttgccaagaagtctttttaaggtggtgtactgcaaagttgcttgtctacacattatgtgcttgtctagttgcgatttagtgtcttgctcgtgcaaaaaatgagaggtctgaataaatcggtttctggaaccagtggatttaccttgttaggagcattagcntattttggatttgcctcttgt

SEQ ID NO: 3159 - DNA, 275 bp, Glycine max
  Clone ID: 701151663H1
tacggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccgccgattacatgacatacatgtttaaatacgacagtgttcacggacactggaagcatcacgatgt

SEQ ID NO: 3160 - DNA, 231 bp, Glycine max
  Clone ID: 700840645H1
gctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgtta

SEQ ID NO: 3161 - DNA, 250 bp, Glycine max
  Clone ID: 700787505H1
ttgttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttccaactcactcccaagaccaatggatcact

SEQ ID NO: 3162 - DNA, 233 bp, Glycine max
  unsure (1)...(233): unsure at all n locations
  Clone ID: 700672894H1
ctacttcctantccaaccgcactnctgctccgcnattatcatgggcaaggttcaagatcngaatcaacggatttggaagaattggccgtttngtagccagagtggctctgcagatagacgatgttgaactcgttgccgttaacgaccctttcatcaccaccgattacntgacatacatgtttaaatacgacagtgttnatggacactggaagcatcacgatgtcaccgttaag

SEQ ID NO: 3163 - DNA, 256 bp, Glycine max
  Clone ID: 700678041H1
gagcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatgg

SEQ ID NO: 3164 - DNA, 263 bp, Glycine max
  Clone ID: 701205624H1
tcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgaga

SEQ ID NO: 3165 - DNA, 166 bp, Glycine max
  Clone ID: 701044525H1
taaggataaggctgccgcacatttgaagggtggtgcaaagaaggttattatttctgcccccagtaaggatgcccccatgtttgttgttggtgttaacgagcacgagtacaagccagagcttgacattatttccaatgctagctgcacaaccaactgccttgccccg

SEQ ID NO: 3166 - DNA, 254 bp, Glycine max
  unsure (1)...(254): unsure at all n locations
  Clone ID: 700998789H1
tcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatanctgtttaaatacgacagtgttcacggacactggaagcatcacgatgtcaccgtta

SEQ ID NO: 3167 - DNA, 261 bp, Glycine max
  unsure (1)...(261): unsure at all n locations
  Clone ID: 700997577H1
cgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcacncccaagaccaatggatcatcaa

SEQ ID NO: 3168 - DNA, 258 bp, Glycine max
  Clone ID: 700849115H1
gtatttttgatgcaaaggctggaattgcattgaataagaactttgtgaagcttgtttctagagacgacaacgagtggggatacagctcacgtgtcattgatcttcttgtattcgttgccaagaagtctctttaaggtgttacttcaaagtagcttgtcttcacattattaccgtatgtttatgtttagctgcgatttagtgtcttgctcgagcaaaaaatgagaggtctgaataaatcggtttctgaaaccagtggtg

SEQ ID NO: 3169 - DNA, 283 bp, Glycine max
  unsure (1)...(283): unsure at all n locations
  Clone ID: 700660742H1
ctcgagcgcaacttctgctacttcctactncaaccgcanttctgctccgcaattatcatnggcaangtcaagatcggaatcaacggatttggaagaattggccgnttggtagccanagnggctctgcagagagacgatgttgaactcgntgccgttaacaccctttcatcaccaccgattacatgacatacatgtttaaatacgacagtgttcatggcacatggnagcatcacgatgtcaccgttaagacgagcagaccttctcttcggtgacaagccagtca

SEQ ID NO: 3170 - DNA, 241 bp, Glycine max
  Clone ID: 700752256H1
gtaaagctagccttgttgcagccatggccacccacgcggctctagcttctacaaggatccccactaacaccaagttcccatccaaggcttcacactctttcccaacccaatgcgcctcaaagcagagacttgacgtgacagaattctctgggctaagatccacttcatgtgtgacatatgctaacgatgctagagaatcttccttttttgatcttgtagcttcccaactcactcccaagac

SEQ ID NO: 3171 - DNA, 255 bp, Glycine max
  unsure (1)...(255): unsure at all n locations
  Clone ID: 700907488H1
caacttctgctcttccaactcctacaacgctattctcagnactcatgggcaaggtcaagatcggaatcaacggatttggaagaattggccgtttggtactcagagtcgctctgcaaagagacgatgttgaactcgttgccgttaacgaccctttcattaccaccgattacatgacataaatgtttaaatacgacagtgttcacggacactggaagcatcacgatgtcaccgttaaggacgagaagacccttctct

SEQ ID NO: 3172 - DNA, 259 bp, Glycine max
  Clone ID: 701146736H1
tacggctgcgagaagacgacagaagggggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcaggattcacgttaaggacgagaagacccttctcttcggtgacaagccagtcactgttttggcaacgcaccctgaagagatccca

SEQ ID NO: 3173 - DNA, 263 bp, Glycine max
  Clone ID: 700872466H1
gtaaagccttgttgctgccatggctacccacgcggctcttgcttctatcaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagcagaccaatggatcaactcctgtgaggggag

SEQ ID NO: 3174 - DNA, 188 bp, Glycine max
  Clone ID: 701057780H1
gtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatga

SEQ ID NO: 3175 - DNA, 264 bp, Glycine max
  Clone ID: 701145459H1
acggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagc

SEQ ID NO: 3176 - DNA, 247 bp, Glycine max
  Clone ID: 701210858H1
ctcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgtt

SEQ ID NO: 3177 - DNA, 267 bp, Glycine max
  Clone ID: 700877001H1
gcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttg

SEQ ID NO: 3178 - DNA, 198 bp, Glycine max
  Clone ID: 700742465H1
tttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacga

SEQ ID NO: 3179 - DNA, 268 bp, Glycine max
  Clone ID: 700763342H1
cactatcttggttcccgcagtcatgggcatggtcacgatcggaatcaacggatttggaagaattggccgtttggtggccagggtggctctgcagatagacgatgttgaactcgttgccgttaacgatcctttcattaccaccgattacatgacatacctgtgtacatacgacagtgttcacgggcactggaagcatcacggtgtcaccgttaaggatgataagacccttctcttcggtgacaagccagtcactgtttctggacacagg

SEQ ID NO: 3180 - DNA, 267 bp, Glycine max
  Clone ID: 700685380H1
gcgagttgttgtaaagctagccttgttgcagccatggccacccacgcggctctagcttctacaaggatccccactaacaccaagttgccatccaaggcttcacactctttcccaacccaatgcgcctcaaagagacttgaggtgacagaattctctgggctaagatccacttcatgtgtgacatctgctaacgatgctagagaatcttccttttttgatcttgtagcttcccaactcactcccaagacaatgggatcatcaactcct

SEQ ID NO: 3181 - DNA, 287 bp, Glycine max
  Clone ID: 701149865H1
aagacggctgcgagacgacagaaggggcattgaataagaactttgtgaagcttgtttcttggtacgacaacgagtggggatacagctcacgtgtcattgacctgcttgtattcgttgccaagaagtctttttaaggtggtgtactgcaaagttgcttgtctacacattatgtgcttgtctagttgcgatttagtgtcttgctcgtgcaaaaaatgagaggtctgaataaatcggtttctggagacagtggatttaccttgttaggagcattagctctattttggact

SEQ ID NO: 3182 - DNA, 239 bp, Glycine max
  Clone ID: 700891972H1
caacaacttctgctacttcctactccaaccgcacttctgctccgcaattatcatgggcaaggtcaagatggagacaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgt

SEQ ID NO: 3183 - DNA, 259 bp, Glycine max
  Clone ID: 700750391H1
tctattcttaactcaacttctgctacccactctcttcttccaagtccaaccacgcttttctctacagtcatgggcaaggtcaagatcggaatcaacggatttggaagaattggccgtttggttgccagagtcgctctgcaagagacgatgtggagctcgttgccgttaacgaccctttcattaccaccgattacatgacatacatgtttaaatacgacagtgttcacggacactggaagcatcacgatgtcaccgttaa

SEQ ID NO: 3184 - DNA, 213 bp, Glycine max
  Clone ID: 700683883H1
atcggaataaacggatttggaagaattggccgtttggtagccagagtggctctgcagagagacgatgttgaactcgttgccgttaacgaccctttcatcaccaccgattacaagacatacatgtttaaatacaacagtgttcatggacactggaagcatcacgatgtcaccgttaaggacgagaagacccttctcttcggtgacaagccagtc

SEQ ID NO: 3185 - DNA, 249 bp, Glycine max
  Clone ID: 700729088H1
aggaatcagagggcaagttgaagggaattcttggttacactgaagatgatgtggtctccaccgactttgtgggcgatagcagatcaagtatttttgatgcaaaggctggaattgcattgaataagaactttgtgaagcttgtctcttggtatgacaacgagtggggatacagctcacgtgtcattgacctgcttgtattcgttgccaagaagtcttttaaggttgtactgaaaaaaaagtagcttgtct

SEQ ID NO: 3186 - DNA, 262 bp, Glycine max
  Clone ID: 700903141H1
attcttaactcaacttctgctaccctctctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacg

SEQ ID NO: 3187 - DNA, 238 bp, Glycine max
  Clone ID: 701202337H1
ctcaacttctgctcttccaactcctacaacgcttttctctgcactcatgggcaaggtcaagatcggaatcaacggatttggaagaattggccgtttggttgccagactcgctctgcaaagagacgatgttgaactcgttgccgttaacgaccctttcattaccaccgattacatgacatacatgtttaaatacgacagtgttcacggacactggaagcatcacgatgtcaccgttaag

SEQ ID NO: 3188 - DNA, 258 bp, Glycine max
  Clone ID: 701155013H1
gacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatc

SEQ ID NO: 3189 - DNA, 240 bp, Glycine max
  Clone ID: 700844326H1
ctcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgt

SEQ ID NO: 3190 - DNA, 248 bp, Glycine max
  Clone ID: 700741362H1
tcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatgcatgtttaaatacgacagtgttcacggacactggaagcatcacgatgtca

SEQ ID NO: 3191 - DNA, 230 bp, Glycine max
  Clone ID: 700755283H1
ctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatc

SEQ ID NO: 3192 - DNA, 250 bp, Glycine max
  Clone ID: 700751536H1
gcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgagcttcccaactcactcccaagaccaa

SEQ ID NO: 3193 - DNA, 264 bp, Glycine max
  Clone ID: 700684196H1
tctcgagccgattcggatcgagaccatggacacccaagcagctcttgcttctacaaggatcacttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcactcctgtgagggga

SEQ ID NO: 3194 - DNA, 218 bp, Glycine max
  Clone ID: 700684881H1
tgtgaagggaaccatgacaaccacacattcctacacaggagaccagaggcttttggatgcttcacaccgtgacttgagaagagccagggctgcagcactgaacattgtcccaaccagcactggagctgccaaggctgtgtctctagtgttgccacagctgaaggggcaagcttaatggaatagcggctcgtgtggctacacccaatgtttcatttgtg

SEQ ID NO: 3195 - DNA, 330 bp, Glycine max
  Clone ID: 700680531H1
tatcgaccgaatcggctcgagatggccacccaagcggctctccagtctacaaggatccattcaaacacaaggttcccaaccaaggcctctcactccttcccaacccaatgcgccttaaagagacttgaggtgacagaattctctgggcttagatccacttcatgtgtcacatatgtaacagtgctagagaatcttcctactctgatcttgtagcttcccaactcactcccaagaccaatggatcaactcctgtgcagggagacacagtggccaagttgatagtggcaatcaatggattcggacgcattggctagaactccttcgctgctg

SEQ ID NO: 3196 - DNA, 246 bp, Glycine max
  Clone ID: 701106044H1
gttgttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaactcactcccaagacaatgga

SEQ ID NO: 3197 - DNA, 153 bp, Glycine max
  Clone ID: 700979630H2
gcaaaggctggaattgcattgaataagaactttgtgaagcttgtctcttggtatgacaacgagtggggatacagctcacgtgtcattgacctgcttgtattcgttgccaagaagtctttttaaggttgtactgaaaaaaaagtagcttgtcta

SEQ ID NO: 3198 - DNA, 222 bp, Glycine max
  Clone ID: 700751095H1
ctcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggaca

SEQ ID NO: 3199 - DNA, 277 bp, Glycine max
  Clone ID: 701153515H1
gaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacg

SEQ ID NO: 3200 - DNA, 232 bp, Glycine max
  Clone ID: 700741789H1
gagaaagttgttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttccttttttgatcttgtagcttcccaa

SEQ ID NO: 3201 - DNA, 256 bp, Glycine max
  Clone ID: 701204330H2
cactcactcactcacaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatc

SEQ ID NO: 3202 - DNA, 246 bp, Glycine max
  Clone ID: 700967679H1
acttaactcaacttctgctacccactctcttcttccaagtccaaccacgcttttctctacagtcatgggcaaggttaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgt

SEQ ID NO: 3203 - DNA, 253 bp, Glycine max
  unsure (1)...(253): unsure at all n locations
  Clone ID: 700972372H1
caacaacttctgctanttcctactccaaccgcacttctgctccgnaattatcatgggcaaggtcaanatcggaatcaacggatttggaagnattngccgttnggtanccagagtggctctgcanngagncgatgttgaactcgttgccgttaacgaccctttcatcatcaccgattacatgacatacatgtttaaatacgacagtnttcntggacactggaagtntcacgatgtcaccgttaaggncgagnag

SEQ ID NO: 3204 - DNA, 249 bp, Glycine max
  unsure (1)...(249): unsure at all n locations
  Clone ID: 700974446H1
acttctgctacccactctcttcttccaagtccaaccacgcttttctctacagtcatgggcaaggtcaagatcggaatcaacggatttggaagaattggccgtttggttgccagantcgctctgcaaagagacgatgtggagctcgttgccgttaacgaccctttcattaccaccgattncatgacatacatgtttaaatacgacagtgttcacggacactggaagcatcacgatgttcaccgttaagga

SEQ ID NO: 3205 - DNA, 257 bp, Glycine max
  Clone ID: 701146670H1
tctcgagccgaatcggctcgagacggctgcgagaagacgacagaaaggggatttggaagaattggccgtttggttgccagaatcgctctgcaaagagacgatgtggagctcgttgccgttaacgaccctttcattaccaccgattcatgacatacatgtttaaatacgacagtgttcacggacactggaagcatcacgatgtcaccgttaaggacgagaagacccttctcttcggtgacaagccagtcactgttttt

SEQ ID NO: 3206 - DNA, 178 bp, Glycine max
  Clone ID: 701102507H1
ccgtgttcccactgtggatgtctctgttgttgacctcacagtgaggctggagaaggaagcctcctacgatgaaattaaaaatgctatcaaggaggaatcagagggcaagttgaagggaattcttggttacactgaagatgatgtggtctccaccgactttgtgggcgatacagatcaa

SEQ ID NO: 3207 - DNA, 237 bp, Glycine max
  unsure (1)...(237): unsure at all n locations
  Clone ID: 701006744H1
gttctagtctcaacttctgctcttccaactcctacaacgctcctctccgnactcatgggcaaggtcaagatcggaatcaacggatttggaagaattggccgtttggttgccagcaccgctctgcaaagagacgatgttgaactcgttgccgttaacgaccctttcattaccaccgattacatgacatacatgtttaaatacgacagtgttcacggacactggaagcatcacgatgtc

SEQ ID NO: 3208 - DNA, 240 bp, Glycine max
  Clone ID: 700835690H1
caaggtcaagatcggaatcaacggatttggaagaattggccgtttggtagccagagtggctctgcagagagacgatgttgaactcgttgccgttaacgaccctttcatcaccaccgattactgacatacatgtttaaatacgacagtgttcatggacactggaagcatcacgatgtcactattaaggacgagaagacccttctcttcggtgacaagccagtcactatttttggacacaga

SEQ ID NO: 3209 - DNA, 293 bp, Glycine max
  unsure (1)...(293): unsure at all n locations
  Clone ID: 700983742H1
ctttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgttaaatacgacagtggttcannggnaatgggancnatcannatgtnnacgntaaaggtgaggagaaccttctctcggtgacnagccagtcactgttttggacacaggaaccctgaagagatcccatggaagtcga

SEQ ID NO: 3210 - DNA, 262 bp, Glycine max
  unsure (1)...(262): unsure at all n locations
  Clone ID: 700654457H1
ctctcaccaacttccgctacttcctactccnaccactttctnntnncccgcanccnngggcaangtcaagatcggaatacaacggatttggaagaattggccgtttggtggccagggtggctctgcagagagacgatgttgaactcnttgccgtnaacgatcctttcattaccnccgnttacatgacatacatgtttaaatacgacagtgtncacgggcactggaagcatcacgatgtcaccgttaaggatgagaagaccct

SEQ ID NO: 3211 - DNA, 272 bp, Glycine max
  Clone ID: 700555371H1
tgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaacttcactcccaagaccaatggatcatcaactcctgtgaggggagagacagtggccaagttgaag

SEQ ID NO: 3212 - DNA, 256 bp, Glycine max
  Clone ID: 700991260H1
ctcactcactcactcacaccgttccatttctcaacaacttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagct

SEQ ID NO: 3213 - DNA, 254 bp, Glycine max
  Clone ID: 701109867H1
gccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagt

SEQ ID NO: 3214 - DNA, 276 bp, Glycine max
  Clone ID: 701151625H1
tacggctgcgagaagacgacagaaggggaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaacattgagccgttaacgaccctttcatcaccaccgattacatgacatacatgtttaaatacgacagtgttcatggacactggaagcatcacgatgt

SEQ ID NO: 3215 - DNA, 217 bp, Glycine max
  Clone ID: 700748787H1
aacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgtcattcatgtttaaatacgacagtgttcatggacact

SEQ ID NO: 3216 - DNA, 219 bp, Glycine max
  Clone ID: 700754611H1
acaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactgga

SEQ ID NO: 3217 - DNA, 255 bp, Glycine max
  Clone ID: 700852565H1
caacaacttctgctacttcctactccaaccgcacttctgttccgcaattatcatgggcaaggtcaagatcggaatcaacggatttggaagaattggccgtttggtagccagagtggctctgcagagatagaatgttgaactcgttgccgttaacgaccctttcatcaccaccgattacatgacatacatgtttaaatacgacagtgttcatggacactggaagcatcacgatgtcaccgttaaggacgagaagac

SEQ ID NO: 3218 - DNA, 205 bp, Glycine max
  Clone ID: 700791713H1
agctgccatggccacccacgcggctcttgcttctacaaggatcccttcaaacacaaggatcccatccaaggcctctcactctttcccaacccaatgcgctttaaagagacttgaggtgacagaattctctgggcttagatccactacatgtgtcacatatgctaacagtgctagagaatcttcctttttggatcttgtagcttcc

SEQ ID NO: 3219 - DNA, 276 bp, Glycine max
  Clone ID: 701205047H1
ctcgagccgctcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagaaccttct

SEQ ID NO: 3220 - DNA, 276 bp, Glycine max
  unsure (1)...(276): unsure at all n locations
  Clone ID: 700972230H1
caacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttncatggacactggaagcatcacgatgtccaccgttaaggacgagaagacccttcttcttcggtgacaa

SEQ ID NO: 3221 - DNA, 256 bp, Glycine max
  Clone ID: 701157734H1
taagacgacagaggggaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacgga

SEQ ID NO: 3222 - DNA, 277 bp, Glycine max
  unsure (1)...(277): unsure at all n locations
  Clone ID: 700567308H1
tttntcaacaacttctgctanntcctactcnaaccgacacttctgctccgcaattatcnctgggcaaggtcaagatcggaatcaacggatttggaagaattggccgtttggtagccagagtggctctgcagagagacgatgttgaantcgttgccgttaacgacncnttcatcaccaccgattacatganatanatgtntanntacgacagtgttcatgggcantggaagcatcncgntgtcangtnaggacgagangannntctcttcgntgacag

SEQ ID NO: 3223 - DNA, 274 bp, Glycine max
  Clone ID: 700741053H1
cacccacgcggctctagcttctacaaggatccccactaacaccaagttcccatccaaggcttcacactctttcccaacccaatgcgcctcaaagagacttgaggtgacagaattctctgggctaagatccacttcatgtgtacatatgctaacgatgctagagaatcttccttttttgatcttgtagcttcccaactcactcccaagaccaatggatcatcaactcctgtgaggggagagacagtggccaagttgaaggtggcaatcaatggtt

SEQ ID NO: 3224 - DNA, 243 bp, Glycine max
  unsure (1)...(243): unsure at all n locations
  Clone ID: 701124645H1
gctacttcctactccaaccgcacttctgcttcgctattatcatgggccaggtcatcatcggaatcaacggatttggaagaattggccgtttggtagccagagtggctctgcagagagacgatgttgaactccttgccgttaacgaccctttcatcaccaccgattacatgacatacatgtttaaatactancgtgttcatggacactggaagcatcacgatgtcaccgttaaggacgagcaga

SEQ ID NO: 3225 - DNA, 253 bp, Glycine max
  Clone ID: 700738430H1
caaaaccctatctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcccgggcactggaagcatcacgatgtcaccg

SEQ ID NO: 3226 - DNA, 231 bp, Glycine max
  unsure (1)...(231): unsure at all n locations
  Clone ID: 700980387H1
tcttaactcaacttctgctacccacacctcttcttccaagtcanaccacgcttttctctacannccatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgtccacggacat

SEQ ID NO: 3227 - DNA, 276 bp, Glycine max
  Clone ID: 701109905H1
aacaacttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagcca

SEQ ID NO: 3228 - DNA, 247 bp, Glycine max
  Clone ID: 700756857H1
aacttctgctacttcctactccaaccgcacttctgctccgcaattatcatgggcaaggtcaagatcggaatcaacggatttggaagaattggccgtttggtagccagagtggctctgcagagagacgagttgaactcgttgccgttaacgaccctttcatcaccaccgattacatgacatacatgtttaaatacgacagtgttcatggacactggaagcatcacgatgtcaccgttaaggacgagaa

SEQ ID NO: 3229 - DNA, 277 bp, Glycine max
  Clone ID: 700685415H1
cagagagaaagttgttgtaaagccttgttgctgccatggccacccacgcggctcttgcttctacaaggatcccttcaaacacaaggttcccatccaaggcctctcactctttcccaacccaatgcgccttaaagagacttgaggtgacagattctctgggcttagatccacttcatgtgtcacatatgctaacagtgctagagaatcttccttttttgatcttgtagcttcccaactcactcccaagaccaggatcactcctgtgagggagagacat

SEQ ID NO: 3230 - DNA, 283 bp, Glycine max
  Clone ID: 700999463H1
gacagagcgagttgttgtaaagctagccttgttgcagccatggccacccacgcggctctagcttctacaaggatccccactaacaccaagttcccatccaaggcttcacactctttcccaacccaatgcgctcaaagagacttgaggtgacagaattctctgggctaagatccacttcatgtgtgacatatgctaacgatgctagagaatcttccttttttgatctggtagcttcccaactcactcccaagaccatggatcatcaactctgtgaggggagaga

SEQ ID NO: 3231 - DNA, 243 bp, Glycine max
  Clone ID: 700899494H1
ctcactcactcacaccgttccatttctcaacaacttctgctacttcctactccaaccgcacttctgctccgcaattatcatgggcaaggtcaagatcggaatcaacggatttggaagaattggcgtttggtagccagagtggctctgcagagagacgatgttgaactcgttgccgttaacgaccctttcatcaccaccgattacatgacatacatgtttaaatacgacagtgttcatggacac

SEQ ID NO: 3232 - DNA, 270 bp, Glycine max
  Clone ID: 701152616H1
tacggctgcgagaagacgacagaaggggacacaccgtttgttctattcttaactcaacttctgctacccactctcttcttccaagtccaaccacgcttttctctacagtcatggacaaggtcaagatcggaatcaacggatttggaagaattggccgtttggttgccagagtcgctctgcaaagagacgatgtggagctcgttgccgttaacgaccctttcattaccaccgattacatgacatacatgtctaaatacgacagtgttcacg

SEQ ID NO: 3233 - DNA, 214 bp, Glycine max
  Clone ID: 700682787H1
gtgacagaattctctgggcttagatccacttcatgcgtcacatatgctaacagtgctagagactcttcctatagtgatcttgtagcttcccaactcagtcccaagaccagtggatcgactcctgtgaggggagagagagtggccaagttgaaggtggcaatcaatggtgtcggacgcattggtagacacttcctcgctgctggcacggccgaaa

SEQ ID NO: 3234 - DNA, 268 bp, Glycine max
  unsure (1)...(268): unsure at all n locations
  Clone ID: 700997526H1
aattctctgggctaagatccacttcatgtgtgacatatgctaacgatgctagagaatcttccttttttgatcttntagcttcccaactgcactcccaagaccaatggatcatcaactcctgtgaggggagagacagtggccaagttgaaggtggcaatcaatggtttcggacgcattggtagaaacttccttcgctgctggcacggccgaaaagactcaccccttgaggtcgttgttgtcaacgacagtggtggtgtcaaatgcttcg

SEQ ID NO: 3235 - DNA, 277 bp, Glycine max
  Clone ID: 701152717H1
cggctcgagtacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttca

SEQ ID NO: 3236 - DNA, 282 bp, Glycine max
  Clone ID: 701156106H1
tactgcgagaagacgacagcaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatc

SEQ ID NO: 3237 - DNA, 241 bp, Glycine max
  Clone ID: 700757283H1
ttctcaacaacttctggtacttcctactccaagcgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatactggtgtacatacgacagtgttcatggacactggaagcatcacgatgtcac

SEQ ID NO: 3238 - DNA, 270 bp, Glycine max
  Clone ID: 701153845H1
acggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacgg

SEQ ID NO: 3239 - DNA, 272 bp, Glycine max
  Clone ID: 701152664H1
acggctgcgagaaaacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggac

SEQ ID NO: 3240 - DNA, 246 bp, Glycine max
  unsure (1)...(246): unsure at all n locations
  Clone ID: 700960557H1
tgcagttntgctccgcaattatcatgggcaaggtcaanatcggaatcaacggatttggaagaattggncgtttggtancanagtggctctgcagagagacgatgttgaactcgttgccgttaacgacctttcatcaccaccgattacatgacatacatgttnaaatacgacagtgttnatggacactggaancatcacgatgtcacgttaaggacgagaagacgcttctnttcggtgacaanccag

SEQ ID NO: 3241 - DNA, 190 bp, Glycine max
  Clone ID: 701046409H1
tacttctgctacttcctactccaaccgcacttctgctccgcaattatcatgggcaaggtcaagatcggaatcaacggatttggaagaattggccgtctggtagccagactggctctgcagagagacgatgctgaactcgttgccgttaacgaccctttcatcaccagcgattacatgacatacatgttta

SEQ ID NO: 3242 - DNA, 166 bp, Glycine max
  unsure (1)...(166): unsure at all n locations
  Clone ID: 700648740H1
gaactcgttgccgttaacgatcctttcattaccaccgattacatgacatacatgtttaaatacgacagtgttcacgggcactggaagcatcacgatgnccaccgttaaggatgagaagacccttctcttcggtgacaagccagtcactgtttttggacacaggaac

SEQ ID NO: 3243 - DNA, 249 bp, Glycine max
  Clone ID: 700728066H1
ctcaacttctgctcttccaactcctacaacgctcttctccgcactcatgggcaaggtcaagatcggaatcaacggatttggaagaattggccgtttggttgactgagattctctgcaaagagacgatgttgaactcgttgacgttaacgagcctatcattaccaccgattacatgacatacgtgtttaatccgacagtgttcacggacactggacagcatcacgatgtcagcgttaacgacgagaagac

SEQ ID NO: 3244 - DNA, 254 bp, Glycine max
  Clone ID: 700740668H1
cagccatggccacccacgcggctctagcttctacaaggatccccactaacaccaagttcccatccaaggcttcacactctttcccaaccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacag

SEQ ID NO: 3245 - DNA, 266 bp, Glycine max
  Clone ID: 701149559H1
acggctgcgagaagacgacagaaggggacacaccgtttgttctattcttaactcaacttctgctacccactctcttcttccaagtccaaccacgcttttctctacggtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttc

SEQ ID NO: 3246 - DNA, 262 bp, Glycine max
  Clone ID: 701124058H1
cggaaatgcaacttacttgttgatataaacttcagacagagcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatctt

SEQ ID NO: 3247 - DNA, 240 bp, Glycine max
  unsure (1)...(240): unsure at all n locations
  Clone ID: 701154958H1
gacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaaganacgatgtggagctcgttgccgttaacgaccctttcattaccaccgattacatgacatacatgtttaaatacgacagtgttc

SEQ ID NO: 3248 - DNA, 266 bp, Glycine max
  Clone ID: 701149995H1
tacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgtt

SEQ ID NO: 3249 - DNA, 276 bp, Glycine max
  Clone ID: 701145383H1
tacggctgcgagaagacgacagaaggggacgcaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacact

SEQ ID NO: 3250 - DNA, 155 bp, Glycine max
  Clone ID: 701064544H1
gctggaattgcattgaataagaactttgtgaagcttgtctcttggtacgacaacgagtggggatacagctcacgtgtcattgatcttgcttgtattcgttgccaagaagtctctttaaggtgttacttcaaagtagtatgtcttcacattattag

SEQ ID NO: 3251 - DNA, 257 bp, Glycine max
  unsure (1)...(257): unsure at all n locations
  Clone ID: 700992479H1
gcaaggtcaagatcggaatcaacggatttggaaganttggccgtttggtggccagggtggctctgcagagagacgatgttgaactcgttgccgttaacgatccttcattaccaccgattacatgacatacatgtttnaatacgacatgttcacgggcactggnagcatcacgatgtcaccgttaaggatgagaagaccttctctncgtgacaagccagtccatgttttnggacacagganccctnaagagatccctg

SEQ ID NO: 3252 - DNA, 231 bp, Glycine max
  Clone ID: 700739262H1
ccactaacaccaagttcccatccaaggcttcacactctttcccaacccaatgcgcctcaaagagacttgaggtgacagaattctctgggctaagatccacttcatgtgtgacatatgctaacgatgctagagaatctccttttttgatcttgtagcttcccaactcactcccaagaccaatggatcatcaactcctgtgaggggagagacagtggccaagttgaaggtggc

SEQ ID NO: 3253 - DNA, 275 bp, Glycine max
  unsure (1)...(275): unsure at all n locations
  Clone ID: 700999632H1
cagccatggccanccacgcgggctctagcttctacaaggatccccactanacaccaagttcccatccaaggcttgcacactctttcccaacccaatgcgcctcaaagagacttgaggtgacagaattctctgggctaagatccacttcatgtgtgacatatgctaacgatgctagagaatcttccttttntgatcntgtagcttcccaactcactcccaagaccaatggatcatcaactcctgtnaggggagngacagtggccaagttgaangtg

SEQ ID NO: 3254 - DNA, 187 bp, Glycine max
  Clone ID: 700743974H1
tgccatggccacccacgcggctcttgcttctacaaggatcccttcaaacacaaggttcccatgcaaggcctctcactctttcccaacccaatgcgccttaaagagacttgaggtgacagaattctctgggcttagatccacttcatgtgtcacatatgctaacagtgctagagaatcttcctttttt

SEQ ID NO: 3255 - DNA, 275 bp, Glycine max
  Clone ID: 700835707H1
cggctcgagaaaaccctatctcgctcgcactcacccacacaccatccgttctacggttctagtctcaacttctgctcttccaactcctacaacgcttttctctgcactcatgggcaaggtcaagatcggaacaacggatttggaagaattggccgtttggttgccagagtcgctctgcaaagagacgatgttgaactcgttgccgttaacgaccctttcattaccaccgattacatgacatacatgtttaaatacgacagtgttcacggacactg

SEQ ID NO: 3256 - DNA, 222 bp, Glycine max
  Clone ID: 700844641H1
ctcgagccgtcttaactcaacttctgctacccactctcttcttccaagtccaaccacgctattctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttatatacga

SEQ ID NO: 3257 - DNA, 180 bp, Glycine max
  Clone ID: 701048040H1
ctcgagccgctttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgaca

SEQ ID NO: 3258 - DNA, 220 bp, Glycine max
  Clone ID: 700829978H1
caacttctgctacccactctcttcttccaagtccaaccacgcttttctctacagtcatgggcaaggtcaagatcggaatcaacggatttggaagaattggccgtttgcgttgccagagtcgctctgcaaagagacgatgtggagctcgttgccgttaacgaccctttcattaccaccgattacatgacatacatgtttaaatacgacagtgttcacggac

SEQ ID NO: 3259 - DNA, 168 bp, Glycine max
  Clone ID: 700875006H1
gtgaatgcagcattcagaaaggcagctgagggtccactgaaaggtgtgttggacgtgtgtgatgttccacttgtgtctatcgacttccgctgctctgatgtttcctctactattgactcctccttgactatggtcatgggagatgacatggttaaggtggttgcttgg

SEQ ID NO: 3260 - DNA, 246 bp, Glycine max
  Clone ID: 700830281H1
tcggcgcgagaacttctgctacttcctactccaaccgcacttctgttccgcaattatcatggtacaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggcagcatcacgatgtcaccgt

SEQ ID NO: 3261 - DNA, 192 bp, Glycine max
  Clone ID: 700990514H1
tgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttga

SEQ ID NO: 3262 - DNA, 278 bp, Glycine max
  Clone ID: 701153744H1
ttcgaccgattcggctcgagtacggctgcgagaagacgacaacaggggacacaccgtatgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacg

SEQ ID NO: 3263 - DNA, 134 bp, Glycine max
  Clone ID: 700742768H1
ggaccatcagccaaggactggagaggtggaagagctgcttcatttaacatcattcctagcagcactggagctgccaaggctgttgggaaagtcctccctgctttgaatggaaaattgactggtatggcattccg

SEQ ID NO: 3264 - DNA, 263 bp, Glycine max
  Clone ID: 701149314H1
acggctgcgagaagacgacagaaggggacaccgtttgttctattcttagctcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtataaatacgacagtgtg

SEQ ID NO: 3265 - DNA, 242 bp, Glycine max
  Clone ID: 700961862H1
actcgagccgattcggctcgagcacccacacaccatccgttctagactcaacttctgctctacccaactcctacaacgcttatctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacga

SEQ ID NO: 3266 - DNA, 262 bp, Glycine max
  Clone ID: 700875647H1
gaataaaacaagaggaggaaatgcaacttacttgttgatataaacttcacagagagaaagttgttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtgctagagaatcttcct

SEQ ID NO: 3267 - DNA, 244 bp, Glycine max
  Clone ID: 700958014H1
ctattcttaactcaacttctgctaccactctgttcttccaagtccatccacgcttttctctacagtcatgggcaaggtcaagatcggaatcaacggatttgagagaattggccgtttggttgccagagtcgctctgcaaagagacgatgtggagctcgttgccgttaagggccctgtcattaccaccgattacatgacatacatgattggatacgtcagtgttcacggacactggaagcatcac

SEQ ID NO: 3268 - DNA, 235 bp, Glycine max
  Clone ID: 700854826H1
attgaataagaactttgtgaagcttgtttcttggtacgacaacgagtggggatacagctcacgtgtcattgatcttcttgtattcgttgccaagaagtctctttaaggtgttacttcaaagtagcttgtcttcacattattaccgtatgtttatgtttagctgcgatttagtgtcttgctcgagcaaaaaatgagaggtctgaataaatcggtttctgaaaccagtggtgttact

SEQ ID NO: 3269 - DNA, 269 bp, Glycine max
  Clone ID: 701106984H1
gcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgt

SEQ ID NO: 3270 - DNA, 199 bp, Glycine max
  Clone ID: 700740352H1
tggccacccacgcggctctagcttctacaaggatccccactaacaccaagttcccatccaaggcttcacactctttccaacccaatgcgcctcaaagagacttgaggtgacagattctctgggctagatccacttcatgtgtgaatagtaacgtctaaatctcttttgactgtactcactatccagacatgacacactc

SEQ ID NO: 3271 - DNA, 219 bp, Glycine max
  Clone ID: 700903658H1
ctcaacttctgctacccactctcttcttccaagtccaaccacgccgttctctacagtcatgggcaacgtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacgg

SEQ ID NO: 3272 - DNA, 246 bp, Glycine max
  unsure (1)...(246): unsure at all n locations
  Clone ID: 700756593H1
aaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgntttaantcgacaggggtcacggacancgtaagcancacgangtcatcgggaatgacgagaagacccaacctacggtgactagcca

SEQ ID NO: 3273 - DNA, 256 bp, Glycine max
  Clone ID: 700789341H2
atttctcaacaacttctgctacttcctactccaaccgcacttctgttccgcaattatcatgggctaggtcaagatcggaatcaacggatttggaagaattggccgtttggtagccagagtggctctgcagagagacgatgttgaactcgttgccgttaacgaccctttcatcaccaccgattacttgacatacatgtttaaatacgacagtgttcatgacactggaagcatcacgatgtcaccgttaaggacgaga

SEQ ID NO: 3274 - DNA, 247 bp, Glycine max
  Clone ID: 700751528H1
gcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatctgtagcttcccaactcactcccaagac

SEQ ID NO: 3275 - DNA, 206 bp, Glycine max
  Clone ID: 701046242H1
tctatctctcaccaacttccgctacttcctactccaaccacttacttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaata

SEQ ID NO: 3276 - DNA, 267 bp, Glycine max
  Clone ID: 700606131H2
atacccacgcggctctagcttctacaaggatccccactaacaccaagttcccatccaaggcttcacactcttactcaacccaatgcgcctcaaagagacttgaggtgacagaattctctgggctaagatccacttcatgtgtgacatatgctacgatgctagagaatcttccttttttgatcttgtagcttcccaactcactcccaagaccaatggatcatcaactcctgtgaggggagagacagtggccaagttgaaggtggcaat

SEQ ID NO: 3277 - DNA, 275 bp, Glycine max
  Clone ID: 701063749H1
gctggaattgcattgaataagaactttgtgaagcttgtttcttggtacgacaacgagtggggatacagctcacgtgtcattgatcttcttgtattcgttgccaagaagtctctttaaggtgttacttcaaagtagcttgtcttacattattaccgtatgtttatgtttagctgcgatttagtgtcttgctcgagcaaaaaatgagaggtcctgaataaatcggtttctgaaaccagtggtgttacttgttggaggagcattagctcttttttgga

SEQ ID NO: 3278 - DNA, 235 bp, Glycine max
  Clone ID: 701156830H1
gacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaacttcattaccaccgattacatgacatacatgtttaaatacgacagtg

SEQ ID NO: 3279 - DNA, 266 bp, Glycine max
  Clone ID: 701123759H1
tatgtaatttaacttacttgctgatataaacttcagacagagcgagtcgtcgtaaagctagccttgttgcagccatggccacccacgcggctctatcttctacaaggatccccactaacaccaagttcccatccaaggcttcacactctttcccaacccaattcgcctcaaagagacttgaggtgacagaattctctgggctaagatccacttcatgtgtgacatatgctagcgctgctagagaatcttccttttttgatcttgta

SEQ ID NO: 3280 - DNA, 157 bp, Glycine max
  Clone ID: 700833470H1
ttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgt

SEQ ID NO: 3281 - DNA, 250 bp, Glycine max
  Clone ID: 701043561H1
ggaaaattgactggtatggcataccgtgttcccaccgtggatgtactctgtagtagacctcacggcgaggctggagaaggaagcctcatatgatgggattaaaaatgctatcaaggaggcatcagacggcaagttgaacggaattcttggttacactgaagatgatgtggtctccaccgacttagttggtgataacagatcaagtatttttgatgcaaaggctggaatcgcattgaataagaattttgtg

SEQ ID NO: 3282 - DNA, 218 bp, Glycine max
  Clone ID: 700685547H1
tctcgagccgattcggctcgaggccatggccacccacgcggctcacgcttctacaaggatagcttcaaacacaaggttccactccaaggcctctcactctttcccaacccaatgcgccttaaagagacttgaggtgacagaattctctgggcttagatccacttcatgtgtcacatatgctaacagtgctagagaatcttcctaacttgatcttgtag

SEQ ID NO: 3283 - DNA, 218 bp, Glycine max
  Clone ID: 701215104H1
ttcttttttcccgcagtcatgggcaaggtcaagatcggaatcaacggatttggaagaattggccgtttggtggccagggtggctctgcagagagacgatgttgaactcgttgccgttaacgatcctttcataccaccgattacatgacatacatgtttaaatacgacagtgttcacgggcactggaagcatcacgatgtcaccgttaaggttgagaag

SEQ ID NO: 3284 - DNA, 263 bp, Glycine max
  Clone ID: 701156675H1
tacacgacagaaggggacacaccgtttgttctattcttaactcaacttctgctacccactctcttcttccaagtccaaccacgcttttctctacagtcatgggcaaggtcaagatggaatcaacggatttggaagaattggccgtttggttgccggagtcgctctgcaaagagacgatgtggagctcgttgccgttaacgaccctttcattaccaccgattacatgacatacatgtttaaatacgacagtgttcacggacact

SEQ ID NO: 3285 - DNA, 357 bp, Glycine max
  unsure (1)...(357): unsure at all n locations
  Clone ID: 700650109H1
acaacttctgctacttcctactccaaccgcacttctgctccgcaattatcatggggcaaggtcaagatcggaatcaacggatttggaagaattggccgtttggtagccagagtggctctgcagagagacgatgttgaactcgttgccgttaacgaccctttcatcaccaccgattncatgacatactgtttaaatacgatatgntcatggacatggaagcatcacgtgtcacgttaaggacgagaagaccttctcttcggtgacaagccagtcatattttggacacagnaacctgaagagtccatggggcantggagtgcatcntgtgatccacgganttcacgtaaggcaaggcgc

SEQ ID NO: 3286 - DNA, 129 bp, Glycine max
  Clone ID: 700996816H1
gagtgtttgtggatggccctggggctggtaaacacatccaagcaggtgccaagaaagttattatcactgctcctgcaaagggtgctgatattccaacttatgttgttggtgtaaatgaaggggactaca

SEQ ID NO: 3287 - DNA, 238 bp, Glycine max
  Clone ID: 700875986H1
gccatggccacccacgcggctcttgcttctacaaggatcccttcacacacaaggttcccatccaaggcctctcactctttcccaacccaatgcgccctccagagacttgaggtgacagaattctctgggcttagatccacttcatgtgtcacacatgctaacagtgctagagaatcttccttttttgatcttgtagcttcccaactcactcccaagaccaatggatcaactcctgtga

SEQ ID NO: 3288 - DNA, 166 bp, Glycine max
  Clone ID: 700875036H1
cccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaac

SEQ ID NO: 3289 - DNA, 142 bp, Glycine max
  Clone ID: 700760859H1
tgaactcgttgccgttaacgaccctttcatcaccaccgattacatgacatacatgtttaaatacgacagtgttcatggacactggaagcatcacgatgtcaccgttaaggacgagaagacccttctcttcggtgacaagcca

SEQ ID NO: 3290 - DNA, 254 bp, Glycine max
  Clone ID: 701203868H1
ctcaacttctgctacccactctcttcttccaagtccaaccacgctactctcaagagtcatggtgcagatcaagatcggaatcaacggatttggaagaattggccgtttggttgccagagtcactctgcaaagagacgatgtggagctcgttgccgttaacgaccctttcattaccaccgattacataacatacatgtttaaatacaacagtgttcacggacactggaagcatcacgatgtcaccgttacagacg

SEQ ID NO: 3291 - DNA, 125 bp, Glycine max
  Clone ID: 700684625H1
tgtgaagggaaccatgacaaccacacattcctacacaggagaccagaggcttttggatgcttcacaccgtgacttgagaagagccagggctgcagcactgaacattgtcccaaccagcactggag

SEQ ID NO: 3292 - DNA, 165 bp, Glycine max
  Clone ID: 700743827H1
ctggagctgccaaggctgttggaaaagtcctccctgctttgaatggaaaattgactggtatggcattccgtgttcccactgtggatgtctctgttgttgacctcacagtgaggctggagaaggaagcctcctacgatgaaattaaaaatgctatcaaggaggaat

SEQ ID NO: 3293 - DNA, 259 bp, Glycine max
  Clone ID: 700895366H1
gccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcgactcctgtgaggggagagacagtggcca

SEQ ID NO: 3294 - DNA, 294 bp, Glycine max
  Clone ID: 701155325H1
acggctgcgagaagacgacagaaggggacacaccgtttgttctattcttaactcaacttctgctagccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcactgacactggaagcatcacgaagtcac

SEQ ID NO: 3295 - DNA, 160 bp, Glycine max
  unsure (1)...(160): unsure at all n locations
  Clone ID: 700979884H2
ccactttcntttttcccgcagtcatggncanagtcaagatcggaatcaacggatttggaagaattggccgtttggtggccagggtgnctctgcagagagacgatgttgaactcgttgccgttaacgatcctttcattaccaccgattacatgacatacat

SEQ ID NO: 3296 - DNA, 224 bp, Glycine max
  Clone ID: 700956948H1
cacacaccgtttgttctattcttaactcaacttctgctacccactctcttcttccaagtccaaccacgctcttctctacagtcatgggcaaggtcaagatcggaatcaacggatttggaagaattggccgtttggttgccagagtcgctctgcaaagagacgatgtggagctcgttgccgttaacgaccctttcattaacaccgattacatgacatacatgttt

SEQ ID NO: 3297 - DNA, 288 bp, Glycine max
  unsure (1)...(288): unsure at all n locations
  Clone ID: 700983542H1
ttcttaactcaacttctgctacccactctcttcttccaagtccaaccacgcttttctctacagtcatgggcaaggtcaagatcggaatcaacggatttggaagaattggccgtttggttgccagagtcgctctgnaaagagacgatgtggagtcgttgccgttaacgacccttcattaccaccgattacatgacatncacgtttaaaatacgacagtgttcacggacaactggaagcatcacgatgtcacgttaaggacgagangacccttctcttcggtgacaagcc

SEQ ID NO: 3298 - DNA, 255 bp, Glycine max
  Clone ID: 700750157H1
caacaacttctgctacttcctactccaaccgcacttctggtccgcaattatcatgggcaaggtcaagatcgggatcaacggatttggaagaattggccgtttggtagccagagtggctctgcagagagacgatgttgaactcgttgccgttaacgaccctttcatcaccagcgtttacatgacatacatggtgtagatacgacagtgttcatgggagcactggaatcatggctatgtcgcggttaagggcggaga

SEQ ID NO: 3299 - DNA, 256 bp, Glycine max
  Clone ID: 700856401H1
caacttctgctacccactctcttcttccaagtccagccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattatatgacatacatgtttaaatacgacattgttcacggacactgggaagcatcacgatgtcaccgttaaggacgaga

SEQ ID NO: 3300 - DNA, 275 bp, Glycine max
  Clone ID: 701153529H1
tctcgagccgaatcggctcgagcggctcgagcggctcgagtacggctgcgagaagacgacaaatggggacacaccgtttgtactattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaatgaccctttcattaccaccgatta

SEQ ID NO: 3301 - DNA, 206 bp, Glycine max
  Clone ID: 700740510H1
cccctatctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaa

SEQ ID NO: 3302 - DNA, 192 bp, Glycine max
  Clone ID: 700742952H1
gaaagttgttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccacttcatgtgtcacatatgctaacagtg

SEQ ID NO: 3303 - DNA, 160 bp, Glycine max
  Clone ID: 700754658H1
tttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgttt

SEQ ID NO: 3304 - DNA, 238 bp, Glycine max
  Clone ID: 700876748H1
aggttgtaaagccttgttgctgccatggccacccacgcggatcttgcttctacaaggatcacttcaaacacaaggttcccatccaaggcctctcactctttcccaacccaatgcgccttaaagagacttgaggtgacagaattctctgggcttagatcaaatcatgtgtcacatatggtaaaaggctagagaatcttccttttatgatcttgtagcttcacaactcaatcccaagcag

SEQ ID NO: 3305 - DNA, 186 bp, Glycine max
  unsure (1)...(186): unsure at all n locations
  Clone ID: 700673094H1
ctacttcctantcnaaccgcacttctgctccgcaattntcatgggnaaggtcaagntcggaatcaacgganttggaagnnttggccgtttggtagccagngtggctctgcagagagacgatgttgaactcgttgccgttaangacccttnnatcacnaccgatnacntganngncatgtttaanta

SEQ ID NO: 3306 - DNA, 232 bp, Glycine max
  Clone ID: 700741756H1
ggaggaaatgcaacttacttgttgatataaacttcagacagagcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgcta

SEQ ID NO: 3307 - DNA, 221 bp, Glycine max
  Clone ID: 701209936H1
ctcgagccgaatcggctcgagtatctctcaccaacttccgctacagcctactccaaccacactcttttttcccgcagtcaacgggcaaggtcaagatcggaatcaacggatttggaagaattggccgtttggtggccagggtggctctgcagagagacgatgttgaactcgttgccgttaacgatcctttcattaccaccgattacatgacatacaggtta

SEQ ID NO: 3308 - DNA, 279 bp, Glycine max
  unsure (1)...(279): unsure at all n locations
  Clone ID: 700997818H1
agnagctcaaganaaatctgcaaagaataaaacaagaggaggaaatgcaacttacttgttgatataaacttcagacagagcgagtngttgtaaagccagccttgttgcagccatggccanccacgcggctctagcttctacaaggatccccactaacaccaagttcccatccaaggcttcacactctttcccaacccaatgcgcctcaaagagacttgaggtgacaganttctctgggctaagatccacttcatgtgtganatatgctaacgatgctag

SEQ ID NO: 3309 - DNA, 236 bp, Glycine max
  unsure (1)...(236): unsure at all n locations
  Clone ID: 701150960H1
gacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgacccttnantaaccccggnttacatggantcttntaaaaaanggagttnnnngaggncngggnaant

SEQ ID NO: 3310 - DNA, 265 bp, Glycine max
  Clone ID: 700685752H1
gcagctcaagaaaaatctgcaaagaataaaacaagaggaggaaatgcaacttacttgttgatataaacttcagacagagcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatg

SEQ ID NO: 3311 - DNA, 285 bp, Glycine max
  Clone ID: 700981608H1
aattaatttttttttgacaagcagctcaagaaaaatctgcaaagaataaaacaagaggaggaaatgcaacttacttgttgatataaacttcagacagagcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatg

SEQ ID NO: 3312 - DNA, 129 bp, Glycine max
  Clone ID: 700742082H1
aatgcttcgcacctgctgaaatatgattctatgtctgggaacctttaaggcagatgtgaaaatactagacaatgaaaccatcactgttgatggtaagtccatcaaggttgtttcaagcagggaccctct

SEQ ID NO: 3313 - DNA, 236 bp, Glycine max
  Clone ID: 701146456H1
tgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacgtgtttaaatacga

SEQ ID NO: 3314 - DNA, 280 bp, Glycine max
  unsure (1)...(280): unsure at all n locations
  Clone ID: 700977936H1
caacnagtggggatacagctcacgtgtcattgacctgcttgtattcgttgccaagaagtctttttaaggtggtgtactgcaaagttgcttgtctacacattatgtgcttgtctagttgcgatttagtgtcttgctcgtgcaaaanatgagaggtctgaataaatcggtttctggaaccagtggatttaccttgttaggagcattagctctattttggactttgcctcttgtggaggaggatggagtttttggattttatatattgcnaatgtacttgtcg

SEQ ID NO: 3315 - DNA, 251 bp, Glycine max
  Clone ID: 700897772H1
gacaagcagctctagaaaaatctgcaaagaataaaacaagaggaggaaatgcaacttacttgttgatataaacttcacagagagaaagttgttgtaaagccttgttgctgccatggccacccacgcggctcttgcttctacaaggatcccttcaaacacaaggttcccatccaaggcctctcactctttcccaacccaatgcgccttaaagagacttgaggtgacagaattctctgggcttagatccactt

SEQ ID NO: 3316 - DNA, 259 bp, Glycine max
  Clone ID: 701064028H1
gaggaaatgcaacttacttgctgatataaacttcagacagagcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttga

SEQ ID NO: 3317 - DNA, 187 bp, Glycine max
  Clone ID: 701044915H1
ttcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtgggctcgttgccgttaacgaccctttcattaccaccgat

SEQ ID NO: 3318 - DNA, 301 bp, Glycine max
  unsure (1)...(301): unsure at all n locations
  Clone ID: 700976839H1
cnacgagtggggatacagctcacgtgtcattgacctgcttgtattcgttgccaagaagtctttttaaggtggtgtactgcaaagttgcttgtctacacattatgtgcttgtctagttgcgatttagtgtcttgctcgtgcaaaanatgagaggtctgaataaatcggtttctggaaccagtggatttaccttgttaggagcattagctctattttggactttgcctcttgtggaggaggatggagtttttggntttttatatatttgctaatgtacttgtcgttattgattgttatagtag

SEQ ID NO: 3319 - DNA, 200 bp, Glycine max
  Clone ID: 700830091H1
gtcgagccgaatcggctgaagactcaaacttctgctacccactctcttcttccaagtccaaccaggcttttctctacagtcatgggcaaggtcaagatcggaatcaacggatttggaagaattggccgtttggttgccagagtcgctctgcaaagagacgatgtggagctcgttgccgttaacgaccctttcattcccac

SEQ ID NO: 3320 - DNA, 121 bp, Glycine max
  Clone ID: 700961412H1
caagatcggaatcaacggatttgcgaagaattggccgtttggtggccagggtggctctgcagagagacgatgttgaactcgttgccgttaacgatcctttcattaccaccgattacatgac

SEQ ID NO: 3321 - DNA, 286 bp, Glycine max
  Clone ID: 701104716H1
aggaatcgaggtagagtcaatggacacccacgcggctctagcttctacaaggatccccactaacaccaagttcccatccaaggcttcacactctttctcaacccaatgcgcctcaaagagacttgaggtgacagaattctctgggctaagatccacttcatgtgtgatctatgctaacgatgctagagaatcttccttttttgatcttgtagcttcccaactcactcccaagaccaatggatcatcaactcctgtgaggggagagacatggccagttgaaggtggc

SEQ ID NO: 3322 - DNA, 176 bp, Glycine max
  Clone ID: 700738003H1
ctcgagcgtttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttc

SEQ ID NO: 3323 - DNA, 141 bp, Glycine max
  Clone ID: 700908925H1
gtcatgggcactgtcaagatcggaatcaacggatttggacgaattggccgtttggtggccagggtggctctgcagagagacgatgttgaactcgttgccgttaacgatcctttcattaccaccgattacatgacatacatg

SEQ ID NO: 3324 - DNA, 178 bp, Glycine max
  Clone ID: 701130161H1
gctacttcctactccaaccgcacttctgctccgcaattatcatgggcaaggtcaagatcgggatcaacggctttcgcagaattggccgcttggtagccagattggctctgcagggtcacgatgttgaacccgttgccgttaacgagtctttcatcaccaccgagtacatgacatatgt

SEQ ID NO: 3325 - DNA, 260 bp, Glycine max
  Clone ID: 700754740H1
aacttattcaccactcgttcccgttactccccagcaaccataattattttttttgacaagcagctaagaaaaatctgcaaagaataaaacaagaggaggaaatgcaacttacttgttgatataaacttcagacagagcgagttgttgtaaagctagccttgttgcagccatggccacccacgcggctctagcttctacaaggatccccactaacaccaagttcccatccaaggcttcacactctttcccaacccaatgcg

SEQ ID NO: 3326 - DNA, 97 bp, Glycine max
  Clone ID: 700990677H1
tcaactggagctgatatcattgttgagtccaccggagttttcaccgataaggacaaggccgccgcacatttgaagggtggtgcgaagaaggttattt

SEQ ID NO: 3327 - DNA, 145 bp, Glycine max
  unsure (1)...(145): unsure at all n locations
  Clone ID: 700662952H1
caacttccgctacttcctactccaaccactttcttttttcccgcagtcatgggcaaggtcnagatcggaatcaacggatttggaagaattggccgtttggtggccagggtggctctgcagagagacgatgttgaactcgttgccg

SEQ ID NO: 3328 - DNA, 231 bp, Glycine max
  Clone ID: 700890971H1
cagctcacgtgtcattgacctgcttgtattcgttgccaagaagtctttttaaggtggtgtactgcaaagttgcttgtctacacattatgtgcttgtctagttgcgatttagtgtcttgctcgtgcaaaaaatgagaggtctgaataaatcggtttctggaaccagtggatttaccttgttaggagcattagctctattttggactttgcctcttgtggaggaggatggagt

SEQ ID NO: 3329 - DNA, 216 bp, Glycine max
  Clone ID: 700745113H1
ttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatgacatgtttaaatacggacagtgttcatgggacactgg

SEQ ID NO: 3330 - DNA, 263 bp, Glycine max
  Clone ID: 700683049H1
cttgttgcagccatggccacccacgcggctctagcttctacaaggatctccactaacaccaagttcccatccaaggcttcacactctttcccaacccaatgcgcctcaaagagacttgaggtgacagaattctcgggctaagatccacttcatgtgtgacatatgctaacgatgctagagaatcttccttttttgatcttgtagcttcccaactcactcccaagaccaatggatcatcaactcctgtgaggggagagacagtg

SEQ ID NO: 3331 - DNA, 144 bp, Glycine max
  Clone ID: 701043808H1
cacaacttccgctacttcctactccaaccactttcttttttcccgcagtcatgggcaaggtcaagatcggaatcaacggatttggaagaattggccgtttggtggccagggtggctctgcagagagacgatgttgaactcgttg

SEQ ID NO: 3332 - DNA, 266 bp, Glycine max
  Clone ID: 700563254H1
gtggggatacagctcacgtgtcattgacctgcttgtattcgttgccaagaagtctttttaaggttgtactgaaaaaaaagtagcttgtctagacattatgtgctggtgtctagctgcgattagtgtcttcttgctcggcagaaatgagaagtatgaataaaatcggtttcgggaaccggtgttgttaccctgttaggagcattaagcttttttttgttgtctcttctgtgtaggggatggagtttttggattattatatacttgcg

SEQ ID NO: 3333 - DNA, 273 bp, Glycine max
  Clone ID: 701068370H1
caacgagtggggatacagctcacgtgtcattgatcttcttgtattcgttgccaagaagtctctttaaggtgttacttcaaagtagcttgtcttcacattattaccgtatgtttatgtttagctgcgatttagtgtcttgctcgagcaaaaaatgagaggtctgaataaatcggtttctgaaaccagtggtgttacttgttggaggagcattagctcttttttggacttttgatgttttctcttgtggagggggatcgagtttttggattttta

SEQ ID NO: 3334 - DNA, 232 bp, Glycine max
  Clone ID: 700840885H1
aacggatttggaagaactggccgtttggtagccagagtggctctgcagagagacgatgttgagctcgttgccgttaacgaccctttcatcaccaccgattacatgacatacatgtttaaataccacagtgttcttggacactgcaagcatcacgctgtcaccgttcaggacgagaacacccttctcttaggtgacaagccactcactatttttggacacagaaaccctgaag

SEQ ID NO: 3335 - DNA, 294 bp, Glycine max
  Clone ID: 701146974H1
tacggctgcgagaagagacagaaggggacacaccatccgttctagtctcaacttctgctcttccaactcctacaacgcttttctctgcactcatgggcgaggtcaagatcggaatcaacggatttggaagaattggccgattggttgccagagtcgctctgcaaagagacgatgttgaactcgtcgccgttaacgacgctttcattaccaccgattacatgacatacatgtttaaatacgacagtgttcacggacactggaagcatcacgatgtcaccgttaaagacgagaaga

SEQ ID NO: 3336 - DNA, 249 bp, Glycine max
  Clone ID: 700874586H1
aattttcattttattatttttttgacaagcagctctagaaaaatctgcaaagaataaaacaagaggaggaaatgcaacttacttgttgatataaacttcacagagagaaagttgttgtaaagccttgttgtgccatggccacccacgcggctcttgcttctacaaggatcccttcaaacacaaggttcccatccaaggcctctcactctttcccaacccaatgcgccttaaagagacttgaggtgacag

SEQ ID NO: 3337 - DNA, 260 bp, Glycine max
  Clone ID: 701156431H1
cggctacgagaagacgacagcaagggggaataaaacaagaggaggaaatgcaacttacttgttgatataaacttcacagagagaaagttgttgtaaagccttgttgctgccatggacacccacgaggctccttgcttctacaaggatcccttcaaacacgaggtccccatccaaggcctctcactctttcccaacccaatgcgccttaaagagacttgaggtgacagacttctctgggcttaaatcgacttcatgtgcca

SEQ ID NO: 3338 - DNA, 257 bp, Glycine max
  Clone ID: 700731566H1
cgcacttcacttggcccatttacctgtcattgcggtcttttactcttctcaataccttattaaaaccctatctcactcactcactcacaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacg

SEQ ID NO: 3339 - DNA, 270 bp, Glycine max
  Clone ID: 700739659H1
ttttcattttattatttttttgacaagcagctctagaaaaatctgcacagaataaaacaagaggaggaaatgcaacttacttgttgatatagacttcatagagagaaagtatgtagataagccatgatgctgccatggtcacatacgcggctcttgcttctacaaggatcccttcaaacacaaggttctcatctaaggcatctcactcttgcacaatccaatgcgccttatagagacttgaggtgtcagaattctctggcttagatccac

SEQ ID NO: 3340 - DNA, 122 bp, Glycine max
  Clone ID: 700678096H1
tggaagcatcacgatgtcaccgttaaggacgataagacccttctcttcggtggcaagccagtcactatttttggacacaggaaccctgaagagatcccatgggggtcaactggagctgacat

SEQ ID NO: 3341 - DNA, 159 bp, Glycine max
  Clone ID: 700957692H1
gctctcaccaacttccgctacttcctactccaaccactttcttgtttcccgcagtcatgggcaaggtcaagatcggaatcaacggatttggaagaattggccgtttggtggccagggtggctctgcagagagacgatgttgaactcgttgccgttaacg

SEQ ID NO: 3342 - DNA, 123 bp, Glycine max
  unsure (1)...(123): unsure at all n locations
  Clone ID: 700554603H1
cgcgagctcttgcntctncaaggatcccttacaaacacaaggttcccatccaaggcctctacactactttcccaacccaatgcgccttaaagagacttgaggtgacagaattctctgggctta

SEQ ID NO: 3343 - DNA, 127 bp, Glycine max
  Clone ID: 701126861H1
tcaaccgcacttctgctccgcaattatcatgggcaatgtcaccatcggaatcaacggatttggaagaattggccgtttggtagccagagtggctctgcagagagactatgttgagctcgttgccgtt

SEQ ID NO: 3344 - DNA, 88 bp, Glycine max
  Clone ID: 700679091H2
cacgagtacgagccagagcttgatattatttccaatgctagctgcacaaccaactgccttgccccacttgccaaggttatcactgaca

SEQ ID NO: 3345 - DNA, 150 bp, Glycine max
  Clone ID: 700737463H1
tcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtgga

SEQ ID NO: 3346 - DNA, 226 bp, Glycine max
  Clone ID: 700870957H1
gacaagcagctcaagaaaaatctgcaaagaataaaacaagaggaggaaatgcaacttacttgttgatataaacttcagacagagcgagttgttgtaaagctagccttgttgcagccatggccacccacgcggctctagcttctacaaggatccccactaacaccaagttcccatccaaggcttcacactctttcccaaccaatgcgcctcagagagacttgaggtg

SEQ ID NO: 3347 - DNA, 178 bp, Glycine max
  unsure (1)...(178): unsure at all n locations
  Clone ID: 700651065H1
gtatgacaacgagtggggatacagctcacgtgtcattgacctgcttgtattcgttgccaagaagtctttttaaggttgtactgaaaaaaaagtagcttgtctagacattatgtgctggtgtctagctgcgatttagtgtntcttgctcgggcagaaatgagaagtatgaataaatcgg

SEQ ID NO: 3348 - DNA, 159 bp, Glycine max
  Clone ID: 701064564H1
tcttaactcaacttctgctacccactctcttcttccaagtccaaccacgcttttctctacagtcatgggccaggtcaagatcggaatcaacggatttggaagaattggccgcttggttgccagactcgctctgcaaagagacgatgtggagctcgttgc

SEQ ID NO: 3349 - DNA, 157 bp, Glycine max
  unsure (1)...(157): unsure at all n locations
  Clone ID: 701000079H1
ctcaacttctgctacccactctcttcttccaagtccaaccacgctagntctctacagtcatgggcaaggtcaagatcggaatcaacggatttggaagaattggccgtttggttgccagantcgctctgcaaagagacgatgngganctcgttgccgt

SEQ ID NO: 3350 - DNA, 165 bp, Glycine max
  Clone ID: 700606257H1
gccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtacatatgctaacgatg

SEQ ID NO: 3351 - DNA, 166 bp, Glycine max
  Clone ID: 700752373H1
tctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccg

SEQ ID NO: 3352 - DNA, 286 bp, Glycine max
  Clone ID: 701130139H1
tctttgtgaagcttgtttcttggtacgacaacgagtggggatatctctcacgtgtcattgatcttcttgatttcgttgccaagaagtctctttaaggtgttacttcaaagtagcttgtcttcacattattaccgtatgtttatgtttagctgcgatttactgtcttgctcgagcaaaaaatgagaggtctgaataaatcggtttctgaaaccagtggtgttacttgttggaggagcattagctcttttttggacttttgatgttgtctcttgtggagggggatcga

SEQ ID NO: 3353 - DNA, 284 bp, Glycine max
  Clone ID: 700646156H1
ctaggagtcacgcacttcacttcgcccatttacctgtcattgcggtcttttactcttctcaataccttattaaaaccctatctcactcactcactcacaccgttccatttctcaacaacttctgctacttcctactccaaccgcacttctgctccgcaattatcatgggcaaggtcaagatcggaatcaacggatttggaagaattggccgtttggtagccagagtggctctgcagagagcgatgttgaactcgttgccgttaacgaccctttcatcaccaccg

SEQ ID NO: 3354 - DNA, 138 bp, Glycine max
  Clone ID: 700743668H1
actcaccaacttccgctacttcctactccaaccactttcttttttcccgcagtcatgggcaaggtcaagatcgggatcaacggatttggaagaattggccgtttggtggccagggtggctctgcagagagacgatgtt

SEQ ID NO: 3355 - DNA, 100 bp, Glycine max
  unsure (1)...(100): unsure at all n locations
  Clone ID: 700648908H1
tgctacttcctactccaaccgcacttctgctccgcaattatcatgggcaaggtcaagatcggaatcaacggatttggaaganttggccgtttggtagcca

SEQ ID NO: 3356 - DNA, 128 bp, Glycine max
  unsure (1)...(128): unsure at all n locations
  Clone ID: 700563235H1
ttcttaactcancttctgctanccactntctnctnccangtccaaccacgcttttctctacagtcatgggcaaggtcaanatcggaatcaacggatttggaagaattggncgtttggttgccagantc

SEQ ID NO: 3357 - DNA, 253 bp, Glycine max
  Clone ID: 700961292H1
cgccaatttcattgaaggcctggtcttggatgctaaggagaaaggagcaacattctgtcaggagtacaaaagagaaggcaatctcatttggcctttgctactggacaatgttaggccagacatgagaattgcatgggaagagccatttggaccggttttaccagtaattaggatcaattcagttgaagaaggaatccatcattgtaatgctagcaactttggacttcagggatgtgtcttcacaaaggatgtc

SEQ ID NO: 3358 - DNA, 269 bp, Glycine max
  Clone ID: 700963585H1
atggcattgcaatttcaaagaaggcaggcatgattcctctgcaaatggagttgggaggaaaagatgcctgcattgtacttgaagatgctgacctggatttggttgctgcaaacattataaagggaggtttttcatacagtggtcagagatgcactgctgttaaggttgtcctggtaatggagtccgctgctgatgctttggttgagaaagtgaaggctaaggtggcaaaactaactgttggaccaccagaggatgactgtgatatcacc

SEQ ID NO: 3359 - DNA, 263 bp, Glycine max
  Clone ID: 700683563H1
caggcatgattcctctgcaactggagttaggaggaaaagatgcctgcattgtacttgaggatgctgacctggatttggttgctgcaaacattataaagggaggcttttcatacagtggtcagaggtgcactgctgttaaggttgtcctggtaatggagtccgttgccgatgctttggttgagaaggtgaaggctaaggtggcaaaactaactgttggaccaccagaggatgactgtgatatcaccccggttgtgtcagaatca

SEQ ID NO: 3360 - DNA, 252 bp, Glycine max
  Clone ID: 700791132H1
ggagtttccagcaatcagcgcaggagcgaactgtataagctttactggtggtgatactggcattgcaatttcaaagaaggcaggcatgattcctctgcaaatggagttgggaggaaaagatgcctgcattgtacttgaagatgctgacctgtgatttggttgctgcaaacattataaagggaggtttttcatacagtggtcagagatgcactgctgttaaggttgtcctggtaatggagtccgctgctgatg

SEQ ID NO: 3361 - DNA, 254 bp, Glycine max
  Clone ID: 700890465H1
agaaggcaggcatgattcctctgcaaatggagttaggaggaaaagatgcctgcattgtacttgaggatgctgacctggatttggttgctgcaaacattataaagggaggcttttcatacagtggtcagagggcactgctgttaaggttgtcctggtaatggagtccgttgccgatgctttggttgagaaggtgaaggctaaggtggcaaaactaactgttggaccaccagaggatgactgtgatatcaccccgg

SEQ ID NO: 3362 - DNA, 249 bp, Glycine max
  unsure (1)...(249): unsure at all n locations
  Clone ID: 700983190H1
cagagatgcactgctgttaaggttgtcctggtaatggagtccgctgctgatgcnttggttgagaaagtgaaggctaaggtggcaaaactaactgttggaccaccagaggatgactgtgatatcaccccggttgtgtcagaatcatccgccaatttcattgaaggcctggtcttggatgctaaggagaaaggagcaacattctgtcaggagtacaaaagagaaggcaatctcatttggcctttgctacng

SEQ ID NO: 3363 - DNA, 258 bp, Glycine max
  unsure (1)...(258): unsure at all n locations
  Clone ID: 700983490H1
canagntgcactgctgttaaggttgtcctggtnatggagtccgctgctgatgctntggttgaganagtgaaggctaangtggcaaaacnaactgttggaccaccagaggatgactgtgatatcaccccggttgtgtcagaatcatccgccaatttcattgaaggcctggtcttggatgctaaggagnnaggagcaacattctgtcaggngtacaaaagagaaggcaatctcatttggcctttgctactggacaatgtt

SEQ ID NO: 3364 - DNA, 260 bp, Glycine max
  unsure (1)...(260): unsure at all n locations
  Clone ID: 700992647H1
ggcaaaactaactgttggaccaccagaggatgactgtgatatcaccccggttgtgtcagaatcatccgccaatttcattgaaggcctggtcttggatgctaaggagacaggagcaacattctgtcaggatacaaaagagaaggcaatctcatttggcctttgcnactggacaatnttaggccagacatgagatttgcatgggaagncccattgggnccggtttcccggtatgggnncttncnntngaagggggccccnct

SEQ ID NO: 3365 - DNA, 207 bp, Glycine max
  Clone ID: 701128429H1
atttggttgctgcaaacattataaagggaggcttttcatacagtggtcagaggtgcactgctgttaaggttgtcctggtaatggagtccgttgccgatgctttggttgagaaggtgaaggctaaggtggcaaaactaactgttggaccaccagaggatgactgtgatatcaccccggttgtgtcagaatcatctgccaatttcattg

SEQ ID NO: 3366 - DNA, 268 bp, Glycine max
  Clone ID: 700726390H1
atctctgaccactgtatgaaaaacctccctttataatgtttgcagcaaccaaatccaggtcagagatgcactgctgttaaggttgtcctggtaatggagtccgctgctgatgctttggttgagaaagtgaaggctaaggtggcaaaactaactgttggaccaccagaggatgactgtgatatcaccccggttgtgtcagaatcatccgccaatttcattgaaggcctggtcttggatgctaaggagaatgttgctcctttctccttag

SEQ ID NO: 3367 - DNA, 148 bp, Glycine max
  Clone ID: 700764629H1
gaaggctcaggtggcaaaactaactgttggaccaccagaggatgactgtgatatcaccccggttgtgtcagaatcatccgccaatttcattgaaggcctggtcttggatgctaaggagaaaggagcaacattctgtcaggagtacaaa

SEQ ID NO: 3368 - DNA, 216 bp, Glycine max
  Clone ID: 700729434H1
atctctgaccactgtatgaaaaacctccctttataatgtttgcagcaaccaaatccaggtcagagatgcactgctgttaaggttgtcctggtaatggagtccgctgctgatgatttggttgagaaagtgaaggctaaggtggcaaaactaactgttggaccaccagaggatgactgtgatatcaccccggttgtgtcagaatcatccgccaatttc

SEQ ID NO: 3369 - DNA, 122 bp, Glycine max
  Clone ID: 700957553H1
ctgcaaatggagttgggaggaaaagatgcctgcattgtacttgaagatgctgacctggatttggttgctgcaaacattataaagggaggtttttcatacagtggtcagagatgcactgctgt

SEQ ID NO: 3370 - DNA, 287 bp, Glycine max
  Clone ID: 700726706H1
gccagccaaagatgctgttatggaggttgtaagatctggggatctggtttcttacactgctgaagaaggtgtaaggattctgggagagggaaagttcttggtgtcggatagctttcctggaaatgaaaggacaaaatattgcctcacatccaagattccactaggagtgattttagacattccaccttttaactatcccgtcaatcttgctgtttccaaaattgctcctgccctgattgctggaaactcaattgtgctcaagcctccaactcagggagctgtttctg

SEQ ID NO: 3371 - DNA, 274 bp, Glycine max
  unsure (1)...(274): unsure at all n locations
  Clone ID: 700553529H1
ctggggatctggtttcttatactgctgaagaaggtgtaaggatnctgggagagggaaagttcttggtgtcggatagctttcctggaaatgaaaggacgaaatattgcctcacatccaagattccacttggagtgattttagccattccaccttttaactatcccgtcaatcttgctgtttccaaaattgctcctgcgctgattgctggaaactccattgtgctcaagcctccaactcagggagctgtttctgctcttcatatggttcatgcttt

SEQ ID NO: 3372 - DNA, 244 bp, Glycine max
  Clone ID: 700739431H1
gaaacgtgctgaacttcttcacaaggcagctgctatccttaaagagcacaaagcaccaattgcagagtgcctggtgaaagaaatagcaaagccagccaaagatgctgttacagaggttgtaagatctggggatctggtttcttatactgctgaagaaggtgtaaggattctgggagagggaaagttcttggtgtcggatagctttcctggaaatgaaaggacgaaatattgcctcacatccaag

SEQ ID NO: 3373 - DNA, 244 bp, Glycine max
  Clone ID: 700875340H1
gcaaaatctgcacaaaagttatgggcaaagaccccactatggaaacgtgctgagcttcttcacaaggcagctgctatccttaaagagcacaaaactccaattgcagagtgcctggtgaaagaaatagcaaagccagccaaagatgctgttatggaggttgtaagatctggggatctggtttcttacactgctgaagaaggtgtaaggattctgggagagggaaagttcttggtgtcggatagct

SEQ ID NO: 3374 - DNA, 238 bp, Glycine max
  Clone ID: 700962678H1
gacttggcaaaatctgcccaaaagttatgggcaaagaccccactatggaaacgtgctgaacttcttcacaaggcagctgctatccttaaagagcacaaagcaccaattgcagagtgcctggtgaaagaaatagcaaagccagccaaagatgctgttacagaggttgtaagatctggggatctggtttcttatactgctgaagaaggtgtaaggattctgggagagggaaagttcttgg

SEQ ID NO: 3375 - DNA, 249 bp, Glycine max
  Clone ID: 701214788H1
gcaccaattgcagagtgcctggtgaaagaaatagcaaagccagccaaagatgctgttacagaggttgtaagatctggggatctggtttcttatactgctgaagaaggtgtaaggattctgggagagggaaagttcttgtgtcggatagctttcctggaaatgaaaggacgaaatattgcctcacatccaagattccacttggagtgattttagccattccaccttttactatcccgtcaatcttgctgt

SEQ ID NO: 3376 - DNA, 265 bp, Glycine max
  Clone ID: 701213755H1
gtgaatgagaagacatacaacccaaaaatggacattgtttctaatgcaagctgtacaacgaattgtcttgctcctcttgccaaggtggttaatgaagagtttggaatagttgaagtttgatgacaacggtacatgcaacaacagcaacacaaaagaccgtagatggtccttctatgaaggattggcgaggaggaagaggggcagctcaaaatataattccaagttcaactggtgctgcgaaggccgttgggaaagttcttcctga

SEQ ID NO: 3377 - DNA, 197 bp, Glycine max
  Clone ID: 701213579H1
gtgaatgagaagacatacaacccaaaaatggacattgtttctaatgcaagctgtacaacgaattgtcttgctcctcttgccaaggtggttaatgaagagtttggaatagttgaaggtttgatgacaacggtacatgcaacaacagcaacacaaaagaccgtagatggtccttctatgaaggattggcgaggaggaag

SEQ ID NO: 3378 - DNA, 221 bp, Glycine max
  Clone ID: 701061621H1
gctcgagctttcttctaaaccctatggccgacgaagccaaagccaaaggcaacgcagccttctcctccggggactatcctgccgccatccaccacttctccgatgccatcgccctggctccctccaaccatgtcctctatatcaaccgatccgccgcacacgggtacctcaaaaactacgcagatgcattagcggatgccacaaagacagttgaagtcaag

SEQ ID NO: 3379 - DNA, 291 bp, Glycine max
  Clone ID: 700566452H1
gctcccctcgccaaggttatcaacgaccgatttggaattgtggagggtcttatgaccactgttcatgccatcacagctactcagaagactgttgatggtccatcaaacaaggactggaggggtggaagagctgcttccttcaatataattcccagcagcactggagctgctaaggctgtaggaaaagttcttccagcactgaatggtaaattgactggcatgtccttccgagtccccactgtagatgtttcagttgttgacctcactgttaggctagagaagccagcaacc

SEQ ID NO: 3380 - DNA, 285 bp, Glycine max
  Clone ID: 701051147H1
aattcccagcagcactggagctgctaaggctgtaggaaaagttcttccagcactgaatggtaaattgactggcatgtccttccgagtcaccactgtagatgtttcagttgttgacctcactgtcaggctagagaagccagcaacctatgagcaaacaaatctgctatcaaggaggaatcagagggcaaattgaagggtattttgggttacaccgaagatgatgttgtgtctactgattttgttggtgataacaggtctagcatatttgacgccaaggccggaatt

SEQ ID NO: 3381 - DNA, 273 bp, Glycine max
  Clone ID: 700851348H1
cttgacattgtttctaatgctagctgcactaccaattgccttgctcccctcgccaaggttatcaacgaccgatttggaattgtggagggtcttatgaccactgttcacgccatcacagtatcagaagactgttgatggtccttcaaacaaggactggagaggtggaagagctgcttcgttcaatataattcctagcagcactggagctgctaaggctgtaggaaaagttcttccagcgctgaatggtaaattgactggaatgtccttccgagt

SEQ ID NO: 3382 - DNA, 252 bp, Glycine max
  Clone ID: 700851470H1
cttgacattgtttctaatgctagctgcactaccaattgccttgctcccctcgccaaggttatcactcaccgatttggaattgtggagggtcttatgaccactgttcacgccatcacagctactcagaagactgttgatggtccttcaaacaaggactggagaggtggaagagctgcttcgttcaatataattcctagcagcactggagctgctaaggctgtaggaaaagttcttccagcgctgaatggtaaa

SEQ ID NO: 3383 - DNA, 282 bp, Glycine max
  Clone ID: 701014769H1
gcactggagctgctaaggctgtaggaaaagttcttccagcgctgaatggtaaattgactggaatgtccttccgagtccccactgttgatgtttcagttgttgacctaactgtcaggctagagaagccagcaacctatgagcaaatcaaagctgctatcaaggaggaatcagagggcaaactgaagggtattttgggatacaccgaagatgatgttgtgtctactgattttgttggtgataacaggtctagcatatttgacgccaaggccggaatttctttga

SEQ ID NO: 3384 - DNA, 258 bp, Glycine max
  Clone ID: 700667186H1
ccgatttggaattgtggagggtcttatgaccactgttcatgccatcacagctactcagaagactgttgatggtccatcaaacaaggactggaggggtggaagagctgcttccttcaatataattcccagcagcactggagctgctaaggctgtaggaaaagttcttccagcactgaatggtaaattgactggcatgtccttccgagtccccactgtagatgtttcagttgttgacctcactgttaggctagagaagcc

SEQ ID NO: 3385 - DNA, 238 bp, Glycine max
  Clone ID: 700734161H1
cactaccaattgtcttgctcccctcgccaaggttatcaacgaccgatttggaattgtggagggtcttatgaccactgttcatgccatcacagctactcagaagactgttgatggtccatcaaacaaggactggaggggtggaagagctgcttccttcaatataattcccagcagcactggagctgctaaggctgtaggaaaagttcttccagcactgaatggtaaattgactggcatg

SEQ ID NO: 3386 - DNA, 254 bp, Glycine max
  unsure (1)...(254): unsure at all n locations
  Clone ID: 700669545H1
ccgatttggaattgtggagggtcttatgaccactgttcatgccatncacagctactcagaagactgttgatggtccatcaaacaaggactggaggggtggaagagctgcttccttcaatataattcccagcagcactggagctgctaaggctgtaggaaaagttcttccagcactgaatggtaaattgactggcatgtccttccgagtccccactgtagatgtttcagttgttgacctcactgttaggctagag

SEQ ID NO: 3387 - DNA, 264 bp, Glycine max
  Clone ID: 700895425H1
aaggactggaggggtggaagagctgcttccttcaatataattcccagcagcactggagctgctaaggctgtaggaaaagttcttccagcactgaatggtaaattgactggcatgtccttccgagtccccactgtagatgtttcagttgttgacctcactgttaggctagagaagccagcaacctatgagcaaatcaaatctgctatcaaggaggaatcagagggcaaattgaagggtattttgggttacacagaagatgatgtt

SEQ ID NO: 3388 - DNA, 251 bp, Glycine max
  Clone ID: 701050651H1
ttcagttgttgacctcactgtcaggctagagaagccagcaacctatgagcaaatcaaatctgctatcaaggaggaatcagagggcaaattgaagggtattttgggttacaccgaagatgatgttgtgtctactgattttgttggtgataacaggtctagcatatttgacgccaaggccggaatttctttgaatgacaactttgtaaaacttgtttcctggtatgacaacgaatggggttacagttcccgtg

SEQ ID NO: 3389 - DNA, 276 bp, Glycine max
  Clone ID: 701014770H1
gcactggagctgctaaggctgtaggaaaagttcttccagcgctgaatggtaaattgactggaatgtccttccgagtccccactgttgatgtttcagttgttgacctaactgtcaggctagagaagccagcaacctatgagcaaatcaaagctgctatcaaggaggaatcagagggcaaactgaagggtattttgggatacaccgaagatgatgttgtgtctactgattttgttggtgataacaggtctagcatatttgacgccaaggccggaattt

SEQ ID NO: 3390 - DNA, 250 bp, Glycine max
  Clone ID: 700786662H1
caacgaccgatttggaattgtggagggtcttatgaccactgtcatcgccatcagagctactcagaagactgttgatggtccttcaaacaaggactggagaggtggaagagctctctcgttcaatatattcctagcatcactggagctgctaaggctgtaggaaaagttcttccagcgctgaatggtaaattgactcatatcgtcttccgagtccccactgttgatgtttcagttgttgacctaactgtca

SEQ ID NO: 3391 - DNA, 269 bp, Glycine max
  unsure (1)...(269): unsure at all n locations
  Clone ID: 700974162H1
ctatgagcaaatcaaatctgctatcaaggaggaatcagagggcaaattgaagggtattttgggttacacagaagatgatgttgtgtctactgattttgttggtgataacaggtctagcatatttgacgccaaggccggaatttctttgaatgacaactttgtaaaacttgtttcctggtatgacaacgaatggggttacagttcccgtgtgattgatttgattgtccacattgcatccgtggcttaaagattgagtctgancttggnta

SEQ ID NO: 3392 - DNA, 246 bp, Glycine max
  Clone ID: 700843984H1
ggactggaggggtggaagagctgcttccttcaatataattcccagcagcactggagctgctaaggctgtaggaaaagttcttccagcactgaatggtaaattgactggcatgtccttccgagtccccactgtagatgtttcagttgttgacctcactgtcatgctagagaagccagcaacctatgagcaaatcaaatctgctatcaaggaggaatcagagggcaattgaagggtatttgggttaca

SEQ ID NO: 3393 - DNA, 234 bp, Glycine max
  Clone ID: 700893406H1
gcagcactggagctgctaaggctgtaggaaaagttcttccagcgctgaatggtaaattgactggaatgtccttccgagtccccactgttgatgtttcagttgttgacctaactgtcaggctagagaagccagcacctatgagcaaatcaaagctgctatcaaggaggaatcagagggcaaactgaagggtattttgggatacaccgaagatgatgttgtgtctactgattttgt

SEQ ID NO: 3394 - DNA, 242 bp, Glycine max
  Clone ID: 700740022H1
gccagcaacctatgagcaaatcaaagctgctatcaaggaggaatcagagggcaaactgaagggtattttgggatacaccgaagatgatgttgtgtctactgattttgttggtgataacaggtctagcatatttgacgccaaggccggaatttctttgaatgaaaactttgtaaaacttgtttcctggtatgacaacgaatggggttacagttcccgtgtgattgatttaattgcccacattg

SEQ ID NO: 3395 - DNA, 204 bp, Glycine max
  Clone ID: 701051962H1
cacagctactcagaagactgttgatggtccttcaaacaaggactggagaggtggaagagctgcttcgttcaatataattcctagcagcactggagctgctaaggctgtaggaaaagttcttccagcgctgaatggtaaattgactggaatgtccttccgagtccccactgttgatgtttcagttgttgacctagctgtcaggct

SEQ ID NO: 3396 - DNA, 269 bp, Glycine max
  Clone ID: 700899741H1
gaggaatcagagggcaaattgaagggtattttgggttacacagaagatgatgttgtgtctactgattttgttggtgataacaggtctagcatatttgacgccaaggccggaatttctttgaatgacaactttgtaaaacttgtttcctggtatgacaacgaatggggttacagttcccgtgtgattgatttgattgtccacattgcatccgtggcttaaagaattgagtctgagcttggatatcatcgctacaccttccaaatttttat

SEQ ID NO: 3397 - DNA, 236 bp, Glycine max
  Clone ID: 700890234H1
ggcaaactgaagggtattttgggatacaccgaagatgatgttgtgtctactgattttgttggtgataacaggtctagcatatttgacgccaaggccggaatttctttgaatgaaaactttgtaaaacttgtttcctggtatgacaacgaatggggttacagttcccgtgtgattgatttaattgcccacattgcatccggggcttaaacagttgaggctgatcttggatatcaccg

SEQ ID NO: 3398 - DNA, 145 bp, Glycine max
  Clone ID: 701043720H1
tggagaggtggaagagctgcttcgttcaatataattcctagcagcactggagctgctaaggctgtaggagaagttcttccagcgctgaatggtaaattgactggaatgtccttccgagtccccactgttgatgtttcagttgttg

SEQ ID NO: 3399 - DNA, 220 bp, Glycine max
  Clone ID: 700893919H1
gtcggaatttctttgaatgacaactttgtaaaacttgtttcctggtatgacaacgaatggggttacagttcccgtgtgattgatttgattgtccacattgcatccgtggcttaaagaattgagtctgagcttggatatcatcgctacaccgttccaaatttttatcttaatcgagtttattttagtgtgaattcggaataaacactttgtgttgctgtga

SEQ ID NO: 3400 - DNA, 280 bp, Glycine max
  Clone ID: 701064754H1
cagttgagaaggaatccatcattgtaatgctagcaactttggacttcagggatgtgtcttcacaaaggatgtcaacaaagcaataatgatcagtgatgcaatggaaacgggaacagttcagataaattctgccccagctcgtgggccagatcattttccctttcagggtataaaggacagtggcattggatctcaagggattaccaacagcataaacatgatgaccaaggtcaaaacgactgtgatcaacttacccagcccttcctatactatgggctag

SEQ ID NO: 3401 - DNA, 244 bp, Glycine max
  Clone ID: 700660246H1
gaattgcatgggaagagccatttggaccggttttaccagtaattaggatcaattcagttgaagaaggaatccatcattgtaatgctagcaactttggacttcagggatgtgtcttcacaaaggatgtcaacaaagcaataatgatcagtgatgcaatggaaacgggaacagttcagataaattctgccccagctcgtgggccagatcattttccctttcagggtataaaggacagtggcattgg

SEQ ID NO: 3402 - DNA, 255 bp, Glycine max
  Clone ID: 700725553H1
atgctagcaactttggacttcagggatgtgtcttcacaaaggatgtcaacaaagcaataatgatcagtgatgcaatggaaacgggaacagttcagataaattctgccccagctcgtgggccagatcattttccctttcagggtataaaggacagtggcattggatctcaagggattaccaacagcataaacatgatgaccaaggtcaaaacgactgtgatcaacttacccagcccttcctatactatgggctagt

SEQ ID NO: 3403 - DNA, 246 bp, Glycine max
  Clone ID: 700906586H1
actcgagccgaatcggctcgagttcagttgaagaaggaatccatcactgcaatgctagcaaacttggacttcagggatgtgacttcacaaaggatgtcaacaaagcaataatgatcagtgatgcaatggaaacgggaacagttcagataaattccgccccggctcgtgggccagatcattttccctttcagggtataaaggacagtggcattggatctcaagggattaccaacagcataaacatga

SEQ ID NO: 3404 - DNA, 278 bp, Glycine max
  unsure (1)...(278): unsure at all n locations
  Clone ID: 700555311H1
caaaagagaaggcaatcttatttggcctttgctactggacaatgttaggccagacatgagaatcgcatgggaagagccatttggaccagttttaccagtaattaggatcaattcagttgaagaaggaatccatcattgcaatgctagcaactttggacttcagggatgtgtctcacaaaggatgtcaacaaagcaataatgatgcagtgatgcaatggaaacgggaacagttgcagataantccgccccggctcgtgggccagatcatttcccttcag

SEQ ID NO: 3405 - DNA, 262 bp, Glycine max
  Clone ID: 700655860H1
aagcaataatgatcagtgatgcaatggaaacgggaacagttcagataaattctgccccagctcgtgggccagatcattttccctttcagggtataaaggacagtggcattggatctcaagggattaccaacagcataaacatgatgaccaaggtcaaaacgactgtgatcaacttacccagcccttcctatactatgggctagtagtgtaatacacacatgcatgggggaacatcattatatagcatgttcctaaatcatag

SEQ ID NO: 3406 - DNA, 266 bp, Glycine max
  Clone ID: 700656931H1
cgggaacagttcagataaattccgccccggctcgtgggccagatcattttccctttcagggtataaaggacagtggcattggatctcaagggattaccaacagcataaacatgatgaccaaggtcaaaacgactgtgatcaacttacccagcccttcctatactatgggctagtagtgtaatagttatacacatacatgcatggaggaaaatcaatttatatcatgttccataatcatagtgaagttcaaaagtatgagttcaaca

SEQ ID NO: 3407 - DNA, 268 bp, Glycine max
  Clone ID: 700684630H1
aaacgggaacagttcagataaattccgccccggctcgtgggccagatcattttccctttcagggtacaaaggacagtggcattggatctcaagggattaccaacagcataaacatgatgaccaaggtcaaaacgactgcgatcaacttacccagcccttcctatactatgggctagtagtgtaatagttatacacatacatgcatggaggaaaatcaatttatatcatgttccataaatcatagtgaacgttcaaaacgtatgagttc

SEQ ID NO: 3408 - DNA, 267 bp, Glycine max
  unsure (1)...(267): unsure at all n locations
  Clone ID: 700999674H1
caaatactgttctgacagggtataaaggacagtggcattggatctcaagggattaccaacancctaaacatgatgaccaaggtcaaaacgactgtnatcaacttacccagcccttcctatactatgggctagtagtgtaatagttatacacatacatgcatggaggaaaatcaatttatatcatgttccataaatcatagtgaacgttcaaaacgtatgagttcaacattgccttctcttttgcagcagggtatcatagagatgaat

SEQ ID NO: 3409 - DNA, 326 bp, Glycine max
  unsure (1)...(326): unsure at all n locations
  Clone ID: 700763868H1
atcttttctaacatggctgctgggactggactctttgcagagattttggatggagatgtgtacaagtactatgctgatggagaatggaagaaatctgcttctgggaaaagtgttgccatcatcaaccccactaccagaaagactcaatacaaagttcaagcttgttcacaagaggaggttaacaaggtcatggacttggcaaaatctgcccaaaagttatgggcaaagaccccactatggaaacgtgctgaacttcttcacaaggcagctgctatccttaaagagcacaaagcaccaattgcagagtgcctggtganagaaatagc

SEQ ID NO: 3410 - DNA, 252 bp, Glycine max
  Clone ID: 700789653H2
ggagaatggaagaaatctgcttctgggaaaagtgttgccatcatcaaccccactaccagaaagactcaatacaaagttcaagcttgttcacaagaggaggttaacaaggtcatggacttggcaaaatctgcccaaaagttatgggcaaagaccccactatggaaacgtgctgaacttcttcacaaggcagctgctatccttaaagagcacaaagcaccaattgcagagtgcctggtgaaagaaatagcaaag

SEQ ID NO: 3411 - DNA, 297 bp, Glycine max
  unsure (1)...(297): unsure at all n locations
  Clone ID: 700986940H1
tctatcttttctaacatgggctgctgggactggactctttgcagagattttggatggagatgcgtacaagtactatgctgatggagagtggaagaaatctgcttctgggaaaagtgtttccatcatcaaccccactaccagaaagactcaatacaaagttcaagcttgttcacaagaggaggttaataaggtcatggacttagcaaaatctgcacaaaagttatnggcaaagaccccactatggnaacgtgctgagcttcttcacaaggcagctgctatccttaaagagcacaaaac

SEQ ID NO: 3412 - DNA, 276 bp, Glycine max
  Clone ID: 700982690H1
atccatctatcttttctaacatggctgctgggactggacctctttgcagagattttggatggagatgcgtacaagtactatgctgatggagagtggaagaaatctgcttctgggaaaagtgtttccatcatcaaccccactaccagaaagactcaatacaaagttcaagcttgttcacaagaggaggttaataaggtcatggacttagcaaaatctgcacaaaagttatgggcaaagaccccactatggaaacgtgctgagcttcttcacaaggcc

SEQ ID NO: 3413 - DNA, 298 bp, Glycine max
  unsure (1)...(298): unsure at all n locations
  Clone ID: 700975608H1
ctgggactggnctctttgcagagattttggatggagangtgtacaagtactatgctgatggagaatggnagaaatctgcttctgggaaaagtgttgccatcatcaaccccactaccagaaagactcaatacaaagttcaagcttgttcacaagaggaggttaacaaggtcatggacttggcaaaatctgcccaaaagttatgggcaaagaccccactatggaaacgtgctgaacttcttcacaaggcagctgcncatccttananagcacaaagcaccaattgcagagtgcctggtga

SEQ ID NO: 3414 - DNA, 257 bp, Glycine max
  Clone ID: 700874732H1
ctgggactggactctttgcagagattttggatggagatgtgtacaagtactatgctgatggagaatggaagaaatctgcttctgggaaaagtgttgccatcatcaaccccactaccagaaagactcaatacaaagttcaagcttgttcacaagaggaggttaacaaggtcatggacttggcaaaatctgcccaaaagttatgggcaaagaccccactatggaaacgtgctgaacttcttcacaaggcagctgctatc

SEQ ID NO: 3415 - DNA, 247 bp, Glycine max
  Clone ID: 700956280H1
cttttctaacatggctgctgggactggactctttgcagagattgtggatggagatgtgtacaagtactatgctgatggagaatggaagaaatctgcttctgggaaaagtgttgccatcatcaaccccactaccagaaagactcaatacaaagttcaagcttgttcacaagaggaggttaacaaggtcatggacttggcaaaatctgcccaaaagttatgggcaaagaccccactatggaaacgtgct

SEQ ID NO: 3416 - DNA, 259 bp, Glycine max
  Clone ID: 700891885H1
cgagtatctttctaacatggctgctgggactggactctttgcagagattttggatggagatgcgtacaagtactatgctgatggagagtggaagaaatctgcttctgggaaaagtgtttccatcatcaaccccactaccagaaagactcaatacaaagttcaagcttgttcacaagaggaggttaataaggtcatggacttagcaaaatctgcacaaaagttatgggcaaagaccccactatggaaacgtgctgagctt

SEQ ID NO: 3417 - DNA, 282 bp, Glycine max
  Clone ID: 701145577H1
tctcgagccgcggctgcgagaagacgacagatgggggaagaaatctgcttctgggaaaagtgtctccatcatcaaccccactaccagaaagactcaatacaaagttcaagcttgttcacaagaggaggttaataaggtcatggacttagcaaaatctgcacaaaagttatgggcaaagaccccactatggaaacgtgctgaacttcttcacaaggcagctgctatccttaaagagcacaaaactccaattgcagagtgcctggtgaaagaaatagcaaagcc

SEQ ID NO: 3418 - DNA, 243 bp, Glycine max
  unsure (1)...(243): unsure at all n locations
  Clone ID: 700975787H1
gatggagatgtgtacaagtactatgctgatggagaatggaaganatctgcttctgggaaaagtgttgccatcatcaaccccactaccagaaagactcaataaaagttcaagcncgttcacaagaggaggttaacaaggtcatggacttggcaaaatctgcccaaaagttatgggcaaagaccccactatggaaacgtgctgaacttcttcacaaggcagctgctatccttaaagagcacaaag

SEQ ID NO: 3419 - DNA, 255 bp, Glycine max
  unsure (1)...(255): unsure at all n locations
  Clone ID: 700989677H1
tttctaacatggctgctgggactggnctctttgcagagattttggatggagatgtgtacaagtnctatgctgatggagaatcgaagaaatctgcttctgggaaaagtgttgccatcatcaaccccactaccagaaagactcaatacaaagttcaagcttgttcacaagaggaggttaaccaaggtcatggacttggcaaaatctgcccaaaagttatgggcaaagaccccactatggaaacgtgctgaacttctt

SEQ ID NO: 3420 - DNA, 260 bp, Glycine max
  Clone ID: 700941396H1
cttttctaacatggctgctgggactggactctttgcagagattctggatggagatgtgtacaagtactatgctgatggagaatggaagaaatctgcttctgggaaaagtgttgccatcatcatccccactaccagaaagactctatacaaagttcaagcttgttcacaagaggaggttaacaaggtcatggacttggcaaaatctgcccaaaagttatgggcaaagaccccactatggaaacgtgctgaacttcttcaca

SEQ ID NO: 3421 - DNA, 271 bp, Glycine max
  unsure (1)...(271): unsure at all n locations
  Clone ID: 700985895H1
tatctatccatctatcttttctaacatggctgctgggactggnctctttgcagagattttggatggagatgcgtacaagtactatgctgatggagagtggaaganatctgcttctgggaaaagtgtttccatcatcaaccccactncccagaaagactcaatacaaagttcaagcttgttcacaagaggaggttaataaggtcatggacttagcaaaatctgcacaaaagttatgggcaaagaccccactatggaaacgtgctgagcttct

SEQ ID NO: 3422 - DNA, 261 bp, Glycine max
  unsure (1)...(261): unsure at all n locations
  Clone ID: 700788465H1
ggctgctgggactggactctttgtctagattntggatggagatgtgtataagtactatgctgatggagaatggaagaaatctgcttctgggaaaagtgttgccatcatcaaccccactaccagaaagactcaatacaaagttcaagcttgttcacaagaggaggttaacaaggtcatggacttggcaaaatctgcccaaaagttatgggcaaagaccccactatggaaacgtgctgaacttcttcacaaggcagctgctat

SEQ ID NO: 3423 - DNA, 270 bp, Glycine max
  Clone ID: 700898809H1
aagaaactcattttaactcagactttgcatttcaccttatctatctatcttttctaacatggctgctgggactggactctttgcagagattttggatggagatgtgtacaagtactatgctgatggagaatggaagaaatctgcttctgggaaaagtgttgccatcatcaaccccactaccagaaagactcaatacaaagttcaagcttgttcacaagaggaggttaacaaggtcatggacttggcaaaatctgcccaaaagttatgggc

SEQ ID NO: 3424 - DNA, 252 bp, Glycine max
  unsure (1)...(252): unsure at all n locations
  Clone ID: 700659510H1
ccatctatctttnctaacatggctgctgggactggactctttgcagagattttgganggngatgcgtacaagtactatgctgatggagagtggaagaaatctgcttctgggaaaagtgtttccatcatcaaccccactaccagaaagactcaatacanagttcaagcttgttcacaagaggaggttaataaggtcatggacttagcaaaatctgcacaaaagttatgggcatagncccactatngaaacgtg

SEQ ID NO: 3425 - DNA, 254 bp, Glycine max
  Clone ID: 700957466H1
atggctgctgggactggactctttgcagagattttggatggagatgcgtacaagtactatgctgatggagagtggaagaaatctgcttctgggaaaagtgtttccacatcaaccccactaccagaaagactcaatacaaagttcaagcttgttcacaagaggaggttaataaggtcatggacttagcaaaatctgcacaaaagttatgggcaaagaccccactatggaaacgtgctgcgtcttcacaaagcagt

SEQ ID NO: 3426 - DNA, 239 bp, Glycine max
  Clone ID: 700957672H1
atctatctatccatctatcttttctaacatggctgctgggactggactctttgcagagattttggatggagatgcgtacaagtactatgctgatggagagtggaagaaatctgcttctgggaaaagtgtttccatcatcaaccccactaccagaaagactcaatacaaagttcaagcttgttcacaagaggaggttaataaggtcatggacttagcaaaatctgcacaaaagttatggg

SEQ ID NO: 3427 - DNA, 261 bp, Glycine max
  Clone ID: 700752023H1
ttcgagccgattcggctgagatccatctatcttttctaacatggctgctgggactggactctttgcagagattttggctggagatgcgtacaagtactatgctgatggagagtggaagaaatctgcttctgggaaaagtgtttccatcatcaaccccactaccagaaagactcaatacaaagttcaagcttgttcacaagaggaggttaataaggtcatggacttagcaaaatctgcacaaaagttatgggcaaagacccc

SEQ ID NO: 3428 - DNA, 264 bp, Glycine max
  Clone ID: 700684123H1
taattctcttctcacccttataaaaagaacctcattttaactcagactttgcatttcaccttatctatctatcttttctaacatggctgctgagactggactctttgcagagattttggatggagatgtgtacaagtactatgctgatggagaatggaagaaatctgcttctgggaaaagtgttgccatcatcaaccccactaccagaaagactcaatacaaagttcaagcttgttcacaagaggaggttaacaaggtcatgga

SEQ ID NO: 3429 - DNA, 259 bp, Glycine max
  Clone ID: 701204216H2
cttttctaacatggctgctgggactggactctttgcagagattttggatggagatgtgtacaagtactatgctgatggagaatggaagaaatctgcttctgggaaaagtgttgccatcatcaaccccactaccagaaaactcaatacaaagttcaagcttgttcacaagaggaggttaacaaggtcatggacttggcaaaatctgcccaaaagttatgggcaaagaccccactatggaaacgtgctgaacttcttcaca

SEQ ID NO: 3430 - DNA, 277 bp, Glycine max
  Clone ID: 700684018H1
cctcctaaccttcaataattctcttctcacccttataaaaagaaactcattttaactcagactttgcatttcaccttatctatctatcttttctaacatggctgctgggactggactctttgcagagattttggatggagatgtgtacaagtactatgctgatggagaatggaagaaatctgcttctgggaaaagtgttgccatcatcaaccccactaccagaaagactcaatacaaagttcaagcttgttcacaagaggaggttaacaaggtcatg

SEQ ID NO: 3431 - DNA, 285 bp, Glycine max
  unsure (1)...(285): unsure at all n locations
  Clone ID: 700981833H1
tcatggctgctgggactggnctctttgcagagattttggntggagatgtgtacaagtactatgctgatggagnatggaagaaatctgcttctgggnaaagtgttgccatccatcaaccncactaccagaaagactcaataccaagttcaagcttgttcacnagaggaggttaacaaggtcatggacttggcccnatctgccccaaaagttatggggcaagaccccactatggaaacgtgctgccacttcttcacaaggcagtnctntccttgaccganacgaanc

SEQ ID NO: 3432 - DNA, 261 bp, Glycine max
  Clone ID: 700685767H1
ctcgagccgttctcctctcacccttataaaaacactcattttaactcccacttttgcatttccacctatctatctatccatctatcttttctaacatggctgctgggactggactctttgcagagattttggatggagatgcgtacaagtactatgctgatggagagtggaagaaatctgcttctgggaaaagtgtttccatcatcaaccccactaccagaaagactcaatacaaagttcaagcttgttcacaagaggagg

SEQ ID NO: 3433 - DNA, 243 bp, Glycine max
  Clone ID: 701119840H1
tcctctcacccttataaaaacactcattttaactcccaattttgcatactcacctatctatctatttgtctatcttttctaacatggctgctgggactggactctttgcagagattttggatggagatgcgtacaagtactatgctgatggagtgtggaagaaatctgcttctgggaaaagtgtttccatcatcaaccccactaccagacctcactcaatacaaagttcaagcttgttcacaa

SEQ ID NO: 3434 - DNA, 143 bp, Glycine max
  Clone ID: 700739439H1
gaaatctgcttctgggaaaagtgtttccatcatcaaccccactaccagaaagactcaatacaaagttcaagcttgttcacaagaggaggttaataaggtcatggacttagcaaaatctgcacaaaagttatgggcaaagaccc

SEQ ID NO: 3435 - DNA, 253 bp, Glycine max
  Clone ID: 701108638H1
aattaaaccaaccatactacaccagacactcctcctaaccttcaataattctcttctcacccttataaaaagaaactcattttaactcagactttgcatttcaccttatctatctatcttttctaacatggctgctgggactggactctttgcagagattttggatggagatgtgtacaagtactatgctgatggagaatggaagaaatctgcttctgggaaaagtgttgccatcatcaaccccactaccaga

SEQ ID NO: 3436 - DNA, 108 bp, Glycine max
  Clone ID: 700681550H1
caaagttcaagcttgttcacaagaggaggttaacaaggtcatggacttggcaaaatctgcccaaaagttatgggcaaagaccccactatggaaacgtgctgaacttct

SEQ ID NO: 3437 - DNA, 251 bp, Glycine max
  Clone ID: 700838733H1
ggagaaattaaaccaaccatactacaccagacactcctcctaaccttcaataattctcttctcacccttataaaaagaaactcattttaactcagactttgcatttcaccttatctatctatcttttctaacatggctgctgggactggactctttgcagagattttggatggagatgtgtacaagtactatgctgatggagaatggaagaaatctgcttctgggaaaagtgttgccatcatcaaccccac

SEQ ID NO: 3438 - DNA, 249 bp, Glycine max
  unsure (1)...(249): unsure at all n locations
  Clone ID: 700874784H1
gaaaaattaaaccaaccatactacaccagacactncttctaaccttcaataattctcttctcacccttataaaaagaaactcattttaactcagactttgcatttcaccttatctatctatcttttctaacatggctgctgggactggactctttgcagagattttggatggagatgtgtacaagtactatgctgatggagaatggaagaaatctgcttctgggaaaagtgttgccatcatcaacccca

SEQ ID NO: 3439 - DNA, 247 bp, Glycine max
  Clone ID: 700796275H1
gaaaaattaaaccaaccatactacaccagacactcctcctaaccttcaataattctcttctcacccttataaaaagaaactcattttaactcagactttgcatttcaccttatctatctatcttttctaacatggctgctgggactggactctttgcagagattttggatggagatgtgtacaagtactatgctgatggagaatggaagaaatctgcttctgggaaaagtgttgccatcatcaaccc

SEQ ID NO: 3440 - DNA, 363 bp, Glycine max
  Clone ID: LIB3049-013-Q1-E1-F2
gtcaatactgaagcgagaagacgacagaaggggaagcttgtctcttgggatgacatccactggggatacagttcacgtaccattgacctgcttgtaaccgttgccaagaagtctgtttaattaatgtggttcgaacattaagtgtcggtcaagctgcgatttattatcgtgcacatggaaatattgcgaagtctgaataaattggtttccggaacgagtgttgtcactcagtcatcaacagtacacccggttcttgttgcctcatccgtgtcagggatggacttttttggagtcctagacacgtgcagatgtagtcagggtttattgaatcagatagcagatatttgctctcaatatatcacc

SEQ ID NO: 3441 - DNA, 334 bp, Glycine max
  Clone ID: LIB3049-035-Q1-E1-B2
atacggctgcgagaagacgacagaagggatcaacgacaggagaggcatgcaacaggcgtctcagcatctcacatacgattccatcctcggaaccttcaatgctgatgtcaagcctgttggcagcaatgtcatctccgtggatggaacagaaagcacagttgtttctgatcgcagccctgcgaaccttccatgggacgacttggggatagacttggtgattgaaggaacaggggtgtttgtatacagagaaggtgcagggaaacacattcaagcaggatctaataatgtgctcatcaatgctcctgttaccggagatatcctcacctacatcgtt

SEQ ID NO: 3442 - DNA, 342 bp, Glycine max
  Clone ID: LIB3054-003-Q1-N1-B6
gcattcagagagagtgccgacaatgagctcaagggaatccgatatgagtgtgatgagccacttgtgtgcattgactataggtgcactgctgtgtgctaaaccgttgactactagttgacgcatggccatgggagatgacatggagaacgtgattgcttggtatgacaatgaatggagctactaccaaagggttgctgaattcgctgacattggtgtcaacaaatggaactgagatccaaacaaattgtcattggtaattaaaatatcatgtatgtaccatgacattgaaaatacggatgcttactactactaacactacgacactagtggcttaaactttat

SEQ ID NO: 3443 - DNA, 344 bp, Glycine max
  Clone ID: LIB3028-009-Q1-B1-C6
aacaacttctgctacttcctactccaaccgcacttccggcccgccattaaccagggccaaggccagattcggatccaacggattgggaaaattttggccgttgggaacccaaattggctctgcaaagacacaatgttgaactcgtcgccgtaaacaaccctttcatcaccaccgattacatgacatacatgtttaaatacgacagtgttcatggacactggaagcatcacgatgtcaccgttaaggacgagaacactcttctcgtcggtgacacgccagtcactatttgtggacacaaaccccctgaaaatatcccaggggggtcaactggacctgacatcatt

SEQ ID NO: 3444 - DNA, 358 bp, Glycine max
  Clone ID: LIB3055-013-Q1-N1-E4
gtatattacaaggctctactctactgcttcaccttctgctctagagaatctactggcgatacatggcttccgctactgtctctgcagccaaacgagccattcatgctaatgggaaaggcttctctgaattctatggcattcgcagatcatcaggctacacttgccgtatgtagaaaatcttcagaggatttgcattctggcattgccttccagacctatgcagttacaagcagtacacgatacatgaaggctgtgacagaagcaaaactgaatgctgctcataaaccgatatgcaaagattggaacgaactacttgacgcgctgtcacagtccgatagacttccgtcttgacgtcatt

SEQ ID NO: 3445 - DNA, 389 bp, Glycine max
  Clone ID: LIB3030-004-Q1-B1-G2
aaccaacgaatttgaaatgttgaaggtcctaagaacaatgttcaagccatcaaagctactccaaagaatgttgattgtccaataaacaaagactggaagggttgaaaaactgcttcccttaataataatcccaagcaacactggacctgctaaggctgtatgatcagttcttcagcactgaatggtaaattgactggcatgtccttccgagttcccactgtagatgtttcagttgttgacctcactgttaggctacagaagccagcaacctatgagcaaatcatatctgctatcaaggaagaatcagagggcacattgaagggtattttgggttacacagaagatgatgttgtgtctactgattttgttggtgataacaggtctaacat

SEQ ID NO: 3446 - DNA, 220 bp, Glycine max
  Clone ID: LIB3051-097-Q1-K1-H1
tcgtccgctttttctttttttttttatgatttctgttttagctacacaaagtgtttattccgaattcgcactggtttaatctcgatttagataaaaatttggaacggtgtatcgttgatattcaagctcagactcaattctataatccactgatgcaaagtggacaatcaaattaattacacatgaactttaaccccattctttgtcataccaataaaca

SEQ ID NO: 3447 - DNA, 407 bp, Glycine max
  Clone ID: LIB3039-010-Q1-E1-B9
acgggtgctaaaagaccaccgaaggggagacaacgtttgttcgattcttaacacaacttcagctactcactctcttcttccaggtccagccatgctcttcgctacagtcatgggcacagtcaagatcggaatcaacggatttggaacacttggccgtatggttgccaaagtcgctcttcatcgagacgatgtgtacctcgtttccgtgaatgatgctttcattaacaccgactatatgacatacatgtttcaatacgacatgtgttcacggacactggaagcatcacgatgtcaacgtttatgactagaagacccttctcttcagtgacaagccagtcactgattctggacacatgaaccttgatcagatcgcatgatggtcaaccagagctgatagcattgttgac

SEQ ID NO: 3448 - DNA, 361 bp, Glycine max
  Clone ID: LIB3039-017-Q1-E1-F2
ggctgcgagaagacgacagaaggggacacaccgtttgttctattcttaactcaacttctgctacccactctcttcttcgagggccaaccacgcgtttctctacagtcatgggcaaggtcaggatcggaatcaacgggtttggcagaattgggcgtttgggtgccagagtcgctctgcggagagacgatgtggagctcgttgccgttaacgagcctttcattaccaccggttacatgacatacatgtttaaatacgacagtgttcacggacactggaagcatcacgatgtcaccgttaacgacgagaagacccttctcttcggtagcaagccagtcaggggggtgtggacacaggaaccctg

SEQ ID NO: 3449 - DNA, 402 bp, Glycine max
  Clone ID: LIB3028-008-Q1-B1-F6
ctatactgcttcaccttctgctctagaaaattcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaacaagcctctcaccttctcaaatacgattccatcctcc

SEQ ID NO: 3450 - DNA, 417 bp, Glycine max
  Clone ID: LIB3053-005-Q1-N1-D9
ggcaaactcaatggcattgcactccgtgtgccaacaccaggcgtctcagtggtggacctcgttgttcaggtctcaaagaagacctttgcagaagaagtgaatgcagcattcagagagagtgcagacaatgagctccagggaatcctctctgtgtgtgatgagccacttgtgtctgttgacttcaggtgcactgatgtgtcctcaaccgttgactcatcgttgaccatggtcatgggagatgacatggttaaggtgattgcttggtatgacaatgagtggggctactcccaaagggttgtggatttggctgacattgttgccaacaagtggaagtgagagccatcaaattctgaattggtaattcaattattatatgtatgtaccatgccattgtagttttgtatgcttactactact

SEQ ID NO: 3451 - DNA, 373 bp, Glycine max
  Clone ID: LIB3054-004-Q1-N1-E12
gcctctactatactgcttcaccttctgctctagaaaatgcagtgctgaaacatggcttcggctactctctctgtagccaaaccagcccttcaggcaaatgggaaaggcttctctgaattctctggcctccgaagctcatcaggcttccttcccttttctagaaaatcttcagaggatttccattctgtcattgccttccagacctatgcagttggaagcagtggaggatacaagaagggtgtgacagaagcaaaactgaaggttgccataaacgggtttggaaggattggaaggaacttcttgaggtgctggcacggtcgcaaagactcccctcttgatgtcattgccatcaacgacaccggcggcgtgaaac

SEQ ID NO: 3452 - DNA, 360 bp, Glycine max
  Clone ID: LIB3053-006-Q1-N1-E5
gcctctactatactgcttcaccttctgctctaggaaagggagtgctgaaacatggcttcggctactctctctgtagccaaaccagcccttcaggcaaatgggaaaggcttctctgaattctctggcctacgaagctcatcaggcttccttcccttttctagaaaatcttcagaggatttccattctgtcattgccttacagacctatgcagttggaagcagtggaggatacaagaagggtgtgacagaagcaaaactgaaggttgccataaacgggttaggaaggattggaaggaacttcttgaggtgctgacacggtcgcaaagactcccctctagatgacattgccatcaacgacacc

SEQ ID NO: 3453 - DNA, 329 bp, Glycine max
  Clone ID: LIB3053-006-Q1-N1-C11
ggcaaactctttggcattgcactccgtgtgccaactcctgacgtctcagtggtggacctcgttgttcaggtctcaaagaagacctttgcagaagaagtgaatgcagcattcagagagagtgcagacaatgagctccagggaatcctctctgtgtgtgatgagccacttgtgtctgttgacttcaggtgcactgatgtgtcctcaaccgttgactcatcgttgaccatggtcatgggagatgacatggttaaggtgattgcttggtatgacaatgagtggggctacttcccaaagggttgtggatttggcttgcattgttgccaacaatt

SEQ ID NO: 3454 - DNA, 393 bp, Glycine max
  Clone ID: LIB3028-003-Q1-B1-D12
gtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggatttggaaggattggaaggaacttcttgaggtgctggcacggtcgcaaagactcccctcttgatgtcattgccatcaacgacaccggtggcgtgaaaaaagcctctc

SEQ ID NO: 3455 - DNA, 321 bp, Glycine max
  Clone ID: LIB3040-023-Q1-E1-D10
gcgtcagacggcatgcgaaagacgacagaagggaggagcagcaaaggcagtggcccttgtcctcccaaccctcaagggcaaactcaatggcattgcactccgtgtgccaacaccaaacgtctcagtggtggacctcgttgttcaggtctcaaagaagacctttgcagaagaagtgaatgcagcattcagagagagtgcagacaatgagctccagggaatcctctctgtgtgtgatgagccacttgtgtctgttgacttcaggtgcactgatgtgtcctcaaccgttgactcatcgttgaccatggtcatgggagatgacat

SEQ ID NO: 3456 - DNA, 399 bp, Glycine max
  unsure (1)...(399): unsure at all n locations
  Clone ID: LIB3040-036-Q1-E1-A12
tacggctgcgagaagacgacagaagggggaaaatctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaggttgccataaacggatttggaaggattggaaggaacttcttgangtgctggcacggtcgcaaagactcccctcttgatgtcattgccatc

SEQ ID NO: 3457 - DNA, 267 bp, Glycine max
  Clone ID: LIB3055-006-Q1-N1-B3
caaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaagatcttcagaggatttccattctgtcattgccttccagacctatgcagttggaagcagtggaggatacaagaagggtgtgacagatgcataactgaaggtt

SEQ ID NO: 3458 - DNA, 286 bp, Glycine max
  Clone ID: LIB3055-002-Q1-B1-A9
ctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcagttggaagcagtggaggatacaagaagggtgtgacagaagcaaaactgaaagttgccataaa

SEQ ID NO: 3459 - DNA, 344 bp, Glycine max
  Clone ID: LIB3040-053-Q1-E1-D5
agggctgcgagaagacgacagaagggggaacctgaaaatctagtttcttacaaggctctactctactgcttcaccttctgctctagaaaattcagtggtgatacatggcttcggctactctctctgtagccaaaccagcccttcaggcaaatgggaaaggcttctctgaattctctggcctccgcagctcatcaggcttccttcccttttctagaaaatcttcagaggatttccattctgtcattgccttccagacctatgcacttggaagcagtggaggatacaagaagggtgtgacataagcaaaactgaaggttgccataaacggatttggaacgattgga

SEQ ID NO: 3460 - DNA, 441 bp, Glycine max
  unsure (1)...(441): unsure at all n locations
  Clone ID: LIB3051-059-Q1-K2-D8
tttctaatctcattctccttctgttcaaacactctctctcatggcatcagataagaagattaggatcggcatcaacgggtttggaaggattggccgtttggtggccagggttgcccttcaaaggaatgatgttgaacttgttgctgtcaacgatcctttcatcaccactgattacatgacatacatgttcaagtacgacaccgttcatggccagtggaagcattttgatgtgaaggtgaaggactctaagacccttctctttggtgagaagcccgtcaccgtttttggaatcaggaaccctgaggaaattccatggngtgaggttggtgctgattatgttgttgagtcaactggtgtattcactgacanggacaangctgctgctcacttgaagggtggtgccaagaaggttgtcatctctgccccaagcaaagatgcacc

SEQ ID NO: 3461 - DNA, 369 bp, Glycine max
  Clone ID: LIB3039-009-Q1-E1-H2
aggctgcataagacgacagaaggggaccaaatcacgctctctaataacatttctaatctcattctccttctgttcaaatactctctctcatggcatcagataagaagattaggatcggcatcaacgggtttggaaggattggccgtttggtggccaaggttgcccttcaaaggagtgatgttgaacttgttgctgtcaacgatcctttcatcaccactgattacatgacatacatgttcaagtacgacaccgttcatggccagtggaagcattttgatgtgaaggtgaaagactctaagacccttctctttggtgagaagcccgtcaccgtttttggaatcagggaacctgaggaaattccatgggggt

SEQ ID NO: 3462 - DNA, 418 bp, Glycine max
  Clone ID: LIB3052-014-Q1-N1-E5
ctctttcccaacccaatgcgccttaaagagacttgaggtgacagaattctctgggcttagatccacttcatgtgtcacatatgctaacagtgctagagaatcttccttttttgatcttgtagcttcccaactcactcccaagaccaatggatcaactcctgtgaggggagagacagtggccaagttgaaggtggcaatcaatggtttcggacgcattggtagaaacttccttcgctgctggcacggccgaaaagactcaccccttgaagtcgttgttgtcaacgacagtggtggtgtcaagaatgcttcgcacctgctgaaatatgattctatgctgggaacctttaaggcagatgtgaaaatactagacaatgaaaccatcactgttgatggtaagtccatcaaggttgtttcaagc

SEQ ID NO: 3463 - DNA, 363 bp, Glycine max
  Clone ID: LIB3055-002-Q1-B1-A6
accgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggacaagggcgccgcaca

SEQ ID NO: 3464 - DNA, 402 bp, Glycine max
  Clone ID: LIB3028-004-Q1-B1-C2
gcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtgcaaagaaggttattatttctgcccccag

SEQ ID NO: 3465 - DNA, 420 bp, Glycine max
  Clone ID: LIB3065-011-Q1-N1-E4
gtctcaacttctgctcttccaactcctacaacgcttggctgtgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggctgccgcacattcgaagggtggtgccaagaaggttattatttct

SEQ ID NO: 3466 - DNA, 412 bp, Glycine max
  unsure (1)...(412): unsure at all n locations
  Clone ID: LIB3053-014-Q1-N1-D3
ggccacccacgcggttctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaatcaatggtttcggacgcattggtagaaacttccttcgctgctggcacggccgaaaagactcaccccttgaggtcgttgttgtcaacgacagtngtggtgtcaagaatgcttcgcacctgcttaaatatgattccatgctggga

SEQ ID NO: 3467 - DNA, 448 bp, Glycine max
  Clone ID: LIB3051-063-Q1-K1-F4
aacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcgctatttttggacacagaaaccctgaagagatcccatgggggtcaactggagctgacatcattgttgagtccaccggagttttcaccgataaggacaaagccgtcgcacatttgaagggtggtgcaaaagaggttattatttctgcccccagtaaagatgcccccatgtttg

SEQ ID NO: 3468 - DNA, 419 bp, Glycine max
  Clone ID: LIB3040-052-Q1-E1-B5
gacagtgttcacagacactggaagcagcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaagctgccgcacatttgaagggtggtgccaagaaggttattatttctgcccccagtaaggatgcccccatgtttgttgttggtgttaatgagcacgagtacaagccagagcttgatactatttccaacgctagctgcacaatcaactgccttgctccactccccaaggttatcaatgacaggtttggcattgttgacggtttgatgacaacggttcattccatcactgccacccagaagac

SEQ ID NO: 3469 - DNA, 397 bp, Glycine max
  Clone ID: LIB3054-006-Q1-N1-C1
gtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggctgccgcacatttgaagggtg

SEQ ID NO: 3470 - DNA, 322 bp, Glycine max
  Clone ID: LIB3052-001-Q1-B1-C6
caccgttaaggacgagaagacccttctcttcggtgacaagccagtcactatttttggacacagaaaccctgaagagatcccatgggggtcaactggagctgacatcattgttgagtccaccggagttttcaccgataaggacaaggccgccgcacatttgaagggtggtgcaaagaaggttattatttctgcccccagtaaggatgcccccatgtttgttgttggtgtcaacgagcacgagtacaagccagagcttgatattatttccaatgctagctgcacaaccaactgccttgccccacttgccaaggttatcaatgac

SEQ ID NO: 3471 - DNA, 406 bp, Glycine max
  Clone ID: LIB3055-004-Q1-N1-F6
gcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaaggtggcaatcaatggtttcggacgcattggtagaaacttccttcgctgctggcacggccgaaaagactcaccccttgaggtcgttgttgtcaacgacagtggtggtgtca

SEQ ID NO: 3472 - DNA, 453 bp, Glycine max
  Clone ID: LIB3051-087-Q1-K1-E1
tttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaagacaaggccggcgcacattttgaaggtggtgccaaagaaggtattatttctggccccagtaaggatgcccccatg

SEQ ID NO: 3473 - DNA, 424 bp, Glycine max
  Clone ID: LIB3051-018-Q1-E1-H11
aattcccggccgacccacgacgtcagcccacgcgtccggtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttgagtccaccggagttttcaccgataaggacaaggctgccgcaca

SEQ ID NO: 3474 - DNA, 365 bp, Glycine max
  Clone ID: LIB3056-012-Q1-N1-H7
ctcgagccgcttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcatttgtgagtcccacggagttt

SEQ ID NO: 3475 - DNA, 381 bp, Glycine max
  Clone ID: LIB3052-014-Q1-N1-E1
cgcgtacgcatgctggggcttgggattcagctcgagctctttgccatcccaatgcgccttaaagagacttggggtgacagaattctctggggtgagatccacttcatgtgtcacatatgctaacagtgctagagaatcttgcttttttgatcttgtagcttcccaactcactcccaagaccaatggatcaactactgtgaggggagagacagtggccaagttgaaggtggcaatcaatggtttcggacgcattggtagaaacttccttcgctgctggcacggccgaaaagactcaccccttgaagtcggtggtgtcaacgacagtggtggtgtcaggaatggctcgcacctgctgaaatatgattctatgctgggaacctt

SEQ ID NO: 3476 - DNA, 402 bp, Glycine max
  Clone ID: LIB3039-015-Q1-E1-A12
tacggctgcgagaagacgacagaaggggacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatcattgttgagtcaacggagttttc

SEQ ID NO: 3477 - DNA, 404 bp, Glycine max
  Clone ID: LIB3039-003-Q1-E1-C4
acaccgtctggtctattcttaactcaacttctgctacccagtctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatatatgtttaaatacgacagtgttcacggacactggaagcatcacgatgtcaccgttaaggacgagaagacccttctcttcagtgacaagccagtcactgtttttggacacaggaaccctgaagagatcccatgggggtcaactggagctgatatcattgttgagtccaccggagttttcaccgataaagac

SEQ ID NO: 3478 - DNA, 379 bp, Glycine max
  Clone ID: LIB3040-015-Q1-E1-H5
tacggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatccatgggggtcaactggagctgacat

SEQ ID NO: 3479 - DNA, 437 bp, Glycine max
  Clone ID: LIB3040-041-Q1-E1-A4
cacgcgtcagacggatgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatcccatgggggtcaactggagctgatatcattgttgagtccaccggagttttcaccgat

SEQ ID NO: 3480 - DNA, 442 bp, Glycine max
  Clone ID: LIB3040-004-Q1-E1-E11
tacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatgggggtcaactggagctgatatcattgttgagtcaccggagtttcaccgataaggacaaggccgccgc

SEQ ID NO: 3481 - DNA, 407 bp, Glycine max
  Clone ID: LIB3039-036-Q1-E1-D10
agacggctgcgagaagacgacagaaggggacaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttt

SEQ ID NO: 3482 - DNA, 420 bp, Glycine max
  Clone ID: LIB3039-030-Q1-E1-D5
tacggctgcgagaagacgacagaaggggacacaccgtttgttctattcttaactcaacttctgctacccactctcttcttccaagtcgaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacataggaaccctgaagagatcccatgggggtcaactggagctgatatcattgttgagtccaccggagttt

SEQ ID NO: 3483 - DNA, 422 bp, Glycine max
  Clone ID: LIB3055-008-Q1-N1-E2
aaccactttttgtactttcttattcaaaccgaacttttgttccgaatttatcatggccaaggtcaagatcggaatcaacggatttggaaaaattgggcgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttcaccgataaggacaaggccggcgcacatttgaagggtggtgcaaagaaggttattattt

SEQ ID NO: 3484 - DNA, 412 bp, Glycine max
  Clone ID: LIB3039-003-Q1-E1-G1
tacggctgcgagaagacgacagaaggggaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagattccatgggggtcaactggagctgacatcattgttgagtccaccggagttttcaccgat

SEQ ID NO: 3485 - DNA, 424 bp, Glycine max
  Clone ID: LIB3049-020-Q1-E1-A4
aatacggctgcgagaagacgacagaagggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatcccatgggggtcaactggagctgatatcattgttgagtccacgggagttttca

SEQ ID NO: 3486 - DNA, 395 bp, Glycine max
  Clone ID: LIB3030-012-Q1-B1-D5
ggacgagaagacccttctcttcggtgacaagccagtcactatttttggacacagaaaccctgaagagatcccatgggggtcaactggagctgacatcattgctgagtccaccggagttttcaccgcggaggacaaggccgccgcacatttgaagggtgctgcaaagcaggttcctatttctgcccccagtaaggatgcccccatgtctgttgttcgcgtcaaccagcacgagtacaagccagagcttgacattatttccaatgctagctgcacaaccaactgccttgccccacttgccacggttagcaatgacaggtttggcagtgttgacggtttgattaccactgttcattccatcagcgctacccacacgactgtttatggaccatccgccc

SEQ ID NO: 3487 - DNA, 429 bp, Glycine max
  unsure (1)...(429): unsure at all n locations
  Clone ID: LIB3039-007-Q1-E1-F8
aatacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatggnggtcaactggagctgatatcattgttgagtccacgggagttttcaacgat

SEQ ID NO: 3488 - DNA, 354 bp, Glycine max
  Clone ID: LIB3056-003-Q1-N1-H12
caacaacttctgctacttcctactccaaccgcacttctgttccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcatttgtgagtccca

SEQ ID NO: 3489 - DNA, 413 bp, Glycine max
  Clone ID: LIB3049-044-Q1-E1-H6
cccacgcgtccgtacggctgcgagaagacgacagaaggggaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggag

SEQ ID NO: 3490 - DNA, 352 bp, Glycine max
  Clone ID: LIB3051-042-Q1-K1-D7
ccaacttccgctacttcctactccaaccactttcttttttcccgcagtcatgggcagggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatcccatggaagtcgactggagctgacatcattgttgagttcacc

SEQ ID NO: 3491 - DNA, 422 bp, Glycine max
  Clone ID: LIB3039-005-Q1-E1-F7
agtacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatgggggtcaactggagctgatatcattgttgagtccaccggagtttt

SEQ ID NO: 3492 - DNA, 423 bp, Glycine max
  Clone ID: LIB3040-028-Q1-E1-C3
gcgtccaacggatgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatcccatgggggtcaactggagctgatatcattgttgagtccaccggag

SEQ ID NO: 3493 - DNA, 380 bp, Glycine max
  Clone ID: LIB3049-014-Q1-E1-A10
atacggctgcgagaagacgacagaaggggaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctggagagatcccatgggggtcaactggagctgac

SEQ ID NO: 3494 - DNA, 422 bp, Glycine max
  Clone ID: LIB3040-012-Q1-E1-G8
tacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatgggggtcaactggagctgatatcattgttgagtccaccggagttttca

SEQ ID NO: 3495 - DNA, 381 bp, Glycine max
  Clone ID: LIB3040-061-Q1-E11-F6
atacggctgcgagaagacgacagaaggggaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatgggggtcaactggagctgacat

SEQ ID NO: 3496 - DNA, 440 bp, Glycine max
  Clone ID: LIB3049-044-Q1-E1-G1
ccggctcgaccacgcgtccatacggctgcgagaagacgacagaaggggaccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatccatgggggtcaactggagctgacatcattgttgagtccaccggagttttcaccgataaggacaag

SEQ ID NO: 3497 - DNA, 401 bp, Glycine max
  Clone ID: LIB3039-040-Q1-E1-A8
cccacgcgtccggcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgacgagattccatgggggtcaactggagctgata

SEQ ID NO: 3498 - DNA, 422 bp, Glycine max
  Clone ID: LIB3049-054-Q1-E1-G11
gcgtccgaccacacgtccgtacggctgcgagaagacgacagaagggggttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattgttgagtccaccggagttttc

SEQ ID NO: 3499 - DNA, 381 bp, Glycine max
  Clone ID: LIB3051-062-Q1-K1-B9
cccacgcgtccgcccacgcgtccgcccacgcgtccgacaacttctgctacttcctacgccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtcaactggagctgacatcattggtg

SEQ ID NO: 3500 - DNA, 381 bp, Glycine max
  Clone ID: LIB3040-039-Q1-E1-A5
agacggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatccatgggggtcaactggagctgacatc

SEQ ID NO: 3501 - DNA, 389 bp, Glycine max
  Clone ID: LIB3039-031-Q1-E1-E11
agaggctgcgagaagacgacagaaggggcacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatgggggtcaactgga

SEQ ID NO: 3502 - DNA, 423 bp, Glycine max
  Clone ID: LIB3040-043-Q1-E1-G3
tacggctgcgagaagacgacagaagggtacggctgcgagaagacgacagaagggtacggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatccatgggggtcaactg

SEQ ID NO: 3503 - DNA, 408 bp, Glycine max
  unsure (1)...(408): unsure at all n locations
  Clone ID: LIB3039-031-Q1-E1-A7
agcccacgcgtccgacggctgcggaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatggnggtcaactggagctgatat

SEQ ID NO: 3504 - DNA, 419 bp, Glycine max
  Clone ID: LIB3039-047-Q1-E1-B12
attccaagccgacccacccgtcaagtaggctacgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatcccatgggggtcaactggagctgat

SEQ ID NO: 3505 - DNA, 392 bp, Glycine max
  Clone ID: LIB3039-033-Q1-E1-D8
agtacggctgcgagaagacgacagaaggggacacaccgtttgttcgattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacatgaaccctgaagagattccatgggggtcaactggag

SEQ ID NO: 3506 - DNA, 446 bp, Glycine max
  Clone ID: LIB3040-010-Q1-E1-A11
cccacgcgtccgcccacgcgtccgtacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatcccatgggggtcaactggagctgatatcattgttgaatccaaccgagttttc

SEQ ID NO: 3507 - DNA, 363 bp, Glycine max
  Clone ID: LIB3040-015-Q1-E1-G5
tacggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatggggg

SEQ ID NO: 3508 - DNA, 418 bp, Glycine max
  Clone ID: LIB3040-008-Q1-E1-G6
tacggctgcgagaagacgacagaagggtacggctgcgagaagacgacagaaggggactgccttcttaaaaccctatctctcaccaacttccgctacttcctactccaaccactttcttttttcccgcagtcatgggcaaggtcaagatcggaatcaacggatttggaagaattggccgtttggtggccagggtggctctgcagagagacgatgttgaactcgttgccgttaacgatcctttcattaccaccgattacatgacatacatgtttaaatacgacagtgttcacgggcactggaagcatcacgatgtcaccgttaaggatgagaagacccttctcttcggtgacaagccagtcactgtttttggacacaggaaccctgaagagatccatggaagtcgactggagctgacatc

SEQ ID NO: 3509 - DNA, 428 bp, Glycine max
  Clone ID: LIB3049-045-Q1-E1-H2
cgggccgacccacgcgtcagcccacgcgtccgcccacgcgtccgtacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaggagatccatgggggtcaac

SEQ ID NO: 3510 - DNA, 437 bp, Glycine max
  Clone ID: LIB3065-008-Q1-N1-B3
cgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgctcatggacactggaagcatcacgatgtcaccgtttaggacgagaagacccttctcttccgtgacaagccagtcactatttttggacacagaaaccctgaagagatcccattggggtcaactggagctgacatcattgttgagtccacccgagttttcaccgattaggacaaggccgtcgcacatttgtaggggggtgcaaaggaagttattatttctggccccagtaaggatgcccccatgtttgttggtgtgtcaacg

SEQ ID NO: 3511 - DNA, 380 bp, Glycine max
  Clone ID: LIB3039-028-Q1-E1-D6
agtacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaatcctgaagagatccatgggg

SEQ ID NO: 3512 - DNA, 358 bp, Glycine max
  Clone ID: LIB3039-045-Q1-E1-D5
acgtacgtacggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagag

SEQ ID NO: 3513 - DNA, 420 bp, Glycine max
  Clone ID: LIB3040-058-Q1-E1-G12
acccaggcgtccgcccacgcgtccgtgcggctgcgagaagacgacataagggggttgatataaacttcagacagagcgagttgttgtaaagctagccttgttgcagccatggccacccacgcggctctagcttctacaaggatccccactaacaccaagttcccatccaaggcttcacactctttcccaacccaatgcgcctcaaagagacttgaggtgacagaattctctgggctaagatccacttcatgtgtgacatatgctaacgatgctagagaatcttccttttttgatcttgtagcttcccaactcactcccaagaccaatggatcatcaactcctgtgaggggagagacagtggccaagttgaacgtggcaatcaatggtttcggacgcattggtataaacttccatcgctgc

SEQ ID NO: 3514 - DNA, 425 bp, Glycine max
  unsure (1)...(425): unsure at all n locations
  Clone ID: LIB3049-034-Q1-E1-F1
ggctcgacccacgcgtacgtacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgnagaagaccttctcttcggtgacaagccagtcactgtttttggacacaggaaccctgaagagatcccatgggggtcaactggagctgatatcattgttga

SEQ ID NO: 3515 - DNA, 387 bp, Glycine max
  Clone ID: LIB3039-050-Q1-E1-C11
acggctgcgagaagacgacagaaggggcccgttccatttctcaacaacttctgctacttcctactccaaccgcacttctgctccgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaatgacgagaagacccttcccttcggtgacaagccagtcactatttttggacacagaaaccctgaacagatcccatgggggtcaactggagctgacctcattgtt

SEQ ID NO: 3516 - DNA, 419 bp, Glycine max
  Clone ID: LIB3040-042-Q1-E1-E12
cccacgcgtccgacggctgcgagaagacgacagaagggtacggctgcgagaagacgacagaaggggacacaccatccgttctagtctcaacttctgctcttccaactcctacaacgcttttctctgcactcatgggcaaggtcaagatcggaatcaacggatttggaagaattggccgtttggttgccagagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacagaaaccctgaagagatcccatgggggtcaactggagctgacatc

SEQ ID NO: 3517 - DNA, 416 bp, Glycine max
  Clone ID: LIB3040-030-Q1-E1-E11
acccacgcgtccgcccacgcgtccgacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagaaccttctcttcggtgacaagccagtcactgtttttggacacaggaaccctgaagagatcccatgggggtcaactggagct

SEQ ID NO: 3518 - DNA, 364 bp, Glycine max
  Clone ID: LIB3040-054-Q1-E1-E9
agacggctgcgagaagacgacagaagggggttccatttctcaacaacttctgctacttcctactccaaccgcacttctgctccgcaattatcatgggcaaggtcaagatcggaatcaacggatctggaagaattggccgtttggtagccagagtggctctgcagagagacgatgttgaactcgttgccgttaacgaccctttcatcaccaccgattacatgacatacatgtttaaatacgacagtgttcatggacactggaagcatcacgatgtcaccgttaaggacgagaagacccttctcttcggtgacaagccagtcactatttttggacacagaaaccctgaagagatcccatgggggtc

SEQ ID NO: 3519 - DNA, 386 bp, Glycine max
  Clone ID: LIB3039-046-Q1-E1-H3
cacgcgtcagacggatgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggacacaggaaccctgaagagatccatggg

SEQ ID NO: 3520 - DNA, 384 bp, Glycine max
  Clone ID: LIB3039-020-Q1-E1-E1
acggtcaagaattccgggcccaccacgcgtcagaaggctgcgaaaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgtttttggaca

SEQ ID NO: 3521 - DNA, 350 bp, Glycine max
  unsure (1)...(350): unsure at all n locations
  Clone ID: LIB3040-036-Q1-E1-F9
cggacgcgtccgcccacgcgtccgacggctgcgagaagacgacagaagggggttccatttctcaacaacttctgctacttcctactccaaccgcacttctgctccgcaattatcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacangccagtcactgtttt

SEQ ID NO: 3522 - DNA, 433 bp, Glycine max
  Clone ID: LIB3039-054-Q1-E1-G11
atacggctgcgagaagacgacagaagggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttcccttcggtgacaagcaattcacggtttttggacacaggaaccctgaagaaattccatgggggtcaactggagctgatatcattgttgagtccaccggagtttccaccgataag

SEQ ID NO: 3523 - DNA, 376 bp, Glycine max
  Clone ID: LIB3040-053-Q1-E1-C6
agcccaggcgtcagtacggctgcgagaggacgacagaagggggttccatttctcaacaacttctgcgacttcctactccaaccgcacttctgctccgcaattatcatgggcaaggtcaagatcggaatcaacggatttggaagaattggccgtttggtagccagagtggctctgcagagaggcgatgttgaactcgttgccgttaacgaccctttcatcaccaccgattacatgacatacatgtttaaatacgacagtgttcatggacactggaagcatcacgatgtcaccgttaaggacgagaagacccttctcgtcggtgacaagccaatcactatttttggacacagaaatcctgaagaaatccaagggggtc

SEQ ID NO: 3524 - DNA, 420 bp, Glycine max
  unsure (1)...(420): unsure at all n locations
  Clone ID: LIB3040-006-Q1-E1-H9
acgcgtccgcccacgcgtccgacagctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagaccttctcttcggtgacaagccagtcactngtttttggacacaggaaaccttaaagagattccatgggggtcaactggagctgatatca

SEQ ID NO: 3525 - DNA, 275 bp, Glycine max
  Clone ID: LIB3027-011-Q1-B1-C6
cactgactttatcggcgatagcagatcaagtatttttgatgcaaaggctggaattgcattgaataagaactttgtgaagcttgtttcttggtacgacaacgagtggggatacagctcacgtgtcattgatcttcttgtattcgttgccaagaagtctctttaaggtgttacttcaaagtagcttgtcttcacattattaccgtatgtttatgtttagctgcgatttagtgtcttgctcgagcaaaaaatgagaggtctgaataaatcggtttctg

SEQ ID NO: 3526 - DNA, 359 bp, Glycine max
  unsure (1)...(359): unsure at all n locations
  Clone ID: LIB3039-045-Q1-E1-E3
acgcgtcagccaacgcgtccgtacggctgcgagaagacaacaaaaggggaaacaacaaccgttccaatcccaaattccggccctccaactcccaaaaagcctttccccgcaatcaagggcaaggtcaagatcggaatcaacggatttggaagaattggccgtttggttgccanagtcgctctgcaaagagacgatgttgaactcgttgccgttaacgaccctttcattaccaccgattacatgacatacatgtttaaatacgacagtgttcacggacactggaagcatcacgatgtcaccgttaaggacgagaagacccttctcttcggtgacaaggcagtcactgtttttggacacag

SEQ ID NO: 3527 - DNA, 399 bp, Glycine max
  Clone ID: LIB3039-029-Q1-E1-D8
tacggctgcgagaagacgacagaaggggacacaccatccgttctagtctcaacttctgcccttccaactcctacaacgcttttcactgcactcatgggcaaggtcaagatcggcatcaccggctttgggagaattggtcgtttggttgccagagtcgctctgcacagagacgatgttgaactcgttgccgttaacgaccctttcattaccaccgattacatgacatacatgtttaaatacgacagtgttcacggacactggaagtatcacgatgtcaccgttaaggacgagaagacccttctcttcggtgacagagcagtcactgtttttggacacagaaagcctgaagagatcccatgggggtcaactggagctgacagcattgttgagtccaccgga

SEQ ID NO: 3528 - DNA, 400 bp, Glycine max
  Clone ID: LIB3049-022-Q1-E1-G9
tcggccaagccttccttacggctccaaaaagacaacagaaggggacacaccgtttgtccaattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgacccttttcattaccaccgattacatgacatgcatgtttaaatacgacagtgttcacggacactggaagcatcacgatgtcaccgttaaggacgagaagactcttctcttcggtgacaagccagtcactgtttttggacacaggaaccctgaagagatcccattggggtca

SEQ ID NO: 3529 - DNA, 376 bp, Glycine max
  Clone ID: LIB3039-027-Q1-E1-C2
agtacggctgcgagaagacgacagaagggtacggctgcgagaagacgacagaaggggacacaccgtttgttctattcttaactcaacttctgctacccactctcttcttccaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacagtgttcacggacactggaagcatcacgatgtcaccgttaaggacgagaagacccttctcttcggtgacaagccagtcactgttttt

SEQ ID NO: 3530 - DNA, 317 bp, Glycine max
  Clone ID: LIB3040-026-Q1-E1-C12
gcgtccaaccaagcgtccgcccacgcgtccgacggctgcgagaagacgacagaagggacacaccgtttgttctattcttaactcaacttctgctacccactctcttcttccaagtccaaccacgcttttctctacagtcatgggcaaggtcaagatcggaatcaacggatttggaagaattggccgtttggttgccagactcgctctgcaaagagacgatgtggagctcgttgccgttaacgaccctttcattaacaccgattacatgacatacatgtttaaataccacagtgttcacggacactggaagcatcacg

SEQ ID NO: 3531 - DNA, 320 bp, Glycine max
  Clone ID: LIB3040-042-Q1-E1-E1
ggtcgaccgacgcgtcgggccacgagtccgacggctgcgagaagacgacagaaggggacacaccgtttgttctattcttaactcaacttctgctacccactctcttcttcgaggtccaaccacgcttttctctacagtcatgggcaaggtcaagatcgggatcaacggatgtgggagaagtgggcgtttggttgccagagtggctcggcacagagacgatgtggcgcgcgttgccgttaacgaccctttcattaccaccgaggacatgacatacatgtttaaatacgacagtgttcaggggcactgggagcatcacgagg

SEQ ID NO: 3532 - DNA, 444 bp, Glycine max
  Clone ID: LIB3039-003-Q1-E1-A2
ggaatcataaggcaagttgaagggaattcatggctacactgaagatgatgtggtctccactgactttatcggcgatagcagatcaagtatttcttgatgcacaagctggaattgcattgaataagaactttgtgaagcttgtttcttggtacgacaacgaatggggatacagctcacgtgtcattgatcttcatgtactcgttgccaacaagtcgctttaacgtgttacatcaaagtagcttgtcttcacattattaccgtatgtttatgtttagctgcgatttagtgtcttgctcgagcaaatcatgagaggtctgaataaatcggtttctgaaaccagtggtgttacatgttggaggagcattagctctttattggacttttgatgtattctcatgtggatggggatcgagttattggatttttatatactcgctgatgtac

SEQ ID NO: 3533 - DNA, 322 bp, Glycine max
  Clone ID: LIB3039-048-Q1-E1-D6
agtacggctgcgagaagacgacagaaggggacacaccgtttgttctattcttaactcaacttctgctacccactctcttcttccaagtccaaccacgcttttctctacagtcatgggcaatgtcaagatcggaatcaacggatttggaagaattggccgtttggttgccagagtcgctctgcagagagacgatgtggagctcgttgccgttaacgaccctttcattaccaccgattacatgacatacatgtttaaatacgacactgttcacggacactgcgagcatcacgatgtcaccgttaaggactagaagacccttctc

SEQ ID NO: 3534 - DNA, 295 bp, Glycine max
  unsure (1)...(295): unsure at all n locations
  Clone ID: LIB3040-018-Q1-E1-G2
acggctgcgagaagacgacagaagggtactgctgcgagaagacgacagaacggtactgctgcgacaagacgacagaaaggtactgctgcgagaagaccacagaatggtacggctgctagaagacgacagaaaggtactgctgcgagaagccgacagaanggtacngctgcgagaagacgacagaaggggacacaccgtttgttctattcttaactcaacttctgctacccactctcttcttccaagtccaaccacgcttttctctacagtcatgggcaaggtcaagatcggaatc

SEQ ID NO: 3535 - DNA, 311 bp, Glycine max
  Clone ID: LIB3050-020-Q1-K1-A10
gacccacgcgtccgtacggctgcgagaagacgacagaagggacacaccgtttgttctattcttaactcaacttgtgctacccactctcttggcgaagtccaaccacgcttttctctacagtcatgggcaaggtcaagatcggaatcaacggatttggaagaattggccgtttggttgccagagtcgctctgcaaagagacgatgtggagctcgttgccgttaacgaccctttcattaccaccgattacatgacatacatgtttaaatacgacattgttcacggacactggatacatcacgatgtcaccgtt

SEQ ID NO: 3536 - DNA, 221 bp, Glycine max
  Clone ID: LIB3051-022-Q1-K1-D1
cccacgcgtccgttcctactccaaccgcacttctgcttcgcaattatcatgggcaaggtcaagatcggaatcaacggatttggaagaattggccgtttggtagccagagtggctctgcagagagacgatgttgaactcgttgccgttaacgaccctttcatcaccaccgattacatgacatacatgtttaaatacgacagggttcatggactctggaatct

SEQ ID NO: 3537 - DNA, 339 bp, Glycine max
  Clone ID: LIB3039-051-Q1-E1-F10
ccacgcgtaagtacagctgcgagagacgacataaggggacacatcatccgttctagtctcaagttctgctcttccaactcctagagagcttttctctgcactcatgggcaaggtcaagatcagcatcaacggatttggaagaattgggcgtttggttgccacagtcgctctgcaaagagacgatgttgaactcgttgccggttacgaccctttcattatcaccgattacatgacatacatgtttaaatacgacagtgttcacggacactggtagcatcacgatgtcaccgttaacgaccaaaaaacccttctcctccgtgacaaagcaatcactggttt

SEQ ID NO: 3538 - DNA, 385 bp, Glycine max
  unsure (1)...(385): unsure at all n locations
  Clone ID: LIB3053-010-Q1-N1-B4
ggcttttcatacagtggtcagaagtgcactgctggtaaggttggcctggtaatggagtccggtggcgatgctttggttgaaaaagtgaaagctaaagtggcaaaactaactgttggaccaccagaggatgactgtgatatcaccccggttgtgtcagaatcatctgccaatttcattgaaggcctggtcttggatgctaaggagaaaggagcaacattctgccaggagtacaaaagagaaggcaatcttatntggcctttgctactggacaatgttaggccagacatgagaatcgcatgggaagagccatttggaccagttntaccagtaattaggatcaattcaatttgaggagggaattcaatcattgcaatgctagcaactt

SEQ ID NO: 3539 - DNA, 224 bp, Glycine max
  Clone ID: LIB3054-008-Q1-N1-D12
aggatttctgttagacaaaccctgctgatgaggaatgcagagtttatgaatagaggagagctccttttctaacgtatcatgtgaaaaagaaggaaattgttcagacagtctatctgaggagagattttcaaagtttatatttatttgcagccaataataagttttggcgtgactgaatgaatatcacccatatattgattgatattgaatttctgaattcttgt

SEQ ID NO: 3540 - DNA, 353 bp, Glycine max
  unsure (1)...(353): unsure at all n locations
  Clone ID: LIB3053-009-Q1-N1-D11
caacaaagcaataatgatcagtgatgcaatggaaacgggaacagttcagataaattctgccccagctcgtgggccagatcattttccctttcagggtataaaggacagtggcattggatctcaagggattaccaacagcataaacatgatgaccaaggtcaaaacgactgtgatcaacttacccagcccttcctatactatgggctagtagtgtaatacacacatgcatgggggaacatcattatatagcatgttccataaatcatagtgnaacgtnaacaaccgtgtgagttcagcattgcattgtcttttgcagctgggattacagagatgaataacgagtttgattgata

SEQ ID NO: 3541 - DNA, 234 bp, Zea mays
  Clone ID: 700019675H1
ttttgatgtatgttttaggcagaagaaggcttttgcaggtgaaacttcttcatcttaagaagttcatgctgctgtacgcaattggctgaagaccaacatatcacacgatgttgcttctagcactcgaataatctatggaggctctgttcaaggataagaagccagtcaaggtcatcaagaagaactcggctgcagtcaccaagttcctcgatgagctggctaagattggccgca

SEQ ID NO: 3542 - DNA, 303 bp, Zea mays
  Clone ID: 700073894H1
gtgcctctttgaagggccctgatttcgccaccattatcaactcggtgaccgctaagaaagttgcagcctgatgagccctgtctgttagaaataagtagtcatctgtgtttcaacctcacctgccacgccgtaaagcctgtaggaggtgatccgtgtgatggtgtgccgtcaccttcctgcctttgctgatttgcaacaccacggaaacagaaaataacgcaagatgtcacattttttttgttctcgtagtccgtagaccttgtgtacgttacgggagttcagttgcacgttggcgatgtacgt

SEQ ID NO: 3543 - DNA, 232 bp, Zea mays
  Clone ID: 700167260H1
cacacgcgtccgcccacgcgtccgcggacgcgtggggtcaagaacgctgcatatgcattgagacaaaatgttaaggttattgcctgcataggcgagcttctggaagagagggaagcagggaaaacttttgaagtatgttttgagcagatgaaggcttttgcagatagtatttcgcactgggccgatgttgtgattgcatatgagcctgtttgggctattggaatcggtaaag

SEQ ID NO: 3544 - DNA, 287 bp, Zea mays
  Clone ID: 700380595H1
gcatcgttgccatggctggatccggcaagttcttcgtcggaggcaactggaagtgcaatggaacaaaggactccattagcaaacttgtctctgaattgaatgctgctacccttgaaactgatgtagatgttgtggtggcacctccattcatctatattgttcaggttaagaattcactaactggtcgcattgaggtttctgctcagaatgtgtggattggaaaaggaggagcctacaccggagagatcagtgcagaacaactggtggacatcggctgtcaatgggtt

SEQ ID NO: 3545 - DNA, 109 bp, Zea mays
  Clone ID: 700449667H1
gaaatccaatctagaagctcccctctccctccctccctctctctctctctcttcgccgtccgaagctccgcacccaatctaatcgacacctcaccgagatgggccgcaa

SEQ ID NO: 3546 - DNA, 239 bp, Zea mays
  Clone ID: 700449720H2
gcaatccaatctagaagctcccctctccctccctccctctctctctctctcttcgccgtccgaagctccgcacgcaatctaatcgacacctcagcgagatgggccgcaagttcgtcgtcggtggcaactggaaatgcaatggaaccacagatcaggtcgagaagattgtcaaaaccctgaatgaaggacaagttccccttcagatgtgctcgaggtcgttgtcaaccctccttatgtcg

SEQ ID NO: 3547 - DNA, 258 bp, Zea mays
  unsure (1)...(258): unsure at all n locations
  Clone ID: 700570661H1
caaggggctgctgcgcctggatttcgccgtcgcagcgcagaactgctgggtgcgcaagggcggcgccttcaccggcgagatcagtgctgagatgctggtacacctgcangtagcctgggtcatggtgacgacatctgagcgcagagctctgttgggtgaatcagtgatgtgctgctgatacagttcatatgcactcactcacgtctcaggtaatgctgcatcgtagaccttgacagaagagctgacaccatgatgtgt

SEQ ID NO: 3548 - DNA, 98 bp, Zea mays
  unsure (1)...(98): unsure at all n locations
  Clone ID: 700616770H1
cgtgtcggcacaacactgttggagtcgcanaggtggtgcttataccggtgaggttagtgctgaaatgcttgttaatatgggaattccttgggttatta

SEQ ID NO: 3549 - DNA, 253 bp, Zea mays
  Clone ID: 701170944H1
aatccacctcaatacatcttaatacacccaaaatgccgcgccaattcttcgtcggaggcaacttcaagatgaatggagtcactgactctatcaagtccatcgtctctaacatcaacaactccaagcgtgacccgtccaccgaagtcgtcatcgcccctcccgccatctatctcgcgctcacccgcgcacttgccgacccctcagtcggtgtctcggcccagaacgtctatgacaagcctagcggtgcttatac

SEQ ID NO: 3550 - DNA, 290 bp, Zea mays
  Clone ID: 700337974H1
ggtaaacctgcaggtgccctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttgttgctgcacaaacaaaggctattgctgaaaaaatatcagattggacaaatattgtgttggcatatgaaccagtttgggctattggtaccggcaaagttgcaactcctgctc

SEQ ID NO: 3551 - DNA, 256 bp, Zea mays
  Clone ID: 700027829H1
tggtgaatccagtgattttgttgctgataaagttgcatatgcactcactcaaggtctcaaggtaattgcttgcattggtgagacccttgagcagagagacgcaggaacaacaatggatgttgttgctgcacaaacaaaggctattgctgaaaaaatatcagattggacaaatattgtgttggcatatgaaccagtttgggctattggtaccggcaaagttgcaattccggttcaggctcaggaggtccatgatggc

SEQ ID NO: 3552 - DNA, 163 bp, Zea mays
  Clone ID: 700050046H1
ggtcaatcttcttggcctcacgatacttgcggagaaggcgcctcagcacacgcatcctcctcatccacagaaccttggtgggtagcctagcctccctggtacccctacgcttaccatatcctgagtggcgtcccttttgcttggcgtcatgtgcccttcttgc

SEQ ID NO: 3553 - DNA, 310 bp, Zea mays
  Clone ID: 700077320H1
gctgcgccaagagttccatgttgctgctcagaactgccgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactgg

SEQ ID NO: 3554 - DNA, 297 bp, Zea mays
  Clone ID: 700104541H1
gtcaagagccagctgcgccaagagttccatgttgctgctcagaacttctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagca

SEQ ID NO: 3555 - DNA, 305 bp, Zea mays
  unsure (1)...(305): unsure at all n locations
  Clone ID: 700047476H1
gagctctgctgggagaatcaaatgaatttgttggagacaaggttgcgtatgccctgtctcagggactaaaggtcattgcatgtgttggtgagacacttgagcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctanagaccaacgtcagccctgaggtt

SEQ ID NO: 3556 - DNA, 321 bp, Zea mays
  Clone ID: 700211559H1
cccacgcgtccggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttg

SEQ ID NO: 3557 - DNA, 285 bp, Zea mays
  Clone ID: 700073553H1
ctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgtttacctctggacgtatcaa

SEQ ID NO: 3558 - DNA, 338 bp, Zea mays
  Clone ID: 700613011H1
ccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtca

SEQ ID NO: 3559 - DNA, 298 bp, Zea mays
  Clone ID: 700352119H1
ggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaag

SEQ ID NO: 3560 - DNA, 283 bp, Zea mays
  Clone ID: 700088148H1
gtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaa

SEQ ID NO: 3561 - DNA, 290 bp, Zea mays
  Clone ID: 700351626H1
ccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcg

SEQ ID NO: 3562 - DNA, 290 bp, Zea mays
  Clone ID: 700240096H1
cccacgcgtccggaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggact

SEQ ID NO: 3563 - DNA, 276 bp, Zea mays
  Clone ID: 700083660H1
cttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtg

SEQ ID NO: 3564 - DNA, 316 bp, Zea mays
  Clone ID: 700208721H1
cccacgcgtccgcatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttc

SEQ ID NO: 3565 - DNA, 313 bp, Zea mays
  unsure (1)...(313): unsure at all n locations
  Clone ID: 700203144H1
cgcctcgctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccnaacttctagct

SEQ ID NO: 3566 - DNA, 277 bp, Zea mays
  Clone ID: 700430425H1
gctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaaga

SEQ ID NO: 3567 - DNA, 268 bp, Zea mays
  Clone ID: 700206091H1
agggactaaaggtcattgcatgtgttggtgagacacttgagcagagggaggctgggtctaccatggaggttgttgctgcacaaacaaaagcaattgctgagaagatcaaggactggagcaacgtattgttgcctatgaaccagtttgggctattggaactggtaaagttgccaccccagctcaggctcaggaagtgcacgcctccctgagggattggctaaagaccaacgtcagccctgaggttgctgaatctactaggatcatttac

SEQ ID NO: 3568 - DNA, 307 bp, Zea mays
  Clone ID: 700077017H1
gagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagctcaggctcaggaagtgcacgcctccctgagggattgggtaaagatcaatgtcagccctgaggtctctgaatctacaag

SEQ ID NO: 3569 - DNA, 285 bp, Zea mays
  Clone ID: 700618792H1
ggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttcgtgcacaaacaaaagcaattgctgagaagatcaaggactggagcaacgtagttgttgcctatgaaccagtttgggctattggaactggtaaagttgccaccccagctcaggctcaggaagtgcacgcctccctg

SEQ ID NO: 3570 - DNA, 337 bp, Zea mays
  Clone ID: 700572532H1
aaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtgga

SEQ ID NO: 3571 - DNA, 302 bp, Zea mays
  unsure (1)...(302): unsure at all n locations
  Clone ID: 700106512H1
cccacgcgtccgcggacgcgtggggagtggnctcaccgagatgggccgcaagttcttcgtcggtggcaactggaaatgcaatggaaccacagatcaggtcgagaagattgtcaaaacactgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttg

SEQ ID NO: 3572 - DNA, 256 bp, Zea mays
  Clone ID: 700195031H1
gccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtc

SEQ ID NO: 3573 - DNA, 268 bp, Zea mays
  Clone ID: 700168131H1
cccacgcgtccggtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctc

SEQ ID NO: 3574 - DNA, 254 bp, Zea mays
  Clone ID: 700197039H1
ccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttg

SEQ ID NO: 3575 - DNA, 341 bp, Zea mays
  Clone ID: 700572688H1
cgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcatcttggacactctgaaag

SEQ ID NO: 3576 - DNA, 251 bp, Zea mays
  Clone ID: 700021313H1
ttcggcacgagaaagagctagcagcacagcctgatgtcgatggttttcttgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgtttacc

SEQ ID NO: 3577 - DNA, 246 bp, Zea mays
  Clone ID: 700452417H1
tggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttgaagcctgagttcatcgacatcatcaacgcggccaccgtga

SEQ ID NO: 3578 - DNA, 270 bp, Zea mays
  Clone ID: 700346119H1
ggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaggactggagcacgtattgttgcctatgaacca

SEQ ID NO: 3579 - DNA, 277 bp, Zea mays
  Clone ID: 700082359H1
cgcagatcaggttgagaagattgtcaaaaccctgaatgaaggaaatgttccctcttcagatgttgttgaggttgttgtcagtcctccttatgtgttcctcccggtggtcaagagccagctgcgtcaagagttccaagttgctgctcagaactgctgggtgaagaagggaggtgcattcactggtgaaattagtgctgagatgctcgtcaaccttggcgttccctgggtcattcttggacactctgaaaggagagctctgctgggagaatcaaatgag

SEQ ID NO: 3580 - DNA, 261 bp, Zea mays
  Clone ID: 700240042H1
cccacgcgtccggaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaac

SEQ ID NO: 3581 - DNA, 276 bp, Zea mays
  Clone ID: 700030064H1
tgaagggaggtgcattcaccggtgaaattagtgctgagatgctcgtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttg

SEQ ID NO: 3582 - DNA, 326 bp, Zea mays
  Clone ID: 700615185H1
ccaatctagaagcacacctctccctctctctctcttcgccgtccgaagctccgcaccccaatctaatcgacacctcaccgagatgggccgcaagttcgtcgtcggtggcaactggaaatgcaatggaaccacagatcaggtcgagaagattgtcaaaaccctgaatgaaggacaggttcccccttcaatgttgtggaggtcgttgtcagccctccttatgtcttccttcctgtggtcaagagccagctgcgccaagagttccatgttgctgctcagaactgctgggtgaagaagggatgtgctttcactggtgaagtcatgctgag

SEQ ID NO: 3583 - DNA, 244 bp, Zea mays
  Clone ID: 700196125H1
aactgcaaagagctagcagcacagcctgatgtcgatggttttcctgtcggtggagcttctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgttta

SEQ ID NO: 3584 - DNA, 258 bp, Zea mays
  Clone ID: 700243429H1
cccacgcgtccgatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattct

SEQ ID NO: 3585 - DNA, 265 bp, Zea mays
  Clone ID: 700474112H1
gaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttacaatgttgttgaggtcgttgtcagccctccttatgtcttccttcctgtggtcaagagccagctgcgccaagagttccatgttgctgctcagaactgctgggtgaagaagggaggtgctttcact

SEQ ID NO: 3586 - DNA, 336 bp, Zea mays
  Clone ID: 700572282H1
aaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacag

SEQ ID NO: 3587 - DNA, 349 bp, Zea mays
  Clone ID: 700622238H1
ctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttgg

SEQ ID NO: 3588 - DNA, 317 bp, Zea mays
  Clone ID: 700095609H1
ccacgcgtccgaatcgacacccggccgacatgggccgcaagttcttcgttggtggcaactggaaacgcaatggaaccgcagaccaggttgagaagatcgtcaaaaccctgaatgaaggaaatgctccctcttcagacgtcgtcgaggttgttgtcagtcctcctcatgtgttcctcccggtggtcaagagccagctgcgccaagagttccaagtcgctgctcagaactgctgggtgaagaagggaggtgcattcactggtgaaaccagtgctgagatgctcgtcaaccttggcgtctccctgggtcactcttggaca

SEQ ID NO: 3589 - DNA, 263 bp, Zea mays
  Clone ID: 700218886H1
ggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggaggtgcattcactggtgaaattagtgctgagatgctcgtcaaccttggcgttccctgggtcattcttggacactctgaa

SEQ ID NO: 3590 - DNA, 227 bp, Zea mays
  Clone ID: 700018688H1
ctttgaagcctgagttcatcgacatcatcaacgcggccaccgtgaagtccgcttaagatgctacgctgaagacgaacatactttttttttgctcaactgtgctatgtaagctagtagcttttgcgcaggagcagagactgttttgcctgcccccaacttctagcttgagcttgctaataatgtttacctctggacgtatcaataatggtgcttatgtatcccctttt

SEQ ID NO: 3591 - DNA, 300 bp, Zea mays
  Clone ID: 700049775H1
ccagtctgggctattggaactggcaaagtcgccaccccagctcaggctcaggaagtgcacgcctccctgagggattgggtaaagatcaatgtcagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccaccgtgtgaagtccgcttaagatgttccaacccttcaccctgttgcggtgatgt

SEQ ID NO: 3592 - DNA, 348 bp, Zea mays
  Clone ID: 700575972H1
ccgtactcaatctaatcgacacccggccgagattggacgcaatttcttcgttggtggcaactggaaatgcaatggaaccgcagatcaggttgagtagattgtcaagacgctgaatgaaggaaatgttccctcttcagatgttgttgaggttgtggtcagtcctccttatgtgttcctcccggtggtcaagagccagctgctccaagagttctaagttgctgctcagaactgctgggtgaagaagggaggtgcattcactggtgaaattagtgctgagatgctcgtcaaccttggcggtccctgggtcattcttggacactctgaaaggagagctctgtctgggagaat

SEQ ID NO: 3593 - DNA, 264 bp, Zea mays
  unsure (1)...(264): unsure at all n locations
  Clone ID: 700215519H1
gtgagacccttgagcagagggaggctgggtctaccatggatgttgttnctgcacaaacaanagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctggggttgctnantctataggntcntctanggggctttaaaaantgctgggaa

SEQ ID NO: 3594 - DNA, 225 bp, Zea mays
  Clone ID: 700161120H1
gttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagt

SEQ ID NO: 3595 - DNA, 278 bp, Zea mays
  unsure (1)...(278): unsure at all n locations
  Clone ID: 700581760H1
cttggcgttccctgggtcattcttggacactctgcaaggagagctctgctgggagtttcctgtgagtttgttggagacaaggtttgtnttgctctgtctcagggactaaaggtcattgcatgtgttggtgagacccttgagtttagggaggctggttcaaccatggatgttgttgctgcacaaacaaaagcaattgctgagaagatcaaggactggagcaacgttgttcttgcctatgaaccagtctgggctattggaactggcaaagtcgccaccca

SEQ ID NO: 3596 - DNA, 317 bp, Zea mays
  Clone ID: 700104672H1
gcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcg

SEQ ID NO: 3597 - DNA, 291 bp, Zea mays
  Clone ID: 700346053H1
ccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaacct

SEQ ID NO: 3598 - DNA, 244 bp, Zea mays
  Clone ID: 701166592H1
acggaggctctgtaactgccgcgaactgcaaagagctagcagcacagcctgatgtcgatgggtttcttgtcggtggagcttctttgaagcctgagttcatcgacatcatcaacgcggccaccgtgaagtccgcttaagatggtacgcgtgagacgaacatactttttttttgctcaactgtgctatgtaagctagtagcttttggcgcaggacagagactttgtttacctcccccaacttttag

SEQ ID NO: 3599 - DNA, 254 bp, Zea mays
  Clone ID: 700968667H1
ccatccgtacccaatctaatcgacacccggccgagatgggccgcaagttcttcgttggtggcaactggaaatgcaatggaaccacagatcaggttgagaagattgtcaaaaccctgaatgaaggaaatgttcctcttcagatgttgttgaggtcgttgtcagtcctccttatgtgttcctcccggtggtcaagagccagctgcgccaagagttccaagttgctgctcagaactgctgggtgaagaagggaggtg

SEQ ID NO: 3600 - DNA, 222 bp, Zea mays
  Clone ID: 700205627H1
tgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacccttgagcagagggaggctgggtctaccatggatgttgttgctgcacaaacaaaagcaattgctgagaagatcaagg

SEQ ID NO: 3601 - DNA, 263 bp, Zea mays
  Clone ID: 700029005H1
atcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgag

SEQ ID NO: 3602 - DNA, 292 bp, Zea mays
  Clone ID: 700476479H1
gaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgttgaggtcgttgtcagccctcttatgtcttccttcctgtggtcaagagccagctgcgccaagagttccatgttgctgctcagaactgctgggtgaagaagggaggtgctttcactggtgaagtcagtgctgagatgctcgtca

SEQ ID NO: 3603 - DNA, 312 bp, Zea mays
  Clone ID: 700050148H1
ctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgaga

SEQ ID NO: 3604 - DNA, 259 bp, Zea mays
  Clone ID: 700259846H1
atccaatctagaagcacaccacaccctctctctctcttcgccgtccgaagcaccgcacaccaatctaatcgacacatcaccgagatgggccgcaagttcatcgtcggtagcaacaggaaatgcaatggaaccacagatcaggtcgagaagattgtcaaaacactgaatgaaggacaggttcccccatcagatgttgtggaggacgttgtcagcccaccttatgtcttccttcctgtggtcaagagccagcagcgccaag

SEQ ID NO: 3605 - DNA, 295 bp, Zea mays
  Clone ID: 700344093H1
aagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggaggtgcattcactggtgaaattag

SEQ ID NO: 3606 - DNA, 320 bp, Zea mays
  Clone ID: 700082327H1
aaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaa

SEQ ID NO: 3607 - DNA, 207 bp, Zea mays
  Clone ID: 700020156H1
gcacgagctggagcaacgtagttgctgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcac

SEQ ID NO: 3608 - DNA, 265 bp, Zea mays
  Clone ID: 700577714H1
aatcgacacccggccgagatgggcgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgttttcctcccggtggtcaagagccagctgcgccaagagttccaagttgctgctcagaactgctgggtgaagaagggaggtgcattcactggtgaaattagtgctgagat

SEQ ID NO: 3609 - DNA, 319 bp, Zea mays
  Clone ID: 700104904H1
cggacgcgtgggtagaagcacccctctccctctctctctcttcgccgtccgaagctccgcaccccaatctaatcgacacctcaccgagatgggccgcaagttactcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggt

SEQ ID NO: 3610 - DNA, 316 bp, Zea mays
  Clone ID: 700104685H1
atccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgc

SEQ ID NO: 3611 - DNA, 276 bp, Zea mays
  Clone ID: 700053463H1
ctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgcttt

SEQ ID NO: 3612 - DNA, 204 bp, Zea mays
  Clone ID: 700171639H1
gaagatcaaggactggagcaacgtattgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagcta

SEQ ID NO: 3613 - DNA, 342 bp, Zea mays
  unsure (1)...(342): unsure at all n locations
  Clone ID: 700574233H1
ctagaagccccctctccctccctccctctctctctctctcttcgccgtccgaagctccgcacccaatctaatccacacctcagccagatgngccgcaagttcttcgtcggtggcaactggaaatgcaatggaaccacagatcaggtcgagaagattgtcagaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaatggaggtgctttcactggtgaagcagtgctgagatgctcgtca

SEQ ID NO: 3614 - DNA, 313 bp, Zea mays
  unsure (1)...(313): unsure at all n locations
  Clone ID: 700262653H1
aatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggangtgct

SEQ ID NO: 3615 - DNA, 277 bp, Zea mays
  Clone ID: 700456738H1
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaaggg

SEQ ID NO: 3616 - DNA, 282 bp, Zea mays
  Clone ID: 700611806H1
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgattgaaggaaatgttccctctacagatgttgttgaggtcgttgtcagtcctccttatgtgttcctcccggtggtcaagagccagctgcgccaagagttccaagttgctgctcagaactgctgggtgaagaagggaggtg

SEQ ID NO: 3617 - DNA, 313 bp, Zea mays
  Clone ID: 700381177H1
acaatttagaagcgaccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggaggtgcattacactggtgaaattagtgctgaga

SEQ ID NO: 3618 - DNA, 307 bp, Zea mays
  Clone ID: 700103347H1
ccaatctagaagctcccctcttcgtccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagg

SEQ ID NO: 3619 - DNA, 299 bp, Zea mays
  Clone ID: 700103605H1
aatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagg

SEQ ID NO: 3620 - DNA, 266 bp, Zea mays
  Clone ID: 700578536H1
agcgcccctcctcctctcctccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaaga

SEQ ID NO: 3621 - DNA, 318 bp, Zea mays
  Clone ID: 700258606H1
cttccttcctctgcaagaagccaaatacaatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcac

SEQ ID NO: 3622 - DNA, 182 bp, Zea mays
  Clone ID: 700335703H1
actctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtacaggtcgtt

SEQ ID NO: 3623 - DNA, 286 bp, Zea mays
  Clone ID: 700351044H1
ccgtacccaatctaatcgacacccggccgagataagccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcatcactggtgaaattatgctgaatgctcgtcaac

SEQ ID NO: 3624 - DNA, 292 bp, Zea mays
  Clone ID: 700346364H1
ctatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactg

SEQ ID NO: 3625 - DNA, 277 bp, Zea mays
  Clone ID: 700619037H1
aatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaa

SEQ ID NO: 3626 - DNA, 298 bp, Zea mays
  Clone ID: 700465160H1
gctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgttgaggtcgttgtcagccctccttatgtcttccttcctgtggtcaagagccagctgcgccaagagttccatgttgctgctcagaactgctgggtgaagaaggga

SEQ ID NO: 3627 - DNA, 272 bp, Zea mays
  Clone ID: 700235687H1
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaag

SEQ ID NO: 3628 - DNA, 301 bp, Zea mays
  unsure (1)...(301): unsure at all n locations
  Clone ID: 700105645H1
cacacgcgtccgaactagaagcacccctctacctccctccctctctctctctctcttcgcagtccgaagctccgcacccaatctaatcgacacctcaccgagatgggccgcaagtacttcgtcggtggcaactgganatgcaatggaaccacagatcaggtcgagaagattgtcaaaaccctgaatgaaggacaggttcccccttcagatgttgtcgaggtcgttgtcagcactccttatgtcttccttcctgtggtcaagagccagctgcgccaagagttccatgttgctgctcagaact

SEQ ID NO: 3629 - DNA, 307 bp, Zea mays
  Clone ID: 700082237H1
cggacggtgggcagcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctca

SEQ ID NO: 3630 - DNA, 310 bp, Zea mays
  Clone ID: 700261906H1
atccaatctagaagctcccctctccctccctccctctctctctctctcttcgccgtccgaagctccgcacccaatctaatcgacacatcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaaggg

SEQ ID NO: 3631 - DNA, 258 bp, Zea mays
  Clone ID: 700456154H1
caatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgacgttgttgtcagtcctccttatgtgttcctcccggtggtcaagagccagctgcgccaagagttccaagttgctgctca

SEQ ID NO: 3632 - DNA, 294 bp, Zea mays
  Clone ID: 700047696H1
atctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaaggg

SEQ ID NO: 3633 - DNA, 271 bp, Zea mays
  Clone ID: 700449905H1
ctcccctctccctccctccctctctctctctctcttcgccgaccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctg

SEQ ID NO: 3634 - DNA, 274 bp, Zea mays
  Clone ID: 700336106H1
acggccgagatgggccgcaagttctgcgttggtggcaactggagatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcgccaagagttccaagttgctgctcagaactgctgggtgaagaagggatgtgcattcactggtgaaattagtgctgagatgctcgtcaaccttggcg

SEQ ID NO: 3635 - DNA, 306 bp, Zea mays
  Clone ID: 700381867H1
ccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaag

SEQ ID NO: 3636 - DNA, 280 bp, Zea mays
  Clone ID: 700051335H1
ctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaaggg

SEQ ID NO: 3637 - DNA, 280 bp, Zea mays
  Clone ID: 700050988H1
tctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaac

SEQ ID NO: 3638 - DNA, 276 bp, Zea mays
  Clone ID: 700029471H1
atccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgc

SEQ ID NO: 3639 - DNA, 300 bp, Zea mays
  unsure (1)...(300): unsure at all n locations
  Clone ID: 700106806H1
gcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcanaaccctgaatgaaggacaggttcccccttcagatgttgtcgaggtcgttgtcagccctccttatgtcttccttcctgtggtcaagagccagctgcgccaagagttccatgttgctgctcagaactg

SEQ ID NO: 3640 - DNA, 316 bp, Zea mays
  Clone ID: 700071749H1
gatcaatgtcagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccgccgtgtgaagtccgctgaagatgttccaacccttcaccctgttgcggtgatgtgctgaagacagatcagactatttttttgtttaaccgtgcagtgctatgtaagctactaactttgcgctggtgcggatgctgatttccctccccctagct

SEQ ID NO: 3641 - DNA, 325 bp, Zea mays
  Clone ID: 700207607H1
agatcaatgtcagccctgaggtctctgaatctacaaggatcatttatggaggttcagtaactgctgcgaactgcaaagagctggcagcacagcctgatgtcgatggtttccttgtgggcggtgcttctttgaagcccgagttcatcgacatcatcaacgccgccgccgtgtgaaatccgcttaagatgttccaacccttcaccctgttgcggtgatgtgctgaagacagatcagactatttttttgtttaaccgtgccgtgctatgtaagctactaactttgcgctggtgcggatgctgatttccctcccccctagctttttgtg

SEQ ID NO: 3642 - DNA, 273 bp, Zea mays
  Clone ID: 700573465H2
caatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgcc

SEQ ID NO: 3643 - DNA, 281 bp, Zea mays
  Clone ID: 700220908H1
gcgatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaact

SEQ ID NO: 3644 - DNA, 297 bp, Zea mays
  Clone ID: 700467719H1
ccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgcctaaaccctgaatgaaggacaggttcccccttcagatgttgttgaggtcgttgtcagccctccttatgtcttccttcctgtggtcaagagccagctgcgccaagagttccatgttctgctcagaactgctggg

SEQ ID NO: 3645 - DNA, 278 bp, Zea mays
  Clone ID: 700456018H1
atttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagctagctgcgccaagagttccagttgctgctcagaactgctgggtgagaagggagt

SEQ ID NO: 3646 - DNA, 216 bp, Zea mays
  Clone ID: 700453767H1
gcgaaatccaatctagaagcacacctctccctctctctctcttcgccgtccgaagctccgcaccccaatctaatcgacacctcaccgagatgggccgcaagttcttcgtcggtggcaactggaaatgcaatggaaccacagatcaggtcgataagattgtcaaaaccctgaatgaaggacaggttcccccttcagatgttgtggaggtcgttgtca

SEQ ID NO: 3647 - DNA, 188 bp, Zea mays
  Clone ID: 700026118H1
gagaagtagtgtaggctatgaaccagtttgggctattggaactggtaaagttgccaccccagctcaggctcaggaagtgcacgcctccctgagggattggctaaagaccaacgtcagccctgaggttgctgaatctactaggatcatttacggaggctctgtaactgccgcgaactgcaaagagctag

SEQ ID NO: 3648 - DNA, 204 bp, Zea mays
  Clone ID: 700026760H1
cggctcgagtctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgt

SEQ ID NO: 3649 - DNA, 278 bp, Zea mays
  Clone ID: 700029525H1
atccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcgg

SEQ ID NO: 3650 - DNA, 265 bp, Zea mays
  Clone ID: 700457972H1
atctagaagccccctctccctcctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgtt

SEQ ID NO: 3651 - DNA, 270 bp, Zea mays
  Clone ID: 700455866H1
ctaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagag

SEQ ID NO: 3652 - DNA, 259 bp, Zea mays
  Clone ID: 700165290H1
ccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagag

SEQ ID NO: 3653 - DNA, 294 bp, Zea mays
  Clone ID: 700351190H1
atccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaag

SEQ ID NO: 3654 - DNA, 237 bp, Zea mays
  Clone ID: 700154095H1
atacaatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggttgttgtcagtcctccttatgtgttcctcccggtggtcaagagccagctgcg

SEQ ID NO: 3655 - DNA, 203 bp, Zea mays
  Clone ID: 700450438H1
ccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcg

SEQ ID NO: 3656 - DNA, 255 bp, Zea mays
  Clone ID: 700044892H1
aatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgc

SEQ ID NO: 3657 - DNA, 209 bp, Zea mays
  Clone ID: 700185095H1
tcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagc

SEQ ID NO: 3658 - DNA, 216 bp, Zea mays
  Clone ID: 700575506H1
ctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagcc

SEQ ID NO: 3659 - DNA, 160 bp, Zea mays
  Clone ID: 700161966H1
acaaaagcaattgctgagaagatcaaggactggagcaacgtattgttgcctatgaaccagtttgggctattggaactggtaaagttgccaccccagctcaggctcaggaagtgcacgcctccctgagggattggctaaagaccaatgccagccctgaggt

SEQ ID NO: 3660 - DNA, 296 bp, Zea mays
  Clone ID: 700343401H1
gtatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtg

SEQ ID NO: 3661 - DNA, 238 bp, Zea mays
  Clone ID: 700152354H1
caatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtca

SEQ ID NO: 3662 - DNA, 303 bp, Zea mays
  Clone ID: 701164924H1
catcaaatgaatttgttggagacaagactgcgtatgccctgtctcagggactaaaggtcattgcatgtgttggtgagacccttgagcagagtgaggctgggtctaccatggatgttgttgctgcacaaacaaaagcaattgctgagaagatcaaggactggagcaacgtagttgttgcctatgaaccagtttgggctattggaactggtaaagttgccaccccagctcagctcaggaagtgcacgcctacctgagggattggctaaagaccaatgccagccctgaggatgctgaatctactag

SEQ ID NO: 3663 - DNA, 242 bp, Zea mays
  Clone ID: 700346896H1
caatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgacggaaatgttccctcttcagatgttgttgaggtcgttgtcagtcctccttatgtgttcctcccggtgggcaagagccagtgcgccaagagtt

SEQ ID NO: 3664 - DNA, 327 bp, Zea mays
  Clone ID: 700210157H1
cacaaacctcaccccacctatattatcccgtgccccttgtctttcttcctccacaagcagcgaaatccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctg

SEQ ID NO: 3665 - DNA, 297 bp, Zea mays
  Clone ID: 700383103H1
catccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtattccttcctgtggtcaagagccagctgcgccaagagttccatgttgctgctcagaactgctgggtgaagaa

SEQ ID NO: 3666 - DNA, 253 bp, Zea mays
  Clone ID: 701158829H1
ctaaagaccaatgccatccctgaggctgctgaatctgctaggatcatctacggaggctctgtaactgctgcgaactgcaaagagctagcagtacagcctgacgtcgatggttgtcttgccgactgagcttctttgaagcctgagttcatcgacatcatcaacgcggccaccgtgaagtccgcttaagatgctacgctgaagactgaacatacttctttttgctcaactgtgctatgtaagctagtagcttttg

SEQ ID NO: 3667 - DNA, 171 bp, Zea mays
  unsure (1)...(171): unsure at all n locations
  Clone ID: 700619883H1
gaagctcncctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgattaa

SEQ ID NO: 3668 - DNA, 246 bp, Zea mays
  Clone ID: 700168219H1
gaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctcctaatgtcttccttcctgtggtcaagag

SEQ ID NO: 3669 - DNA, 240 bp, Zea mays
  Clone ID: 700155210H1
cctccacaagcagcgaaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatg

SEQ ID NO: 3670 - DNA, 212 bp, Zea mays
  Clone ID: 700334861H1
atccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgag

SEQ ID NO: 3671 - DNA, 151 bp, Zea mays
  unsure (1)...(151): unsure at all n locations
  Clone ID: 700355663H1
cagcagctgcgccaagagttccatgttgctgctcagaactgctgngtgaagaagggaggtgctttcactggtgaagtcagtgctgagatgctcgtcaaccttggtgttccctgggtcattcttggacactctgaaaggagagctctgctgg

SEQ ID NO: 3672 - DNA, 279 bp, Zea mays
  unsure (1)...(279): unsure at all n locations
  Clone ID: 700074764H1
ccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattggcaaaaccctgaacgaaggacagggtcccccgtcagaagtcgtcgagggcgntggcagcccnccctaaggcnttcctcccgnggacaagagccagcatcgccaagagttccatgtt

SEQ ID NO: 3673 - DNA, 128 bp, Zea mays
  Clone ID: 700621934H1
aatctagaagcacccctctccctctctctctcttcgccgtccgaagctccgcaccccaatctaatcgacacctcaccgagatgggccgcaagttcttcgtcggtggcaactggaaatgcaatggaacc

SEQ ID NO: 3674 - DNA, 150 bp, Zea mays
  Clone ID: 700802084H1
cagcgaaatccaatctagaagcacccctctccctctctctctcttcgccgtccgaagctccgcacccaatctaatcgacacctcaccgagatgggccgcaagttcttcgtcggtggcaactggaaatgcaatggaaccacagatcaggtc

SEQ ID NO: 3675 - DNA, 323 bp, Zea mays
  Clone ID: 700620444H1
ggaactcggggaggtgagcagaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgcctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaa

SEQ ID NO: 3676 - DNA, 214 bp, Zea mays
  Clone ID: 700356205H1
gtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgggtcattttgggacattctgagcgcagagctctgttgggtgaatccagtgattttgttgctg

SEQ ID NO: 3677 - DNA, 267 bp, Zea mays
  Clone ID: 700215549H1
cacgaattcaccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaacgaagccgaggtgccctctgaagacgtcgtcgaggtggtggtgagtccgccgttcgtttttctgcagcaggtcaaggggctgctgcggctggacttcgccgtcgca

SEQ ID NO: 3678 - DNA, 191 bp, Zea mays
  Clone ID: 700620318H1
ggaactcggggaggtgagcagaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgagtcattttggga

SEQ ID NO: 3679 - DNA, 322 bp, Zea mays
  unsure (1)...(322): unsure at all n locations
  Clone ID: 700028742H1
tcacaacanactccactgtctccaactctccatcgcgtctgctacgcctctcctgcatgacgaccaatggcttccangaagttcttcgtgggtggcaactgganatgcaacggtactggcgaggacgtgaagaagatcgtcaccgtgctcaacgaagccgaggtgccctctgaagacgtcgtcgangtggtggtgagtccgccgttcgtttttctgcagcanngtcaagggctgctgcggctagacttcgccgtcgcagcgcagaactgctgngtgcgcaagggcngcgccttcaccggcgagatcagtgctgagatgctgg

SEQ ID NO: 3680 - DNA, 240 bp, Zea mays
  Clone ID: 700150060H1
caccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcg

SEQ ID NO: 3681 - DNA, 284 bp, Zea mays
  Clone ID: 700448477H1
accaaactccactgtctccaactctccatcgcgtctgctacgcctctcctgcaggacgaccaatggcttccaggaagttcctcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaagggctgctgcggctggacttcgccgtcgcagcgcagaactgctgggtgcgcaaggaggcg

SEQ ID NO: 3682 - DNA, 166 bp, Zea mays
  Clone ID: 700336489H1
cacgaattcaccaaccaaactccactgtctccaactctccatcgcgtctgctacgcctgtcctgcaggacgaccaatggcttccaggaagttcttcgtgggtggcaactggaaatgcaacggtactggcgaggacgtgaagaagatcgtcaccgtgctcaaccaag

SEQ ID NO: 3683 - DNA, 322 bp, Zea mays
  Clone ID: 700099709H1
gcctcctctcccgttcccccaccaaccgcagcagcgagagcgagactgagaatggccgcggcgccgtcgtccctcgtgtcctcccatctctctcgcctcgccgacctccgccgcgcggcgcgccggccactcccaccgtcccacagcagcttcgcgtcggctgctcgcaccgccgcgcccagcgcgtcgtcgccatggctggatccggcaagttcttcgtcggaggcaactggaagtgcaacgtaacaaaggactccgttagcaagcttgtctctgaactgaatgctgctaccctcgaaactgatgtagatgttgtggtggc

SEQ ID NO: 3684 - DNA, 303 bp, Zea mays
  Clone ID: 700075837H1
cctcgccctcgccgcctcctctcccgttcccccaccaaccgcagcagcgagagcgagactgagaatggccgcggcgccgtcgtccctcgtgtcctcccatctctctcgcctcgccgacctccgccgcgcgcggcgccggccactcccaccgtcccacagcagcttcgcgtcggctgctcgctccgccgcgcccagcgcgtcgtcgccatggctggatccggcaagttcttcgtcggaggcaactggaagtgcaacggaacaaaggactccgttagcaagcttgtctctgaactgaatgctgct

SEQ ID NO: 3685 - DNA, 270 bp, Zea mays
  Clone ID: 700045678H1
ctcgccgcctgctcctctccagttctcccccaccaaccgcagcagcgagagcgagactgagaatggccgcggcgccgtcgtccctcgtgtcctcccatctctcccgcctcgccgacctccgccgcgctgcggcgccggccactcccaccgtcccacagcagcttcgcgtcggcttctcgcgccgccgcgcccagcgcgtcgtcgccatggctggatccggcaagttcttcgtcggaggcaactggaagtgcaacggaacaaaggactccg

SEQ ID NO: 3686 - DNA, 301 bp, Zea mays
  Clone ID: 700097852H1
ccgacgcgtgggcgccgcctgctcctctccagttctcccccaccaaccgcagcagcgagacgagactgagaatggccgcggcgccgtcgtccctcgccacctcccatctctcccgcctcgccgacctccgccgcgcggcgcgccggccactcccaccgtcccacagcagcttcgcgtcggcttctcgcgccgccgcgcccagcgcgtcgtcgccatggctggatccggcaagttcttcgtcggaggcaactggaagtgcaacgtaacaaaggactccgttagcaagcttgtctctgaactg

SEQ ID NO: 3687 - DNA, 282 bp, Zea mays
  unsure (1)...(282): unsure at all n locations
  Clone ID: 700053342H1
cccacgcgtccgcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggnccactcccaccgtcccacagcagcttcgcgtcggcttctcgcgccgccgcgcccagcgcgtcgtcgccatggctggatccggcaagttcttcgtcggaggcaactggaagtgcaacgcaacaaaggactccgt

SEQ ID NO: 3688 - DNA, 273 bp, Zea mays
  Clone ID: 700041954H1
tcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcgcgccggccactcccaccgtcccacagcagcttcgcgtcggcttctcgcgccggcgcgcccagcgggtcgtcgccatggctggatccggcaagttcttcgtcggaggcaactggaagtgcaacgcaacaaaggactcc

SEQ ID NO: 3689 - DNA, 275 bp, Zea mays
  Clone ID: 700217471H1
acgaactgctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccgagccactcccaccgtcccacagcagcttcgcgtcggcttctcgcgccgccgcgcccagcgcgtcgtcgccatggctggatccggcaagttcttcgtcggaggcaactggaag

SEQ ID NO: 3690 - DNA, 300 bp, Zea mays
  Clone ID: 700264437H1
tggacgaactgctaccccctcgcctcgccctcgccgcctgctcctctccagttctcccccaccaaccgcagcagcgagagcgagactgagaatggccgcggcgccgtcgtccctcgtgtcctcccatctctcccgcctcgccgacctccgccgcgcggcggcgccggaccactcccacagtcccacagcagcttcgcgtcggcttctcgcgccgccgcgcccagcgcgtcgtcgccatggctggatccggcaagttcttcgtcggaggcaactggaagtgcgtaagtgcatgttctgctt

SEQ ID NO: 3691 - DNA, 255 bp, Zea mays
  Clone ID: 700218371H1
acgaactgctaccccctcgcctcgccctcgccgcctgctcctctccagttctcccccaccaaccgcagcagcgagagcgaggactgagaatggccgcggcgccgtcgtccctcgtgtcctcccatctctcccgcctcgccgacctccgccgcgcggcggcgccggccactcccaccgtcccacagcagcttcgcgtcggcttctcgcgccgccgcgcccagcggtcgtcgccatggctggatccggcaagttctt

SEQ ID NO: 3692 - DNA, 283 bp, Zea mays
  Clone ID: 700381686H1
cgaaccttggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgccgcgcccagcgcatcgttgccatggctggatccggcaagttcttcgtcggaggcaactggaagtgcaatggaacaaaggactccattagcaaacttgtctctgaattgaatgctgctacccttgaaactgatgt

SEQ ID NO: 3693 - DNA, 282 bp, Zea mays
  Clone ID: 700356082H1
ccgaaccttggcgtctgccctaccaaccgcagcagcgacactagaatggccgcggcgccgtcatccctcgcgtcctcccacctctccccaatcgcggcggtgtccactcccgccgtcccacatcagcttcgcaccggctgctcccgccgccgcgcccagcgcatcgttgccatggctggatccggcaagttcttcgtcggaggcaactggaagtgcaatggaacaaaggactccattagcaaacttgtctctgaattgaatgctgctacgcctgaaactgat

SEQ ID NO: 3694 - DNA, 235 bp, Zea mays
  Clone ID: 700622077H1
cggctcgagcaaccgcagcagcgacactagaatggccgcggcgccgtcatccctcgcgtcctcccagctctccccaatcgtcggggtgtccactcccgccgtcccacatcagcttcgcatcggctgctcccgccgccgcgcccggcgcatcgttgccatggctggatccggcaagttcttcgtcggagggccctggacgtgcaatggaacaaaggactccattaacaaacttgtc

SEQ ID NO: 3695 - DNA, 273 bp, Zea mays
  Clone ID: 700470822H1
gcttctagtccctcgcctaccccgcccccgaacctggcgtctgccctaccaaccgcagcagcgacactagaatggccgcggcgccgtcatccctcgcgtcctcccacctctccccaatcgcggcggtgtccactcccgccgtcccacatcagcttcgcatcgcttgctcccgccgccgcgccgggcgcatcgttgccatggctggatccggcaagttcttcgtcggaggcaactggaagtgcaatggaacaaaggctccattagcaaacttgt

SEQ ID NO: 3696 - DNA, 305 bp, Zea mays
  Clone ID: 700083139H1
cagagagaggcaggaacaacaatggatgttgttgctgcacaaacaaaggctattgctgaaaaaatatcagattggacaaatattgtgttggcatatgaaccagtttgggctattggtaccggcaaagttgcaactcctgctcaggctcaggaggttcatgatggtctgagaaagtggctccactccaatgttagccctgcagttgctgaattgacaaggataatttatggagggtctgtaaatggagctaactgcaaagaacttgcagctcaaccagatgttgatggattccttgttggtggagc

SEQ ID NO: 3697 - DNA, 290 bp, Zea mays
  Clone ID: 700205474H1
cattggacaaatattgtgttggcatatgaaccagtttgggctattggtaccggcaaagttgcaactcctgctcaggctcaggaggttcatgatggtctgagaaagtggctccactccaatgttagccctgcagttgctgaattgacaaggataatttatggagggtctgtaaatggagctaactgcaaagaacttgcagctcaaccagatgttgatggattccttgttggtggagcctcattgaagcctgaattcgtggacatcatcaagtctgccactgtcaagtcttc

SEQ ID NO: 3698 - DNA, 309 bp, Zea mays
  Clone ID: 700336856H1
aaacttttgaagtatgttttgagcagatgaaggcttttgcagatagtatttcaaactgggccgatgttgtgattgcatatgagcctgtttgggctattggaaccggaaaagttgctactcctgagcaagcccaggaagttcatgctgctgtacgcgattggttgacgaccaacatatcacctgatgttgcctctagcacccgaataatctatggaggttctgtgaatgcagccaactgtgcagagctagcaaagaaagaggatatcgatggttttcttgttggtggtgcctccttgaaggccccggact

SEQ ID NO: 3699 - DNA, 280 bp, Zea mays
  Clone ID: 700042717H1
gtgattgcatatgagcctgtttgggctattggaaccggaaaagttgctactcctgagcaagcccaggaagttcatgctgctgtacgcgattggttgacgaccaacatatcacctgatgttgcctctagcacccgaataatctatggaggttctgtgaatgcagccaactgtgcagagctagcaaagaaagaggatatcgatggttttcttgttggtggtgcctccttgaaggccccggacttcgccaccattatcaactcagtgaccgccaagaaagttg

SEQ ID NO: 3700 - DNA, 295 bp, Zea mays
  unsure (1)...(295): unsure at all n locations
  Clone ID: 700379491H1
cagttaaggttatctgccgtgcatagcgagagcgttctggaagagtagggatgcagggataacttttgaagtatgttttgagcagatgaaggcttgtgcagatagtatttcaaactgggccgatgttgtgattgcatatgagcctgtttgggctattggaaccggataagttgctactcctgagcaagcccaggaagttcatgctgctgtacgcgattggttgacgaccaacatatcacctgatgttgcctctagcaattttntaatctatggaggttctgtgaatgcagccaac

SEQ ID NO: 3701 - DNA, 242 bp, Zea mays
  Clone ID: 700156635H1
agagagggaagcaggcaaaacttttgatgtatgttttaggcagatgaaggcttttgcagatagtatttcaaactgggcagatgttgtaattgcatacgagcctgtttgggcgattggaaccggaaaagttgctactcctgagcaagcccaggaagttcatgctgctgtacgcaattggctgaagaccaacatatcacccgatgttgcctctagcactcgaataatctatggaggttctgtga

SEQ ID NO: 3702 - DNA, 237 bp, Zea mays
  Clone ID: 700046340H1
cggaaaagttgctactcctgagcaagcccaggaagttcatgctgctgtacgcgattggttgacgaccaacatatcacctgatgttgcctctagcacccgaataatctatggaggttctgtgaatgcagccaactgtgcagagctagcaaagaaagaggatatcgatggttttcttgttggtggtgcctccttgaaggccccggacttcgccaccattatcaactcagtgaccgccaa

SEQ ID NO: 3703 - DNA, 314 bp, Zea mays
  Clone ID: 700081869H1
cccacgcgtccggcctcgttgaaggccccggacttcgccaccattatcaactcagtgaccgccaagaaagttgcagcctgatggaccaccctgtgagaaataagaggccatcagcgtgtcgcctcatctgccacgccttaaagcctgtataggaggtgatccgtgtgatggtgtgcccgtcacctcctgtttttgctgatttgcagcacggggacagaaaataatgttttgctctcgtggacctgcactgcacgtgacgaggagagttcagttgtcgtgagcgatgtacgttggggatattgtgatgtggtcct

SEQ ID NO: 3704 - DNA, 167 bp, Zea mays
  unsure (1)...(167): unsure at all n locations
  Clone ID: 700426102H1
cggaggttctgtgaatgcagccaactgtgcagagctagcaaagaaagaggatatcgatggttttgttgttggtggtgcctccttgaaggccccggacttcgccaccattatcaactcagtgaccgccaagaaagttgcagcctcgtgngancacctgtgaagaaata

SEQ ID NO: 3705 - DNA, 368 bp, Zea mays
  Clone ID: 700613626H1
ttcggctcgaggaattgaatgctgtacccttgaaactgatgtagatgttgtggtggcacatccattcatctatattgatcaggttaagaattcactaactggtcgcattgaggtttctgctcagaatgtgtggattggaaaaggaggagcctacaccggagagatcagtgcagaacaactggtggacatcggctgtcaatgggttattcttggacactctgagcgtagacatattattggtgaaaatgatgagtttattggaaagaaggctgcatatgcattgagcccaaatgttaaggttattgcctgcataggagagctgctggaagagagggaagcaggcaatacttttgatgtatgtctaggca

SEQ ID NO: 3706 - DNA, 304 bp, Zea mays
  Clone ID: 700101506H1
cctcgaaactgatgtagatgttgtggtggctcctccattcatctatatcgatcaggtcaagaattcactaacgggtcgcattgaggtttctgctcagaatgtgtggattggaaaaggaggagcctacaccggagagatcagtgcagaacaactggtggacatcggttgtcaatgggttattcttggacactcagagcgtagacatattattggtgaaaatgacgagtttattgggaagaaggctgcatatgcattgagccaaaatgttaaggttattgcctgcataggagagcttctggaagag

SEQ ID NO: 3707 - DNA, 261 bp, Zea mays
  Clone ID: 700206445H1
gtggtggcacctccatttatctatattgatcaggttaagaattcactaactggtcgcattgaggtttctgctcagaatgtgtggattggaaaaggaggagcctacaccggagagatcagtgccgaacaactggtggacatcggctgtcaatgggttattcttggacactctgagcgtagacatattattggtgaaaatgatgagtttattggaaagaaggctgcatatgcattgagccaaaatgttaagggtattgcctgc

SEQ ID NO: 3708 - DNA, 225 bp, Zea mays
  Clone ID: 700220160H1
tctatatcgatcaggtcaagaattcactaacgggtcgcattgaggtttctgctcagaatgtgtggattggaaaaggaggagcctacaccggagagatcagtgcagaacaactggtggacatcggttgtcaatgggttattcttggacactcagagcgtagacatattattggtgaaaatgacgagtttattgggaagaaggctgcatatgcattgagccaaaatg

SEQ ID NO: 3709 - DNA, 328 bp, Zea mays
  Clone ID: LIB143-004-Q1-E1-C5
atacaatttagaagcgcccctcctcctctcccccatccgtacccaatctaatcgacacccggccgagatgggccgcaagttcttcgttggtggcaactggaaatgcctggaagagcccgcgttcttcttccaatgcgcctgtgcttccaggctccagcccagagcaaatcgtaaaagcccttcataagtttcgtgatgcatgttgtctgtaggagcagaggagttcgatatccaacttttggagacccattctcgtttgctgcacgaattaaccttacgtttcttgtcatggagctcggggcttgctcaatctgagcataggttggag

SEQ ID NO: 3710 - DNA, 228 bp, Zea mays
  unsure (1)...(228): unsure at all n locations
  Clone ID: LIB3061-017-Q1-K1-C9
gaagggaggtgcncccactgaatncatnaccatttgagatnctngacaacctnctgggggtagggttcanggctggncgccctgaaaggagaacnntaataagaaaataacatgaattcgggatccgcagagtcnncgtntgcggcggcggngggactaaangtcattgcatgtgttgccgagacncttgaacacaacnagntngtggacnncatnctncnncncggg

SEQ ID NO: 3711 - DNA, 339 bp, Zea mays
  Clone ID: LIB3062-034-Q1-K1-A8
ctagagttttgcagcaacctagcactaaggctcctgctaaaaagggaaaacagcaagcattgacaagtgctgaagaaccagatgagcctcctctgtgaagaggagcctacaccggactgatcagtgcaaaacaactggtggacatcatctgtcaatggatgattcttggacactctgagcgtagacatattattggtgaaaatgatgagtttattggaaagaaggctgcatatgcatagagccaaaatgttaagggcattgcctgcataggagagctgcttgaagagagtgaagcatgcaaaactcttaatgtatgttgaatgcagatgaaggcttttg

SEQ ID NO: 3712 - DNA, 348 bp, Zea mays
  Clone ID: LIB36-021-Q1-E1-E7
aacacgcgtccggcctccttgaaggccccggacttcgccaccattatcaactcagtgaccgccaagaaagttgcagcctgatggaccaccctgtgaagaaataagaggccatcaccgtgtcgcctcatctgccacgccttaaagcctgtaggaggcgtcacctcctgtttttgctgatttgcagcacggggacagaaaataatgttttgctctcgtggatctgcacgtgacgaggagagttcagttgtcgtgagcgatgtacgttgggaatattgttatgtggtccttttctaaagaaaaaaaatgttgacagtcaaggaaaaataataaaaaaaggcggccgctcta

SEQ ID NO: 3713 - DNA, 373 bp, Zea mays
  Clone ID: LIB3062-056-Q1-K1-F9
gcgcgcctcggcttcagcgccatggcgccctccaggaagttcttcgttgggggagactgggagaagaacgggcggaagcacagtctgggggagctcatcggcactctgaacgcggtcaaggtgccggccgacaccgatgtggaacgtgctcagcatactgcctatatcgacttagtccggcagaagctagatcccaagaacgctgaggctgcgcagaactgctacaaagtgactaatgacgcttgaactgatgagatcagccctggcatgatcaaacactgcggagccacacgggcggtactggggcactcagagagaacgcatgtctttggggagtcagatgagctgattgggcacaaagtgcgccatgctc

SEQ ID NO: 3714 - DNA, 442 bp, Zea mays
  Clone ID: LIB3067-047-Q1-K1-H2
ggtggagcttctttgaagcctgagttcatcgacatcatcaacgcggccaccgtgaagggcgctgaagatgttacgctgaagacgaacatactttttttttgctcaactgtgctatgtaagctagtagcttttgcgcaggagcagagactgttttgcctgcccccaacttttagcttgagcttgctaataatgtttacctctggacgtatcaataatggtgcttatgtaccccttttttgtgccgaattacggtggatccgtcatctgaaccatgggtttggtgtatgtaattgcgtcacccgatgcctaaggtgagactgaagtttttggacatttgggacaaggtagccttgtgccccacattggtcgaatgctgccaaaactgtaccggtcatctgtgctccgtacggattagcctgatctgcgaatgcaacttgtcagc

SEQ ID NO: 3715 - DNA, 433 bp, Zea mays
  Clone ID: LIB3067-055-Q1-K1-G8
cccacgcgtccgggatcatttacggaggctctgtaactgccgcgaactgcaaagagctggcagcacagcctgatgtcgatgggtttcttgtcggtggagcttctttgaagcctgagttcatcgacatcatcaacgcggccaccgtgaagtccgcttaagatgttacgctgaagacgaacatactttttttttgctcaactgtgctatgtaagctagtagcttttgcgcaggagcagagactgttttgcctgcccccaacttttagcttgagcttgctaataatgtttacctctggacgtatcaataatggtgcttatgtaccccttttttgtgccgaattacggtggatccgtcatctgaaccatgggtttggtgtatgtaattgcgtcacccgatgcctatggtgagactgaagtttttggacatttgggac

SEQ ID NO: 3716 - DNA, 427 bp, Zea mays
  Clone ID: LIB3067-059-Q1-K1-D10
cgcaccccaatctaatcgacacctcgccgtgatgggccgcaagttcttcgtcggtggcagctggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtgttggtgagacactt

SEQ ID NO: 3717 - DNA, 457 bp, Zea mays
  Clone ID: LIB3067-027-Q1-K1-B10
aaggttgcgtatgccctgtctcagggactaaaggtcattgcatgtgttggtgagacagttgggcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgccttcctgagggattggctaaagaccaacgtcagccctgaggttgctgaatctactaggatcatttacggaggctctgtaactgccgcgaactgcaaagagctagcagcacagcctgatgtcgatgggtttcttgtcggtggagcttctttgaagcctgagttcatcgacattatcaacgcggtcaccgtgaagtccgcttaagatgttacgctgaagacgaacatactttttt

SEQ ID NO: 3718 - DNA, 471 bp, Zea mays
  unsure (1)...(471): unsure at all n locations
  Clone ID: LIB189-032-Q1-E1-H2
agggtttntcaacgtcacgtcgcacggacagtacagactacacggtcgagcacgcgtccgaccacacgtccgcccacgcgtccggctgcgccaaaatttcaatgttgcggctcaaaactgctggttaaacaagggaggtcctttcactggtgaactcagtgctgagatgctcgtcaaccttggtgttccctgcgtcattcttggacactctgaaacgagagctctgctgggagaatcaaatgaatttgttggagacaaggttgcgtatgccctgtctcagggactaaaggtcattgcatgtgttggtgagacccttgagcagaaggaggctgggtctnacatggatgttgttgctgcacaaacaaaagcaattgctgagaagatcaaggactggagcaacgtacttgttgcctatgaaccagtttgggctattggaactggtacagttgccacctcagctcaggctcagga

SEQ ID NO: 3719 - DNA, 402 bp, Zea mays
  Clone ID: LIB3059-023-Q1-K1-A7
cccacgcgtccgcccacgcgtccggacaaggttgcgtatgccctgtctcagggactaaaggtcattgcatgtgttggtgagacccttgagcagagggaggctgggtctaccatggatgttgttgctgcacaaacaaaagcaattgctgagaagatcaaggactggagcaacgtagttgttgcctatgaaccagtttgggctattggaactggtaaagttgccaccccagctcaggctcaggaagtgcacgcctccctgagggattggctaaagaccaatgccagccctgaggttgctgaatctactaggatcatctacggaggctctgtaactgctgcgaactgcaaagagctagcagcacagcctgatgtcgatggttttcttgtcggtggagcttctttg

SEQ ID NO: 3720 - DNA, 450 bp, Zea mays
  Clone ID: LIB3069-016-Q1-K1-D9
atttagaagcgcccctcctcctctcccccttccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgcttagaactgctgggtgaataagggaggtgcattcactggtgaaattagtgctgaaatgctcgtcaaccttggcgttccctgggtcattcttggacactctgaaaggagagctctgctgggagaatcaaatgagtttgttggagacaaggttggctttgctctgtctaagggactaaaggtcattgcatgtgttggtg

SEQ ID NO: 3721 - DNA, 503 bp, Zea mays
  Clone ID: LIB143-006-Q1-E1-A8
cggcgctcgaggggctgactgttcatttcgcctgtcggtgcaagtccgaaattcgccgggccacccacgcaaccgaaccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttgga

SEQ ID NO: 3722 - DNA, 387 bp, Zea mays
  Clone ID: LIB3068-054-Q1-K1-C11
cccacgcgtccgcgcccctcctcctctccttcatccgtacccaatctaatctacacccgggcgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgttccctgtgtcattcttggacactctgaaaggagagctctgctgggagaatcaaatg

SEQ ID NO: 3723 - DNA, 404 bp, Zea mays
  unsure (1)...(404): unsure at all n locations
  Clone ID: LIB3067-034-Q1-K1-B7
acttgagcagagggaggctgggtctaccatggaggttgttgctgcacaaacaaaagcagttgctgagaagatcaaggactggagcaacgtagttgttgcctatgaaccagtttgggctattggaactggtaaagttgccaccccagctcaggctcaggaagtgcacgcctccctgagggattggctaaagaccaacgtcagccctgaggttgctgaatctactaggatcatttacggaggctctgtaactgccgcgaactgcaaagagctagcagcacagcctgatgtcgatgggtttcttgtcggtggagcttctttgaagcctgagttcatcgacatcatcaacgcggccaccgtgaagtccgcttaagatgttacgctgaagacgaacatactnttttttt

SEQ ID NO: 3724 - DNA, 413 bp, Zea mays
  Clone ID: LIB143-031-Q1-E1-E5
aatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggaaagctctgctgggaaaatcaaatgaatttg

SEQ ID NO: 3725 - DNA, 423 bp, Zea mays
  unsure (1)...(423): unsure at all n locations
  Clone ID: LIB3069-055-Q1-K1-H12
agggggntnnnaacagggccccagtcccncgcacgctccaccggaanggaagggncgacccgagcgagcggntgctcagaactgctgggtgaagaagggttgtgcattcactggtgaaattagtgctgaaatgctggtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagc

SEQ ID NO: 3726 - DNA, 423 bp, Zea mays
  unsure (1)...(423): unsure at all n locations
  Clone ID: LIB3061-027-Q1-K1-A8
aagctccgacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctaggagaatcanatgaatctgttggagacaaggttgcgtatgccctgtcttaaggactaaaggtcattgcatgttgtggtg

SEQ ID NO: 3727 - DNA, 379 bp, Zea mays
  Clone ID: LIB3078-008-Q1-K1-E5
gggaggtgcattcactggtgaaattagtgctgagatgctcgtcaaccttggcgttccctgggtcattcttggacactctgaaaggagagctctgctgggagaatcaaatgagtttgttggagacaaggttgcttttgctctgtctcagggactaaaggtcattgcatgtgttggtgagacccttgaggagagggaggctggttcaaccatggatgttgttgctgcacaaacaaaagcaattgctgagaagatcaaggactggagcaacgttgttcttgcctatgaaccagtctgggctattggaactggcaaagtcgccaccccagctcaggctcaggaagtgcacgccttcctgagggattgggtaaagatcaatgtc

SEQ ID NO: 3728 - DNA, 349 bp, Zea mays
  unsure (1)...(349): unsure at all n locations
  Clone ID: LIB3066-027-Q1-K1-E1
cggacgcgtgggctgaaaggagagctctgctgggagaatcaaatgaatttgttggagacaaggttgcgtatgccctgtctcagggactaaaggtcattgcatgtgttggtgagacacttgagcagagggaggctgggtctaccatggaggttgttgctgcacaaacaaaagcaattgctgagaagatcaaggactggagcaacgtagttgttgcctatgaaccagtttgggctattggaactggtaaagttgccaccccagctcaggctcaggaagtgcacgcctncctgagggattggctaaagaccaacgtcagccctgaggttgctgaatctactaggatcattta

SEQ ID NO: 3729 - DNA, 314 bp, Zea mays
  Clone ID: LIB3067-032-Q1-K1-E5
caggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaa

SEQ ID NO: 3730 - DNA, 360 bp, Zea mays
  Clone ID: LIB3078-029-Q1-K1-F7
gcctctgttggccgttcgaatctccgcacccaatttaatcgacacctcaccgagatgggccgcagagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaagagagctct

SEQ ID NO: 3731 - DNA, 338 bp, Zea mays
  Clone ID: LIB3061-006-Q1-K1-B7
gccaaatacaatttagaagcgcccctcctcctctcccccatccgtacccaatcgaatcgacacccggccgagatgggccgcaagttcttcgttggtggcaactggaaatgcaatggaaccgcagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcactggtgaaattagtgctgaaatgctcgtcaaccttggcgt

SEQ ID NO: 3732 - DNA, 430 bp, Zea mays
  Clone ID: LIB143-048-Q1-E1-F8
agcatcgtaggcggccatcatcaaactacaggctcatggctaggactcgcgggcagatacacgcctcagaattgattcgtaggagacaatgttgcgtatgccctgtctcatggactaacggtcattgcatgtgttggtgatacccttgatcatagggatgctgagtctaccatggatgttgttgctgcacatccagaagcaattgctgataacatcaaggactggatcaacgtaattgttgcctatgaaccactttgggctattggaactggtaaagttgccaccccagctcaggctcaggaagtgcacgcctccctgaaggattggctaaagaccaatgccatccctgaggttgctgaatctactaggatcatctacggaggctctgtaactgctgcgaactgcagatagctagcagcacagcctgatg

SEQ ID NO: 3733 - DNA, 408 bp, Zea mays
  Clone ID: LIB3078-033-Q1-K1-B10
gcgatccaatctagactctcccctcttcctccctccctctctctatctctcttcggggtccgaatctacggacccaagcgaatcgacacctcaccgacatgggccgcacgctcttcatccgtggcaactggaaatgcaatggaaccacagatcatgtcgcgaacatagtcaaaaccctgaatgaacgacaggttcccccttcagatcttgaccaggtcgttgccagccctacttatgtcttccttcctgtgctcaagagccagctgtgccaagagttccatgatgctgctcataactgctgggtgaagaaaggacgtgctttcactggtgaactcagatctgagatgctcctcaaccttggtgatccctgagtcattcttggacactctgaaacgagaactctgcttg

SEQ ID NO: 3734 - DNA, 267 bp, Zea mays
  Clone ID: LIB3069-046-Q1-K1-C4
tcggccacgccgttcgccacgcgttcgcttggacactcttaaaggagagctcttcttggagaatcaaatgaatttgttggagacaaagttgcgtatgccctgtctcagggactaaaggtcattgcatgtgttggtgagacacttgagcagaaggaggctgggtctaccatggaggttggtgctgcacaaacaaaagcaattgctgagaagatcaaggactggagcaacgtagttgttgcctatgaaccagtttgggctattggaact

SEQ ID NO: 3735 - DNA, 241 bp, Zea mays
  Clone ID: LIB3061-049-Q1-K1-H2
tcgtgctcactctacaaggagagctctgctgggagaatcaaatgaatttgttggaaacaaggttgcgtatgccctgtcttagggactaaaggtcattgcatgtgttggtgagacccttgagcagaaggaggctgggtctaccatggatgttggtgctgcacaaacgaaagcaattgctgagaagatcaaggactggagcaacgtagtttgtgcctatgaaccatgttgggctatcggaact

SEQ ID NO: 3736 - DNA, 260 bp, Zea mays
  Clone ID: LIB143-029-Q1-E1-G4
atccaatctagaagctcccctctccctccctccctctctctctctctcttcgccgtccgaagctccgcacccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccat

SEQ ID NO: 3737 - DNA, 398 bp, Zea mays
  Clone ID: LIB84-027-Q1-E1-E5
cagccctgaggtctctgaatctacaaggatcatctatggaggttcagtaactgctgcgaactgcaaagagctggcagcacagcctgatgtcgatggtttccttgtgggcggtgcttctttgaagcccgagttcatcgacatcatcaacgccgccgccgtgtgaagtccgctgaagatgttccaacccttcaccctgttgcggtgatgtgctgaagacagatcagactacttttttgtttaaccgtgcagtgctatgtaagctactaactttgcgctggtgcggatgctgatttccctccccctagctttttgtgaggctactctacagcttgattcagcttgctaataatgtttgcctctggacatagcgatagtggtgtttgtgtagcccttttttt

SEQ ID NO: 3738 - DNA, 231 bp, Zea mays
  Clone ID: LIB3062-001-Q1-K2-F7
caatttagaagcgcccctcctcctctccccatccgtgacccaatctaatcgacacccggccgagatgggccgcaagttcttcgttggtggcaactggaaatgcaatggaaccgcagatcaggttgagaagattgtcaaaaccctgaatgaaggaaatgttccctcttcagatgtcgttgaggtcgttgtcaagcctacttatgtgttcctcccggtggtcaagagccagct

SEQ ID NO: 3739 - DNA, 304 bp, Zea mays
  Clone ID: LIB3066-014-Q1-K1-H11
ctgcaaagagctggcagcacagcctgatgtcgatggtttccttgtgggcggtgcttctttgaggcccgagttcatcgacatcatcaacgccgccgccgtgtgaagtccgctgaagatgttccaacccttcaccctgttgcggtgatgtgctgaagacagatcagactatttttttgtttaaccgtgcagtgctatgtaagctactaactttgcgctggtgcggatgctgatttccctccccctagctttttgtgaggctactctacagcttgattcagcttgctaataatgtttgcctctggac

SEQ ID NO: 3740 - DNA, 463 bp, Zea mays
  unsure (1)...(463): unsure at all n locations
  Clone ID: LIB3069-014-Q1-K1-C11
agccngcgctacagaacaggcagcaccgtcgctctggcctggcacctttgggctggtttatgtgcttgtggatgtgcgggtggatgtgcgggctacgcagttagtcgtgttaagagccttaagccgtcgtctagaatcgtcgggcgaagaagggaggcgtacctatcggcgaaaccagcgtcgaaacgtctgctaattccggtgcctttcgggctacctccggatatctcgaaaggagagtctcgtcgggagaactaaacgagcccgccggagataaggccgtccccgtctcgctctagggatcaaaggctaccgtacgcgccggcgagatttccgaggagagggaggtcggcctaattacggacgccgccgtcgtataaataaaagtaaccgtcgagaagactaaggatcggagtaatgccgcctccgttcacgaattagctcgggtcaccggaatcggtaa

SEQ ID NO: 3741 - DNA, 469 bp, Zea mays
  unsure (1)...(469): unsure at all n locations
  Clone ID: LIB3069-013-Q1-K1-C11
agtcagcggtggctttttgattcccctgtncanatcacgnctggccccgttggacgtgtttatgtgcctgtggatgtgcgggtggatgtgcgggctacccacctatcgtgttaagagccttaagccgtggtcggagatcgtcgggcgaagaagggaggcgtacctatcggcgaaaccagcgtcgaaacgtctgctaattccggtgcctttcgggctacctccggatatctcgaaaggagagtctcgtcgggagaactaaacgagcccgccggagataaggccgtccccgtctcgctctagggatcaaaggctaccgtacgcgccggcgagatttccgaggagagggaggtcggcctaattacggacgccgccgtcgtataaataaaagtaaccgtcgagaagactaaggatcggagtaatgccgcctccgttcacgaattagctcgggtcaccggaatcggtaaagctg

SEQ ID NO: 3742 - DNA, 466 bp, Zea mays
  unsure (1)...(466): unsure at all n locations
  Clone ID: LIB3062-045-Q1-K1-F6
ctcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgngtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttg

SEQ ID NO: 3743 - DNA, 402 bp, Zea mays
  Clone ID: LIB3067-045-Q1-K1-E5
cccacgcgtccgccctcgcgtctttgcgtacgaggacggcttctagtccctcgcctaccccgcccccgaacctggcgtctgccctaccaaccgcagcagcgacactagaatggccgcggcgccgtcatccctcgcgtcctcccacctctccccaatcgcggcggtgtccactcccgccgtcccacatcagcttcgcatcggctgctcccgccgacgcgccgggcgcatcgttgccatggctggatccggcaagttcttcgtcggaggcaactggaagtgcaatggaacaaaggactccattagcaaacttgtctctgaattgaatgctgctacccttgaaactgatgtagatgttgtggtggcaccctcatttatctatattgatcaggttaaagaattcac

SEQ ID NO: 3744 - DNA, 415 bp, Zea mays
  Clone ID: LIB3059-026-Q1-K1-G9
aatgggttattcttggacactctgagcgtagacatattattggtgaaaatgaggagtgtattggaaagaaggctgcatatgcattgagccaaaatgttaaggttattgcctgcataggagagctgctggaagagagggaagcaggcaaaacttttgatgtatgttttaggcagatgaaggcttttgcagatagtatttcaaactgggcagatgttgtaattgcatacgagcctgtttgggctattggaaccggaaaagttgctactcctgaacaagcccaggaagttcatgctgctgtacgcaattggctgaagaccaacatatgacccgatgttgcctctagcactcgaataatctatggaggatctgagaatgcatgcaactgtgcggagctagcaaagaaagaagatattga

SEQ ID NO: 3745 - DNA, 433 bp, Zea mays
  Clone ID: LIB3078-049-Q1-K1-E4
gcgattggttgacgaccaacatatcacctgatgttgcgtctagcacacgaataatctatggaggttctgtgaatgcagccaactgtgcagagctagcaaagaaagaagatatcgacggttttcttgttggtggtgcctcgttgaaggccccggacttcgccaccattatcaactcagtgaccgccaagaaagttgcagcctgatggaccaccctgtgagaaataagaggccatcagcgtgtcgcctcatctgccacgccttaaagcctgtataggaggtgatccgtgtgatggtgtgcccgtcacctcctgtttttgctgatttgcagcacggggacagaaaataatgttttgctctcgtggacctgcactgcacgtgacgaggagagttcagttgtcgtgagcgatgtacgttggggatattgtgatgtggt

SEQ ID NO: 3746 - DNA, 429 bp, Zea mays
  Clone ID: LIB3062-034-Q1-K1-A4
ggtggcacctccattcatctatattgatcaggttaagaattcactaactggtcggattgaggtttctgctcagaatgtgtggattggaaaaggaggagcctacaccggagagatcagtgcagaacaactggtggacatcggctgtcaatgggttattcttggacactctgagcgtagacatattattggtgaaaatgatgagtttattggaaagaaggctgcatatgcattgagccaaaatgttaaggttattgcctgcataggagagctgctggaagagagggaagcaggcaaaacttttgatgtatgttttaagcagatgaaggcttttgcagatagtatttcaaactgggcagatgttgtaattgcatacgaacctgtttgggctattggaaccggaaaagttgctacttcttgaacaacccaaga

SEQ ID NO: 3747 - DNA, 229 bp, Glycine max
  Clone ID: 700743237H1
ggccgcacagcccgatgttgatggatttttggttggtggtgccaattctttgcagtttcctccatttacagaacctccatagataattcttacagatgcagcaactgcaaagaattggccgcacagcccgatgttgatgatttttggttggtggtgcctccctgaagccggagttcgtggacatcataaatgctgccactgtgaagaagaattgaaattcgtagttagg

SEQ ID NO: 3748 - DNA, 267 bp, Glycine max
  unsure (1)...(267): unsure at all n locations
  Clone ID: 700977730H1
ggnntngaggttgnacaagggtanctctgtctgcttctacaatttctctcgtnaccaatagaaanncaaaacnanaacatgggcagaaaattcttcgncggtggcaantgganattgaangggancaatgaggaggtaaagnagattgtnantactttgaatgaggctaaagtngctgnagangatgtngtagaagttgttgtgagaccnccttatgtgttccnnncatngnaanaagtttgctgcanctgnttnccatgtttcggc

SEQ ID NO: 3749 - DNA, 265 bp, Glycine max
  Clone ID: 701056176H1
tgggaccaaagactccatcagaaagcttgtctctgacttgaacagtgcaacattggagtctgatgttgatgttgttgttgcacctccttttgtgtacatcgatcaggtgaaaaactcaattacagataggattgaaatttctgcccagaattcttgggtgggaaaaggtggggctttcacgggagaaatcagtgtggagcaactaaaagaccttggctgcaagtgggttattcttggacattctgagcgaagacatgtaattgga

SEQ ID NO: 3750 - DNA, 259 bp, Glycine max
  Clone ID: 701110172H1
ggcaactggaagtgtaacgcaacaaaagactcaatcagcaagcttgttgctgacttgaacaatgcaaaattggagcctgatgttgatgttgtcgttgcacctcccttcctctacatcgatcaagtgaaaaactcactcactgagcggcttgacatatctgcccagaattcttgggttggaaaaggtggtgcttttactggagaaatcagcgcggaacaactaaacgatcttggatgcacgtgggttgttcttggacatt

SEQ ID NO: 3751 - DNA, 245 bp, Glycine max
  Clone ID: 700995141H1
gcaacctcaacatccctcttctcctcaaatctccattctctcaactcacagcctttctcttcctcactctccttcttccgaaatgtccattccaccctctctttcccttcttctaaaccctcccgtggcgttgtagccatggctggctctggcaagttctttgttggtggcaattggaagtgtaatgggaccaaagactccatcagaaagcttgtctctgacttgaacagtgcaacattggagtc

SEQ ID NO: 3752 - DNA, 283 bp, Glycine max
  Clone ID: 701124548H1
agatgcaccactctttcttcttcaatcaatggcagcaacctcaacatccctcttctcctcaaatctccattctctcaactcacaacctttctcttcctcactctccttcttctgaaatgtccattccaccctctctttcccttcttctaaaccctcccgtggcgttgtagccatggctggctctggcaagttctttgttggtggcaattggaagtgtaatgggaccaaagactccatcagaaagcttgtctctgacttgaacagtgcaacattggagtctgat

SEQ ID NO: 3753 - DNA, 249 bp, Glycine max
  Clone ID: 700739771H1
ctcgagccgcttcaatcaatggcagcaacctcaacatccctcttctcctcatatctccattctctcaactcataacctttctcttcatcactctccttccgaaatgtccattccactctctctttcccttcttctaaaccctctcgtggcgttgtagccatggctggctctggcaagttctttgatggtggcaattggaagtgtaatggtaccaaagactccatcagacagcttgtctctgttttgaac

SEQ ID NO: 3754 - DNA, 278 bp, Glycine max
  unsure (1)...(278): unsure at all n locations
  Clone ID: 700999820H1
cattcctaggtaccatttgcaccactctttcttcttcaatcaatggcagcaacctcaacatccctcttctcctacaaatctccattctctcaactcacaacctttctcttcctcactctccttnagccngtccattccaccctctctnncanaacantctaaaccctcccgtggcgttgtagccatggctggctctggcaagtnctttgttggtggcaattggaagtgtaatgggaccaaagactccatcagaaagttgtctctggattgaacaggca

SEQ ID NO: 3755 - DNA, 268 bp, Glycine max
  Clone ID: 701119858H1
attcaatccaagcttagattgttttactgttacaccattcctaggtaccatttgcaccactctttcttcttcaatcaatggcagcaacctcaacatccctcttctcctcaaatctccattctctcaactcacaacctttctcatcctcactctccttcttccgaaatgtccattccaccctctctttcccttcttataaaccctcccgtggcgttgtagccatggctggctctggcaagttctttgttggtggcaattggaagtgtaa

SEQ ID NO: 3756 - DNA, 289 bp, Glycine max
  Clone ID: 700988684H1
aaatttctgcccagaattcttgggtgggaaaaggtggggctttcacgggagaaatcagtgtggagcaactaaaagaccttggctgcaagtgggttattcttggacattctgagcgaagacatgtaattggagaaaatgatgagtttataggaaagaaaactgcctatgctttgagtgagggtcttggtgtgatagcatgtattggggaacttctacaagaaagagaagctggtcaaactttcgacatttgtttccagcaattgaaggcttttgcagatgcagtgccaag

SEQ ID NO: 3757 - DNA, 270 bp, Glycine max
  Clone ID: 700902425H1
gaaatttctgcccagaattcttgggtgggaaaaggtggggctttcacgggagaaatcagtgtggagcaactaaaagaccttggctgcaagtgggttattcttggacattctgagcgaagacatgtaattggagaaaatgatgagtttatagggaagaaggctgtctatgctttgagtgagggtctaggtgtgatagcatgtattggggaactgttacaagaaagagaagctgggaaaactttcgatgtttgttttcagcaattgaaggct

SEQ ID NO: 3758 - DNA, 281 bp, Glycine max
  Clone ID: 701069004H1
gtgaaaaactcactcactgagcggattgaaaatctgcccagaattcttgggttggaaaaggtggtgctcttactggagaaatcagcgcggaacaactaaaagatcttggatgcaagtgggttgttcttggacattctgagcgaagacatgttattggagaaaatgatgagtttatagggacgaaagctgcctatgctttgagccaaggtcttggggtgattgcatgcattggagaattgttagaagaaagggaggctggaaaaacttttgatgtttgtttt

SEQ ID NO: 3759 - DNA, 223 bp, Glycine max
  Clone ID: 701151554H1
acggctgcgagaagacgacagaagggtggaaaaggtggtgcttttactggagaaatcagcgcggaacaactaaaagatcttggatgcaagtgggttgttcttggacattctgagcgaagacatgttattggagaaaatgatgagtttatagggaagaaagctgcctatgctttgagccaaggtcttggggtgattgcatgcattggagaattgttagaagaca

SEQ ID NO: 3760 - DNA, 170 bp, Glycine max
  unsure (1)...(170): unsure at all n locations
  Clone ID: 700659936H1
cactgagcggattgaaatatctgcccagaattcttgggttggaaaaggtggtgcttttactggagaaatcagcgcggaacaactaaaagatcttggatgcaagtnggttgttcttggacattctnagcgaagacatgttattggngaaaatgatgagtttatagggaaga

SEQ ID NO: 3761 - DNA, 355 bp, Glycine max
  unsure (1)...(355): unsure at all n locations
  Clone ID: 700680927H1
gtttcggcacaaaactgttgggttcgcaaaggtggtgcttataccggtgaggttagtgctgtcatgcttgttaatttgggaattccttgggttattattggtcactctgaacggaggcagcttttaaatgaatcaaacgagtttgtgggagataaagttgcctatgcacttcaacaaggtctaaaagttattgcatgcattggggagactctcgaacagcgtgaagctggtacaacaacggctgttgtttctgagcaaacaaaagcaattgcagctanaatatcaaattgggacaatgttgtcttggcctacgagccagtttggggcattggaacaggaaaggttgctactcctg

SEQ ID NO: 3762 - DNA, 275 bp, Glycine max
  unsure (1)...(275): unsure at all n locations
  Clone ID: 700656871H1
gagcaaacaaaagcaattgcagctaaaatntcaaattgggacaatgtcgttttggcctatgagccagtttgggccattggaacaggaaaggttgcaactcctgctcaggctcaagaggttcatgctgatttaaggaaatgggttcatgacaatgtgagtgctgaagttgctgcatctgtaagaattatctatggaggctctgtaaatggaggaaactgcaaagaattggcagcacagcccgatgttgatggatttttggttggtggtgcatccct

SEQ ID NO: 3763 - DNA, 268 bp, Glycine max
  Clone ID: 701124364H1
gtgggagataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgtcgttttggcctacgagccagtttgggccattggaacaggaaaggttgctactcctgctcaggctcaagaggtccatgctgatttgaggaaatgggttcatgacaatgtgagtg

SEQ ID NO: 3764 - DNA, 264 bp, Glycine max
  Clone ID: 701134707H2
gtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtg

SEQ ID NO: 3765 - DNA, 256 bp, Glycine max
  Clone ID: 700673750H1
catgcattggggacactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcaggctcaagaggttcatgctgatttaaggaaatgggttcatgacaatgtgagtgctgaaattgctgcatctgtaagaattatctatggagg

SEQ ID NO: 3766 - DNA, 270 bp, Glycine max
  Clone ID: 701123269H1
gtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagtcgttagtgctgaaatgcttgttaatttgggaattccttgggttattattggtcactctgaacggaggcagcttttgaatgaatcaaatgagtttgtgggagataaagttgcctatgcacttcaacaaggt

SEQ ID NO: 3767 - DNA, 264 bp, Glycine max
  Clone ID: 701004846H1
cggagataaagttgcctatgcacttcaacaaggtctaacagttattgcatgcattggggagactctcgaacagcgtgaagctggtacaacaacggctgttgtttctgagcaaacaaaagcaattgcagctaaaatatcaaattgggacaatgttgttttggcctacgagccagtttgggccattggcacaggaaaggttgctactcctgctcaggctcaagaggtccatgctgatctgaggaaatgggttcatgacaatgtgag

SEQ ID NO: 3768 - DNA, 258 bp, Glycine max
  unsure (1)...(258): unsure at all n locations
  Clone ID: 700993362H1
gcattggggagactctcgaacagcgtgaagctggtacaacaacggctgttgtttctgagcaaacaaaagcaattgcagctaaaatatcaaattgggacaatgtcgttttggcctacgagccagtttgngccattggaacaggaaagnttgctactcctgctcaggctcaagaggtccatgcggatttgaggaaatgggttcatgacaatgtgagtgctgaagttgctgcatcggtaanatttatctanggaggtctgt

SEQ ID NO: 3769 - DNA, 278 bp, Glycine max
  Clone ID: 701005445H1
tgcttatactggagaggttagtgctgaaatgcttgttaatttgggaattccttgggttattattggtcactctgaacggaggcagcttttgaatgaatcaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatg

SEQ ID NO: 3770 - DNA, 278 bp, Glycine max
  Clone ID: 701134327H1
ctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatg

SEQ ID NO: 3771 - DNA, 272 bp, Glycine max
  Clone ID: 701148169H1
aaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcaaaactgttgggttcgcaaaggtggtgcttataccggtgaggttagtgctgaaatgcttgttaatttggg

SEQ ID NO: 3772 - DNA, 264 bp, Glycine max
  Clone ID: 701153410H1
tacggctgcgagaagacgacagaaggggaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaattccttgggttattattggtcactctgaacggaggcagcttttaaatgaatcaaacgagtttgtgggagataaagttgcctatgca

SEQ ID NO: 3773 - DNA, 257 bp, Glycine max
  Clone ID: 700830168H1
ctcgagccggttgcaactcctgctcaggctcaagaggttcatgctgatttaaggaaatggactcatgacaatgtgagtgctgaagttgctgcatctgtaagaattatctatggaggctctgtaaatggaggaaactgcaaagaattggcagcacagcccgatgttgatggatttttggttggtgtggcatccctcaaggcggaatttgtggacatcataaacgctgctactgtgaagaagaattgaaattcgtagtt

SEQ ID NO: 3774 - DNA, 283 bp, Glycine max
  Clone ID: 701120627H1
cttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagatgttagtgctgaaatgc

SEQ ID NO: 3775 - DNA, 256 bp, Glycine max
  unsure (1)...(256): unsure at all n locations
  Clone ID: 700975358H1
aaaaaatcatgggcagaaaattcttcgtcggtggtcaactggaaatgcaatgggaccactgaggaggtgaagnagattgttactactttaaatgaagctaaagtccctggagaagatgttgtagaagttgttgtgagccctccttttgtgttccttccttttgtaaaaagtttgctgcgccctgatttccatgtctcggcccaaanttgttgggttcgcaaaggtggtgcttatactggagangntagtgctgaaa

SEQ ID NO: 3776 - DNA, 262 bp, Glycine max
  Clone ID: 700755979H1
gtaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgctt

SEQ ID NO: 3777 - DNA, 266 bp, Glycine max
  Clone ID: 701131374H1
gtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttctgtgttccttccttttgtaaaaagtttgctgcgccctgatttccatgtctcggcccaaaattgttgggttcgcaaaggtggtgcttat

SEQ ID NO: 3778 - DNA, 281 bp, Glycine max
  unsure (1)...(281): unsure at all n locations
  Clone ID: 700994166H1
gtagaagttgttgtgagccctccttttgtgttccttncttttgtaaaaagtttgctgcgccctgatttccatgtctcggcccaaaattgttgggttcgcaaaggtggtgcttatactggagaggttagtgctgaaatgcttgtnaatttgggaattcctgggttattattggtcactctgaacggaggcagcttttgaatgaatcaaatgagtttgtgggnccataaagttgcctatgcacttcaacaaggtctgaaattatagcatgcattgggccaacc

SEQ ID NO: 3779 - DNA, 284 bp, Glycine max
  Clone ID: 701138038H1
atcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgc

SEQ ID NO: 3780 - DNA, 262 bp, Glycine max
  Clone ID: 700974248H1
gcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtgg

SEQ ID NO: 3781 - DNA, 274 bp, Glycine max
  unsure (1)...(274): unsure at all n locations
  Clone ID: 700655832H1
ctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccntccttttgtgttccttccttttgtaaaaagtttgctgcgccctgatttccatgtctcggcccaaaattgttgggttcgcaaagtggtgctta

SEQ ID NO: 3782 - DNA, 253 bp, Glycine max
  Clone ID: 700758320H1
cactttctctcgtttcaatcgaaaaaaatcatgggcagaaaattcttcgtcggtggcaactggaaatgcaatgggaccactgaggaggtgaagaagattgttactactttaaatgaagtaaagtccctggagaagatgttgtagaagttgttgtgagccctccttttgtgttccttccttttgtaaaaagtttgctgcgccctgatttccatgtctcggcccaaaattgttgggttcgcaaaggtggtgctta

SEQ ID NO: 3783 - DNA, 284 bp, Glycine max
  Clone ID: 701064709H1
aagggtttctcttctctttctctgtctgcttcttcactttctctcgtttcaatcgaaaaaaatcatgggcagaaaattcttcgtcggtggcaactggaaatgcaattgggacactgaggaggtgaagaagattgttactactttaaatgaagctaaagtccctggagaagatgttgtagaagttgttgtgagccctccttttgtgttccttccttttgtaaaacgtttgctgcgccctgatttccatgtctcggcccaaaattgttgggttcgcaaaggtggtg

SEQ ID NO: 3784 - DNA, 278 bp, Glycine max
  Clone ID: 701138504H1
gcttcttcactttctctcgtttcaatcgaaagcaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctggcgccctgatttccatgtttcggcacaaaactgttgggttcgcaaaggtggtgcttataccggtga

SEQ ID NO: 3785 - DNA, 271 bp, Glycine max
  Clone ID: 700980284H1
aagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggt

SEQ ID NO: 3786 - DNA, 263 bp, Glycine max
  Clone ID: 701133585H2
gtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggtt

SEQ ID NO: 3787 - DNA, 285 bp, Glycine max
  Clone ID: 700674706H1
ctcgagccggttgaacaagggtttctctgtctgcttcttcactttctctcgtttcaatacgcaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggtcg

SEQ ID NO: 3788 - DNA, 269 bp, Glycine max
  Clone ID: 700964927H1
aagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcg

SEQ ID NO: 3789 - DNA, 253 bp, Glycine max
  Clone ID: 700830923H1
gcactttctctcgtttcaatcgaaaccaaactccaaacgtgggcagaaaattcttcgtcggtggcaactggaaatgccctgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaagg

SEQ ID NO: 3790 - DNA, 253 bp, Glycine max
  Clone ID: 700662845H1
gtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaatgttgggttcgcaaaggtggtgcttatactggagagt

SEQ ID NO: 3791 - DNA, 257 bp, Glycine max
  Clone ID: 701133824H1
ggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactg

SEQ ID NO: 3792 - DNA, 238 bp, Glycine max
  Clone ID: 700848913H1
ctttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttg

SEQ ID NO: 3793 - DNA, 256 bp, Glycine max
  Clone ID: 701005984H1
ggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaact

SEQ ID NO: 3794 - DNA, 255 bp, Glycine max
  Clone ID: 701140769H1
tcgctgtctgcttcttcactttctctcgtttcaatcgagaccagaacaaaaacatgggcagaaaattcttcgtcggtggcaactggaaatgcaatgggatcactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacgaaactgtt

SEQ ID NO: 3795 - DNA, 259 bp, Glycine max
  Clone ID: 700753357H1
tctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaatgtcgtagaagttgttgtgagccctccttttgtgttccttcctgttgtaaaaagtttgctgcgccctgatttccatgtttcggcacaaaactgttgggttcgc

SEQ ID NO: 3796 - DNA, 250 bp, Glycine max
  Clone ID: 701056336H1
tgcttcttcactttctctcgtttcaatcgagaaaaatcatgggcagaagattcttcgtcggtggcaactggaaatgcaatgggaccactgaggaggtgaagaagattgtgactactttaaatgaagctaaagtccctggagagatgttgtagaagttgttgtgagccctccttttgtgttccttccttttgtaaaaagtgtgctgcgccctgatttccatgtctcggcccaaaattgttgggttcgcaaa

SEQ ID NO: 3797 - DNA, 265 bp, Glycine max
  Clone ID: 700895411H1
attgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaa

SEQ ID NO: 3798 - DNA, 267 bp, Glycine max
  Clone ID: 701060188H1
gtttctctttctctttctctgtctgcttcttcactttctctcgtttcaatcgaaaaaaatcatgggcagaaaattcttcgtcggtggcaactggaaatgcaatgggaccactgaggaggtgaagaagattgttatactttaaatgaagctaaagtccctggagaagatgttgtagaagttgttgtgagccctccttttgtgttccttccttttgtaaaaagtttgctgcgccctgatttccatgtctcggcccaaaattgttgggtt

SEQ ID NO: 3799 - DNA, 250 bp, Glycine max
  Clone ID: 700739461H1
agggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtc

SEQ ID NO: 3800 - DNA, 251 bp, Glycine max
  Clone ID: 700941104H1
gttgaacaagggtttctctgtctgcttcttcactttctctcgtttcaatcgaaaccataacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgctctgatttccatg

SEQ ID NO: 3801 - DNA, 245 bp, Glycine max
  Clone ID: 700732960H1
cttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcgg

SEQ ID NO: 3802 - DNA, 253 bp, Glycine max
  Clone ID: 700686476H1
gggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcgg

SEQ ID NO: 3803 - DNA, 262 bp, Glycine max
  Clone ID: 701054231H1
tgttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtacctggagaagatgtcgtagaagttgttgtgagccctccttttgtgttccttcctgttgtaaaaagtttgctgcgccctgatttccatgtttcggcaca

SEQ ID NO: 3804 - DNA, 253 bp, Glycine max
  unsure (1)...(253): unsure at all n locations
  Clone ID: 700671690H1
agggtttctctgtctgcttcttcactttctctcgtttcaatcgaaaccaaaacaaaaacatgggcagaaaattcttcgtnggtggcaactggaaatgcaatgggaccactgaggaggtaaagaagattgttactactttgaatgaggctaaagtccctggngaagatgtcgtagaagttgttgtgagccctccttttgtgttccttcctgttgtaaaaagtttgctgcgccctgatttccatgtttcgnncac

SEQ ID NO: 3805 - DNA, 249 bp, Glycine max
  Clone ID: 700941174H1
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttcca

SEQ ID NO: 3806 - DNA, 248 bp, Glycine max
  Clone ID: 701125091H1
acaacaacggctgttgttgctgagcaaacaaaagcaattgcagctaaaatatcaaattgggacaatgtcgttttggcctatgcgccagtttgggccattggaacaggaaaggttgcaactcctgctcagggctcagaggttcatgctgattaaggaaatggggtcatgacaatgtgagttctgaagttgccgcatctgtaggaataatctatggaggctctgtaaatggaggaaactgcaaagaattg

SEQ ID NO: 3807 - DNA, 255 bp, Glycine max
  unsure (1)...(255): unsure at all n locations
  Clone ID: 700989827H1
gtattgttgaacaagggtttctctgtctgcttcttcactttctctcgtttcaatcganaccaanacaaaatcatgggcagaaaattcttcgttggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccat

SEQ ID NO: 3808 - DNA, 263 bp, Glycine max
  Clone ID: 700835006H1
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaa

SEQ ID NO: 3809 - DNA, 251 bp, Glycine max
  Clone ID: 700834847H1
tgttgaacaagggtttctctgtctgcttcttcactttctcacgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctaccttttgtgttcctacctgttgtaaaaagtttgctgcgccctgatttcca

SEQ ID NO: 3810 - DNA, 255 bp, Glycine max
  Clone ID: 700953411H1
tgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcgg

SEQ ID NO: 3811 - DNA, 246 bp, Glycine max
  Clone ID: 700869222H1
tgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatt

SEQ ID NO: 3812 - DNA, 249 bp, Glycine max
  Clone ID: 700850633H1
attgttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgattt

SEQ ID NO: 3813 - DNA, 227 bp, Glycine max
  Clone ID: 700890283H1
tgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtcccgggggaagatgtcgtagaagttgttgtgagccctccttttgtgttccttcctgttgtaaaaagtttgctgcgccctgatttcca

SEQ ID NO: 3814 - DNA, 266 bp, Glycine max
  Clone ID: 700727079H1
gttgagcaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtagaaagtttgctgcgccctgatttccatgtttcggcacaaaact

SEQ ID NO: 3815 - DNA, 258 bp, Glycine max
  Clone ID: 700892544H1
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggc

SEQ ID NO: 3816 - DNA, 242 bp, Glycine max
  Clone ID: 700869230H1
tgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccct

SEQ ID NO: 3817 - DNA, 252 bp, Glycine max
  unsure (1)...(252): unsure at all n locations
  Clone ID: 700993034H1
gttgaacaagggtttcnctgtcnccttcnncactttctctccgtttcaatcgaaaccaaaacaaaatcatgggcannaaattcttcgttggtggcaantgganatgcaatgggaccactgaggaggtaaagnagattgttactactttgaatgaggctaaagtccctggagaagatgtcgtagaagttgttgtgagccctcctttngtgttccttcctgttgtaaaaagtttgctgcgccctgatttccatg

SEQ ID NO: 3818 - DNA, 266 bp, Glycine max
  Clone ID: 700975553H1
tttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctggcgccctgatttccatgtctcggcccaaaattgttggg

SEQ ID NO: 3819 - DNA, 339 bp, Glycine max
  unsure (1)...(339): unsure at all n locations
  Clone ID: 700651326H1
gttgaacaagggtttctctgtctgcttcttcactttctctcgtttcaatcgaaaccaaaacaaaaacatgggcagaaaattcttcgtcggtggcaactggaaatgcaatggggaccactgaggaggtaaagaagattgttactactttgaatgaggctaaagtccctggagaagatgtcgtagaagttgttgtgagccctccttttgtgttccttcctgttgtaaaaagtttgctgcgccctgattccatgtttcggcacaaaactgttgggttcgcaaagtggtgcttataccggaggttagtgctgaaatgctgttaattgggaatcccctngggaa

SEQ ID NO: 3820 - DNA, 272 bp, Glycine max
  Clone ID: 701215308H1
attgtattgttgaacaagggtttctctgtctgcttcttcactttctctcgtttcaatcgaaaccaggttgaggacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaa

SEQ ID NO: 3821 - DNA, 264 bp, Glycine max
  unsure (1)...(264): unsure at all n locations
  Clone ID: 700654480H1
ggtttctctttctctttctcngtctgcttcntcactttctctcgtntcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttcctttgtanaaagtttgctgcgccctgatttnccatgtctcggcccaaaattgtt

SEQ ID NO: 3822 - DNA, 190 bp, Glycine max
  Clone ID: 701045128H1
ttaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttcca

SEQ ID NO: 3823 - DNA, 249 bp, Glycine max
  Clone ID: 701060759H1
caatgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctga

SEQ ID NO: 3824 - DNA, 257 bp, Glycine max
  Clone ID: 700741652H1
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaagtttgctgcgccctgatttccatgtttcggc

SEQ ID NO: 3825 - DNA, 237 bp, Glycine max
  Clone ID: 700675469H1
ctcgagccggttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctcttgtaaaaag

SEQ ID NO: 3826 - DNA, 241 bp, Glycine max
  unsure (1)...(241): unsure at all n locations
  Clone ID: 700983693H1
ggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttcctccttttgtaaaangtttgctgcgccctgatttc

SEQ ID NO: 3827 - DNA, 272 bp, Glycine max
  Clone ID: 701156784H1
tacggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagt

SEQ ID NO: 3828 - DNA, 259 bp, Glycine max
  Clone ID: 701009957H2
agggtttctctttctctttctctgtctgcttcttcactttctctcgttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaa

SEQ ID NO: 3829 - DNA, 245 bp, Glycine max
  unsure (1)...(245): unsure at all n locations
  Clone ID: 700657787H1
gtagaactgaacaagggtttctctttctctttctctgtctgcttcttcactttctctcgtttcaatcgcaaaaaaatcatgggcagaaaattcttcgtcggtggcaactggaaatgcaatgggaccactgaggaggtgaagaagattgttactactttaaatgaagctaaagtccctggagaagatgttnaagaagttgttgtgagccctccttttgtgttccttcctttgtaaaaagtttgctg

SEQ ID NO: 3830 - DNA, 221 bp, Glycine max
  Clone ID: 700893935H1
tgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgtt

SEQ ID NO: 3831 - DNA, 266 bp, Glycine max
  Clone ID: 701144619H1
aacggctgcgagaagacgacagaagggggcagttgtattgttgaacaagggtttctctgtctgcatcttcgctttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaa

SEQ ID NO: 3832 - DNA, 260 bp, Glycine max
  Clone ID: 701148851H1
ggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgtt

SEQ ID NO: 3833 - DNA, 273 bp, Glycine max
  Clone ID: 701058218H1
gttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggt

SEQ ID NO: 3834 - DNA, 257 bp, Glycine max
  unsure (1)...(257): unsure at all n locations
  Clone ID: 700975165H1
ctctctctttctctgtctgcttcttcactttctctcgtttcaatcgaaaaaaatcatgggcagaaaattcttcgtcggtggcaactggnaatgcaatgggaccactgaggaggtgaagaagattgtnactactttaaatgaagctaaagtccctggagaagatgttgtagaagttgttgtgagccctcctttgtnctccatccttngtaaaaatttgcngcgcccgganttncatgtcngggccnaaattgttgggt

SEQ ID NO: 3835 - DNA, 272 bp, Glycine max
  Clone ID: 701100165H1
cgctgtttcgacggtcacacgcagttgtattgtagaactgaccaagggtttctctttctctttctctgtctgcttcttcactttctctcgtttcaatcgaaaaaaatcatgggcagaaaattcttcgtcggtggcaactggaaatgcaatgggaccactgatgaggtgaagaagattgttactactttaaatgaagctaaagtccctggagaagatgttgtagaagttgttgtgagccctccttttgtgttccttccttttgtaaaaagttt

SEQ ID NO: 3836 - DNA, 253 bp, Glycine max
  Clone ID: 701150241H1
tacggctgcgagaagacgacagaaggggactcgcagttgcattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgtt

SEQ ID NO: 3837 - DNA, 148 bp, Glycine max
  Clone ID: 701098308H1
aaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgt

SEQ ID NO: 3838 - DNA, 268 bp, Glycine max
  Clone ID: 701150440H1
tacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagt

SEQ ID NO: 3839 - DNA, 265 bp, Glycine max
  Clone ID: 700685125H1
acggtcacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgct

SEQ ID NO: 3840 - DNA, 274 bp, Glycine max
  Clone ID: 701061565H1
gtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgcgctgatttccatgtctcggcccaaaa

SEQ ID NO: 3841 - DNA, 255 bp, Glycine max
  unsure (1)...(255): unsure at all n locations
  Clone ID: 700991418H1
ctttctctttctctgtctgcttcttcactttctctcgtttcaatngaaaaaaatcatgggnagaaaattcttcgtgcggtggcaactggaaatgcaatgggaccanttangacgtgaanaagnttnttantactttaaatnnngntaaagtccctggagangatgttgtagnnnttgttgtgagccctcctttngtgtnccttcctnntgtaaaangtttnctgcgcncngatttccntgtctcggcccanaatt

SEQ ID NO: 3842 - DNA, 262 bp, Glycine max
  Clone ID: 701156156H1
cgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagcctccttttgtgttcttcctgttgtaaaagttgctg

SEQ ID NO: 3843 - DNA, 264 bp, Glycine max
  Clone ID: 701007231H2
gttgaacaagggtttctctgtctgcttcttcactttctctcgtttcaatcgaaaccaaaacaacaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtacaaagtttgctgcgccctgatttccatgtttcggcacaaaa

SEQ ID NO: 3844 - DNA, 254 bp, Glycine max
  Clone ID: 700829667H1
gggtttctctttctctttctctgactgcttcttcactttctctcgttgcaatcgaaaaaaatcatgggcagaaaattcttcgtcggtggcaactggaaatgcaatgggaccactgaggaggtgaagcagattgttactactttaaatgaagctaaagtccctggagaagatgttgtagacgttgttgtgagccctccttttgtgttccttccttttgtaaaaagtttgctgcgccctgatttccatgtctcgga

SEQ ID NO: 3845 - DNA, 234 bp, Glycine max
  Clone ID: 701156033H1
tacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgag

SEQ ID NO: 3846 - DNA, 193 bp, Glycine max
  Clone ID: 701014293H1
gtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgccgtagaagttgttgtgagccct

SEQ ID NO: 3847 - DNA, 240 bp, Glycine max
  Clone ID: 700945665H1
aggctgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagcctccttttgtgttccttcttttgt

SEQ ID NO: 3848 - DNA, 300 bp, Glycine max
  unsure (1)...(300): unsure at all n locations
  Clone ID: 701152138H1
acggctgcgagaagacgacagaaggggacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctanagtccctggagaagatgttgtagaagttgttgtgagcctccttttgtgttcttccttttgtaaaaattgctgcgcctgattccagtctc

SEQ ID NO: 3849 - DNA, 278 bp, Glycine max
  unsure (1)...(278): unsure at all n locations
  Clone ID: 701001407H1
ctgaacaagggtttctctttctctttctctgtctgcctcttcactttctctcgtttcaatcgaaaaaatcatgggcagaaaattcttccgtcggtggcaactggaaatgcaatgggaccactgaggaggtgaagaagattgttatactttaaatgaagctaaagtccctggagaagatgttgtagaagttgttgtgagccctccttttgtgttccttcctttgtaaaaagttngctgcgccctgatttccatgtctcggcccaaaattgttgggttcg

SEQ ID NO: 3850 - DNA, 263 bp, Glycine max
  unsure (1)...(263): unsure at all n locations
  Clone ID: 700983185H1
gttgaacaagggtttctctgtctgcttcttcactttctctcgtttcaatcgaaaccaaaacaaaaacatgggcagaaaattattcgtcggtggnaactggaaatgcnatgggacnactgaggaggtaaagaagattgttactactttgnatgaggcnaaagtccctggagangatgtcgtagaagttgttntgaggcctccttttgtgttncttcnccgttgtaaaaagtttgctgcgccctgatttccatgtttcggcacaa

SEQ ID NO: 3851 - DNA, 238 bp, Glycine max
  Clone ID: 700752364H1
aacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctg

SEQ ID NO: 3852 - DNA, 266 bp, Glycine max
  unsure (1)...(266): unsure at all n locations
  Clone ID: 700992409H1
gttgaacnagggtttctctntctgcttcttcactttctctcgttnccaatcgaaaccaaaacaaaatcatgggcagaaaattcttcgttggtggcaactggaaatgcaatgggaccactgangaggtaaagnagattgttactactttgaatgaggctaaagtccctggagaagatgtcgtagaagttgttgtgagccctcctttgtgttccttcctgttgtaaaaagtttgctgcgccctgatttccatgtttcggcananactg

SEQ ID NO: 3853 - DNA, 256 bp, Glycine max
  Clone ID: 701109396H1
gttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaagttgttgtgagcctccttttgtgttccttcctgttgtaaaaagtttgctgcgccctgatttccatgtttcgg

SEQ ID NO: 3854 - DNA, 250 bp, Glycine max
  Clone ID: 701151402H1
ctacagctggggactcgcagttgtattgttgaacaagggtttctctgtctgcttcttcactttctctcgtttcaatcgaaaccaaaacaaaaacatgggcagaaaattcttcgtctgtggcaactggaaatgcaatgggaccactgaggaggtaaagaagattgttactactttgaatgaggctaaagtccctggagaagatgtcgtagaagttgttgtgagccctcttttgtgttcctcctgttgtaaa

SEQ ID NO: 3855 - DNA, 264 bp, Glycine max
  Clone ID: 701149617H1
acggctgcgagaagacgacagaaggggactcgcagttgtattgttgaacaaggggttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtcctggaagaagatgtcgtagaagttgttgtgagccctccttttgtgttccttcctgttgt

SEQ ID NO: 3856 - DNA, 267 bp, Glycine max
  Clone ID: 700747310H1
gtagtactgatcaagggtgtctgtttctatgtctctgtgtgtttcgtcactttctctcgtttcaatcgaaaaagatcatgggtagaagattagtcgtcggtggcaactggaaatgcaatgggaccactgaggaggtgaagaagattgttactactttaaatgaggctaaagtccctggagaagatgttgttgaagttgttgtgagccgccttttgtgttcctccttttgtagaggtttgctgcgcctggatttccatgtctcggccc

SEQ ID NO: 3857 - DNA, 238 bp, Glycine max
  Clone ID: 701139569H1
gtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagcctccttttgtgttccttcctttgtaaaaagtt

SEQ ID NO: 3858 - DNA, 273 bp, Glycine max
  Clone ID: 701213275H1
gaacaagggtttctctttctctttctctgtctgcttcttcactttctctcgtttcaatcgaaaaaaatcatgggcagaaaattcttcgtcggtggcaactggaaatgcaatgggaccactgaggaggtgaagcagattgttactactttaaatgaagctacagtccctggagaagatgttgtagaagttgttgtgagccctccttttgtgttccttccttttgtaaaaagtttgctgcgccctgatttccatgtctcggcccaaaattgttgg

SEQ ID NO: 3859 - DNA, 240 bp, Glycine max
  Clone ID: 701157185H1
acggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggaagagatgtcgtagaagttgttgtgagccc

SEQ ID NO: 3860 - DNA, 252 bp, Glycine max
  unsure (1)...(252): unsure at all n locations
  Clone ID: 700655520H1
gcgcattattataaagagtgataaggttgtttggacggtcnntcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtcccggagaagatgtcgtagaagttgttgtgagccc

SEQ ID NO: 3861 - DNA, 274 bp, Glycine max
  Clone ID: 701010779H1
gtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagcccctggagaagatgttgtagaagttgttgtgagccctccttttgtgttccttccttttgtaaaaagtttgctgcgcgctgatttccatgtctcggcccaaaa

SEQ ID NO: 3862 - DNA, 185 bp, Glycine max
  Clone ID: 701044104H1
gttgaacaagggtttctctgtctgcttcttcactttctctcgtttcaatcgaaaccaaaacaaaatcatgggcagaaaattcttcgttggtggcaactggaaatgcaatgggaccactgaggaggtaaagaagattgttactactttgaatgaggctaaagtccctggagaagatgtcgtagaag

SEQ ID NO: 3863 - DNA, 215 bp, Glycine max
  Clone ID: 700867605H1
gcttcttcactttctctcgtttcaatcgaaaaaaatcatgggcagaaaattcttcgtcggtggcaactggaaatgcaatgggaccactgaggaggtgaagaagattgttactactttaaatgaagcgtaagtcgctggaggagaatgtgtagaagtggttgtgagcctcctttttgtgtccttccttttttaaaaaatttgctggggcctgattt

SEQ ID NO: 3864 - DNA, 190 bp, Glycine max
  Clone ID: 701125521H1
cactgaacaagggtttctctttctctttctctgtctgcttcttcactttctctcgcactcaatcgagcatcatcatgggcagaaaattcttcgtcggtggcaactggaaatgcaatgggaccactgaggacgtgaagaagatctgttactactttaaatgaagctaaagtccctggagaacgagttgtag

SEQ ID NO: 3865 - DNA, 266 bp, Glycine max
  Clone ID: 701058593H1
gaggaaactgcaaagaattggcagcacagcccgatgttgatggatttttggttggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctttgatctcatccatagg

SEQ ID NO: 3866 - DNA, 248 bp, Glycine max
  Clone ID: 701070286H1
cgaaactgcaaagaattggcagcacagcccgatgttgatggatttttggttggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctt

SEQ ID NO: 3867 - DNA, 161 bp, Glycine max
  unsure (1)...(161): unsure at all n locations
  Clone ID: 700649007H1
agggttctctttctctttctctntctgcttcttcactttctctcgtttcaatcganaaaaatcatgngcagaaaattcttcgtcggtggcaactggaaatgcaatgggaccactgaggaggtgaagaagattgttactactttaaatgaagctaaagtccc

SEQ ID NO: 3868 - DNA, 225 bp, Glycine max
  Clone ID: 700876790H1
aaagaattggcagcacagcccgatgttgatggatttttggttggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaata

SEQ ID NO: 3869 - DNA, 254 bp, Glycine max
  Clone ID: 700877219H1
aaagaattggcagcacagcccgatgttgatggatttttggttggtggtgcatccctcaaggcggaatttgtggacatcataaacgctgctactgtgaagaagaattgaaattcgtagttaggaactgatatgctgcctttcaagctgcttcggaaattgctgtttttgagttttggttctgtgctttgtggccaatgtattgaactctgtttagtacctgaataaacatgctttcctttgatctcatccatagg

SEQ ID NO: 3870 - DNA, 258 bp, Glycine max
  Clone ID: 700877212H1
aaagaattggcagcacagcccgatgttgatggatttttggttggtggtgcatcactcaaggcggaatttgtggacatcataaacgctgctactgtgaagaagaattgaaattcgtagttaggaactgataatctgcctttcaagctgcttcggaaattgctgtttttgagttttggttctgtgctttgtggccaatgtattgaactctgtttagtacctgaataaacatgctttcctttgatctcatccataggcgat

SEQ ID NO: 3871 - DNA, 145 bp, Glycine max
  Clone ID: 700760847H1
gaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgt

SEQ ID NO: 3872 - DNA, 180 bp, Glycine max
  Clone ID: 700893711H1
agaaaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtaga

SEQ ID NO: 3873 - DNA, 98 bp, Glycine max
  Clone ID: 700557532H1
ttgttttggcctacgagccagtttgggccattggaacaggaaaggttgctactcctgctcaggctcaagagggtccatgctgatttgaggaaatgggt

SEQ ID NO: 3874 - DNA, 147 bp, Glycine max
  Clone ID: 700793802H1
gctcgaggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactt

SEQ ID NO: 3875 - DNA, 265 bp, Glycine max
  unsure (1)...(265): unsure at all n locations
  Clone ID: 700659725H1
gtttctctntctctntctctgtctgcttcttcactttctctcgtttcantcganaaaaatcatgggcagaaaattctcgtcggtggcaactggaaatgcaatgggaccactgaggaggtgaagaagattgtngnnacttaaattgaagccnaaatccccttggggaaatgttgtagannttgttgtgagccctccttttgtgttccttcctntgtaaaaagtttgctgcgccctgattnccagtctcgggcccanaatggtggng

SEQ ID NO: 3876 - DNA, 162 bp, Glycine max
  Clone ID: 701044545H1
aactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagc

SEQ ID NO: 3877 - DNA, 150 bp, Glycine max
  Clone ID: 701037485H1
cgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactacttt

SEQ ID NO: 3878 - DNA, 263 bp, Glycine max
  Clone ID: 700683524H1
caaagataattcttacagatgcagcacagcccgatgttgatggatttttggttggtggtgcatccctcaaggcggaatttgtggacatcataaacgctgatactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctttgatctcatccat

SEQ ID NO: 3879 - DNA, 247 bp, Glycine max
  Clone ID: 700876711H1
aaagaattggaagcacagcccgatgttgatggatttttggctggtggtgcatccctcaaggcggaatttgtggacatcataaacgctgctactgtgaagaagaattgaaattcgtagttaggaactgataatgctgcctttcaagctgcttcggaaattgctgtttttgagttttggttctgtgctttgtggccaatgtattgaactctgtttagtacctgaataaacatgctttcctttgatctca

SEQ ID NO: 3880 - DNA, 195 bp, Glycine max
  Clone ID: 701155437H1
tacggctgcgagaagacgacagaaggggacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttact

SEQ ID NO: 3881 - DNA, 271 bp, Glycine max
  unsure (1)...(271): unsure at all n locations
  Clone ID: 700997892H1
cttattggaganaatgatgagtttatagggaaganagctgcctatgctttgagccaaggtcttggggtgattgcatgcattggagacttgttagaagaaagggaggctggaaaaactactgatgtttgtnttcagcaattgaaggcttatgcagacgcagttgctagttgggacaacattgttattgcatatgaacctgtatgggccattggaacgggcaaagtcgccactccccaacaagctcaggaagtacatgtagctgttcgggatt

SEQ ID NO: 3882 - DNA, 322 bp, Glycine max
  Clone ID: 701053174H1
cttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgcaaaattggagcctgatgttgatgttgtcgttgcacctcccttcctctacatcgatcaagtgaa

SEQ ID NO: 3883 - DNA, 249 bp, Glycine max
  Clone ID: 700754467H1
gcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgca

SEQ ID NO: 3884 - DNA, 257 bp, Glycine max
  Clone ID: 701107430H1
ggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgcaaaattgg

SEQ ID NO: 3885 - DNA, 275 bp, Glycine max
  Clone ID: 700985855H1
gtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacgggaacaaaagactcaatcagcaagcttgttgctgacttgaacaatgcaaaatt

SEQ ID NO: 3886 - DNA, 287 bp, Glycine max
  Clone ID: 701038167H1
ctgtgttcctgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgacttgaacaatgcaaaattgga

SEQ ID NO: 3887 - DNA, 272 bp, Glycine max
  unsure (1)...(272): unsure at all n locations
  Clone ID: 700670393H1
gatggcggcaacctcaacatcactgggcttctcaactctacattggcctggcgccgcccctgcctcaagctcgattctttcaattctcaatctttctctctcttcgaccctaatcttcgccnatccctctctccacccaaaccctcacnacaccgtcatcgccatggccggcaccgggaagttctttgttggtggcaactggaagtgtaacggaacaaaagactcaatcagcaancttgttgctgacttgaacaatgcaaaattggagcctg

SEQ ID NO: 3888 - DNA, 287 bp, Glycine max
  unsure (1)...(287): unsure at all n locations
  Clone ID: 700559280H1
ctgtgttcctgtttttgttcttcgatggcggcaacctcaacatcactggcttctcaactctacattggcctgcgccgcccctgcctcaagctcgattctttcaattctcaatctttcnctctcttcgaccctaatcttcgcctatccctctctccacccaaaccctcacgcgccgtcatcgccatggccggcaccgggaagttctttgttggtggcaactggaagtgtaacgnaacaaaagactcaatcagcaagcttgttgctgacttgaacaatgcaaaattgga

SEQ ID NO: 3889 - DNA, 274 bp, Glycine max
  Clone ID: 700793048H1
tgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaagactcaatcagcaagcttgttgctgcttgacatgcaaatggag

SEQ ID NO: 3890 - DNA, 247 bp, Glycine max
  unsure (1)...(247): unsure at all n locations
  Clone ID: 700993683H1
ctgtgttcctgtttttnttcttcgatggcggcaacctcaacatcactggantctcaactctacattggcctgcgccgcccctgtctcaagctcgattctttcaattctcaatctttctctctcttcgaccctaatcttcgcctatccctctctccacccaaaccctcacgcgccgtcatcgccatggccggcaccgggaagttctttgttggtggcaatggaagtgtaacgcaacaaaagactcaat

SEQ ID NO: 3891 - DNA, 241 bp, Glycine max
  Clone ID: 700663233H1
gttcctgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaaggaacaaaagactca

SEQ ID NO: 3892 - DNA, 253 bp, Glycine max
  Clone ID: 700908079H1
cactgtgttgctgtttttgttcttcgatggcggcaacctcaacatcactggcttctcaactctacattggcctgcgccgcccctgcctcaagctcgattctttcaattctcaatctttctctctgttcgaccctaatcttcgcctatccctctctccacccaaaccctcacgcgccgtcatcgccatggccggcaccgggaagttctttgttggtggcaactggaagtgtaacgaaacaaaagactcaatcag

SEQ ID NO: 3893 - DNA, 240 bp, Glycine max
  Clone ID: 701043447H1
ctcgagcgttttgttcttcgatggcggcaacctcaacatcactggcttctcaactctacattggcctgcgccgcccctgcctcaagctcgattctttcaattctcaatctttctctctcttcgaccctaacttcgcctatccctctctccacccaaaccctcacgcgccgtcatcgccatggccggcaccgggaagttctttgttggtggcaactggaagtgtaaggaacaaaagactca

SEQ ID NO: 3894 - DNA, 240 bp, Glycine max
  Clone ID: 700740188H1
gtgttcctgtttttgttcttcgatggcggcaacctcaacatcactggcttctcaactctacattggcctgcgccgcccctgcctcaagctcgattctttcaattctcaatctttctctctcttcgaccctaatcttcgcctatccctctctccacccaaaccctcacgcgccgtcatcgccatggccggcaccgggaagttctttgttggtggcaactggaagtgtaacggaacaaaaga

SEQ ID NO: 3895 - DNA, 198 bp, Glycine max
  Clone ID: 700742922H1
ctgacttgaacagtgcaacattggagtctgatgttgatgttgttgttgcacctccctttgtgtacatcgatcaggtgaaaaactcaattacagataggattgaaatttctgcccagaattcttgggtgggaaaaggtggggctttcacgggagaaatcagtgtggagcaactaaaagaccttggctgcaagtgggtta

SEQ ID NO: 3896 - DNA, 282 bp, Glycine max
  Clone ID: 700606255H1
ctcaattacagataggattcagattttcacctgatcgatgtacacaaagggaggtgcaacaacaacatcaacatcagactccactgttgcacctccctttgtgtacatcgatcaggtgaaaaactcaattacagataggattgaacttctgcccagaattcttgggtgggaaaaggtggggctttcacgggagaaatcagattggagcaactaaaagaccttggctgcaagtgggctattcttggacattctgagcgcagacatgtaattggagcaaatgat

SEQ ID NO: 3897 - DNA, 377 bp, Glycine max
  Clone ID: LIB3053-005-Q1-N1-F9
ctttctctttctctgtctgcttcttcactttctctcgttggaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagcttttgaatgaatcaaatg

SEQ ID NO: 3898 - DNA, 426 bp, Glycine max
  Clone ID: LIB3039-035-Q1-E1-C5
ccgggccgacccaaacgtcagtacggctgcgagaagacaacagaagggggaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctgaacggaggcagctttt

SEQ ID NO: 3899 - DNA, 405 bp, Glycine max
  unsure (1)...(405): unsure at all n locations
  Clone ID: LIB3039-031-Q1-E1-A8
agtacggctgcgagaagacgacagaagggtgaatcaaacgagtttgtgggagataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgttgttttggcctacgagccagtttgggccattggaacaggaaaggttgctactcctgctcaggctcaagaggtccatgctgatttgaggaaatgggttcatgacaatgtgagtgccgaagttgctgcatctgtaagaattatctatggaggttctgtaaatggaaganactgcaaaaaattggccgcacagcccgatgttgatgga

SEQ ID NO: 3900 - DNA, 387 bp, Glycine max
  Clone ID: LIB3030-003-Q1-B1-C9
gtcacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaggttagtgctgaaatgcttgttaatttgggaattccttgggttattattggtcactctg

SEQ ID NO: 3901 - DNA, 419 bp, Glycine max
  Clone ID: LIB3039-023-Q1-E1-H12
ggtcgacgacgcgtccatacggcagcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaattccttgggttattattggtcactctg

SEQ ID NO: 3902 - DNA, 400 bp, Glycine max
  Clone ID: LIB3039-047-Q1-E1-D8
agacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaattttgggattcccttggggtataatggtcactctga

SEQ ID NO: 3903 - DNA, 367 bp, Glycine max
  Clone ID: LIB3039-052-Q1-E1-D6
ccggctcgacccacgagtaagcccacgcgtccgacggctgcgagaagacgacagaaggggattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatac

SEQ ID NO: 3904 - DNA, 371 bp, Glycine max
  Clone ID: LIB3039-051-Q1-E1-A1
agacggctgcgagaagacgacagaagggggcagttgtattgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttggga

SEQ ID NO: 3905 - DNA, 387 bp, Glycine max
  Clone ID: LIB3049-009-Q1-E1-G5
acgcccacgcgtccgtacggctgcgagaagacgacagaaggggattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctcggcccaaaattgttgggttcgcaaaggtggtgcttatactggagaagttagtgctgaaatgcttgttaatttggga

SEQ ID NO: 3906 - DNA, 384 bp, Glycine max
  unsure (1)...(384): unsure at all n locations
  Clone ID: LIB3039-009-Q1-E1-C1
gggccgagccacgcgtccatacggatgcgagaagacgacagaagggggtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtanaagttgttgtgagccctccttttgtgttccttccttttgtaaaaagtttgctgcgccctgatttccatgtctcggcccaaaattgttgggttcgcaaaggtggtgcttatactggagaagttagtgctgaaatgcttgtt

SEQ ID NO: 3907 - DNA, 265 bp, Glycine max
  Clone ID: LIB3055-006-Q1-N1-H3
gataaagttgcctatgcacttcaacaaggtctaaaagttattgcatgcattggggagactctcgaacagcgtgaagctggtacaacaacggctgttgtttctgagcaaacaaaagcaattgcagctaaaatatcaaattgggacaatgtcgttttggcctacgagccagtttgggccattggaacaggaaaggttgctactcctgctcaggctcaagaggtccatgctgatttgaggaaatgggttcatgacaatgtgagtgctg

SEQ ID NO: 3908 - DNA, 421 bp, Glycine max
  Clone ID: LIB3055-013-Q1-N1-C3
gttcgcaaaggtggtgcttatactggagaggttagtgctggaatgcttgttaattggggaattccttgggttattattggtcactctgaacggaggcagcttttgaatgaatcaaatgagtttgtgggagataaagttgcctatgcacttcaacaaggtctgaaagttatagcatgcattggggaaactcttgaacagcgtgaagctggtacaacaacggctgttgttgctgagcaaacaaaagcaattgcagctaaaatatcaaattgggacaatgtcgttttggcctatgagccagtttgggccattggaacaggaaaggttgcaactcctgctcatgctcaagaggttcatgctgatttaaggaaatgggttcatgacaatgtgagtgctgaagttgctgcatctgtaagaattatct

SEQ ID NO: 3909 - DNA, 325 bp, Glycine max
  unsure (1)...(325): unsure at all n locations
  Clone ID: LIB3049-034-Q1-E1-A2
acgaccacgcgtccgtacggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactgangaggtaaagaagattgttactactttgaatgaggctaaagtccctggagaagatgtcgtagaagttgttgtgagccctccttttgtgttccttcctgtcgtaaaaagtttgctgcgccctgatttccatgtttcggcacaaaactg

SEQ ID NO: 3910 - DNA, 393 bp, Glycine max
  unsure (1)...(393): unsure at all n locations
  Clone ID: LIB3049-022-Q1-E1-F9
aaaagacgacagaaagggaatcccaatttgaatggttaacaaagggttccccggccggctcctcaacttccccccgttccaaccaaacccaaaccaaaatcatgggcaaaaaatcctccgccggtggcaactggaaatgcaatgggaccactgaagaggtaaagaaaattgttactactttgaatgacgctaaagtccctggagaagatgtcgtagaagttgttgtgagccctccttttgtgttccttcctgttgtanaaagtttgctgcgccctgattcccatgtttcggcacaaaactgttgggttcgcaaaagtggtgcttataccggtgaggttagtgctgaaatgcttgttaatttgggaattccttgggttattattggtcactctg

SEQ ID NO: 3911 - DNA, 300 bp, Glycine max
  Clone ID: LIB3049-030-Q1-E1-C7
tacggctgcgagaagacgacagaaggggactcgcagttgtattgttgaacaagggtttctctgtctgcttcttcactttctctcgtttcaatcgaaaccaaaacaaaaacatgggcagaaaattcttcgtcggtggcaactggaaatgcaatgggaccactggggaggtaaagaagattgttactactttgaatgaggctaaagtccctggagaagatgtcgtacaagttgttgtgagccctccttttgtgttccttcctgttgtaaaaagtttgctgcgccctgatttccatgtttcgg

SEQ ID NO: 3912 - DNA, 234 bp, Glycine max
  Clone ID: LIB3040-035-Q1-E1-C5
agtacggctgcgagaagacgacagaaggggattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtacaagttgttg

SEQ ID NO: 3913 - DNA, 342 bp, Glycine max
  Clone ID: LIB3040-005-Q1-E1-H8
cccacgcgtccgtacggctgcgagaagacgacagaaggggggtcacacgcagttgtattgtagaactgaacaagggtttctctttctctttctctgtctgcttcttcactttctctcgtttcaatcgaaaaaaatcatgggcagaaaattcttcgtcggtggcaactggaaatgcaatgggaccactgaggaggtgaagaagattgttactactttaaatgaagctaaagtccctggagaagatgttgtagaagttgttgtgagccctccttttgtgttccttccttttgtaaaaagtttgctgcgccctgatttccatgtctccggccaaaattgttgggt

SEQ ID NO: 3914 - DNA, 354 bp, Glycine max
  Clone ID: LIB3028-025-Q1-B1-D1
ctcgagccgaatcggctcgagtgttgaacaagggtttctctgtctgcttcttcactttctctcgtttcaatcgaaaccaaaacaaaaacatgggcagaaaattcttcgtcggtggcaactggaaatgcaatgggaccactgaggaggtaaagaagattgttactactttgaatgaggctaaagtccctggagaagatgtcgtagaagttgttgtgagccctccttttgtgttccttcctgttgtaaaaagtttgctgcgccctgatttccatgtttcggcacaaaactgttgggttcgcaaaggtggtgcttataccggtgaggttagtgctgaaatgcttgttaatttgggaa

SEQ ID NO: 3915 - DNA, 291 bp, Glycine max
  Clone ID: LIB3039-022-Q1-E1-D5
cccaggcgtccgtacggctgcgagaggacgacagaagggggcagttgtattgttgaacaagggtttcgctgtctgcttcttcactttctctcgtttcaatcgaaacgaaaacaaaaacatgggcagaaaattcttcgtcggtggcaactggaaatgcaatgggaccactgaggaggtaaagaagattgttacgactttgaatgaggcgaaagtccctggagaagatatcgtacaagttgttgtgagccctccttttgtgttccttcctgtgggtaaaagtttgctgcgccc

SEQ ID NO: 3916 - DNA, 312 bp, Glycine max
  Clone ID: LIB3052-001-Q1-B1-C5
tgaacaagggtttctctttctctttctctgtctgcttcttcactttctctcgtttcaatcgagggaaatcatgggcagaaaattcttcgtcggtggcaactggaaatgcaatgggaccactgatgaggtgaagaagattgttactactttaaatgaagctaaagtccctggagaagatgttgtagaagttgttgtgagcactccttttgtgttccttccgtttgtaaaaagtttgctgcgccctgatttccatgtctcggcccaaaattgttgggtacgcataggtgatgcttagactggagaagttagtgc

SEQ ID NO: 3917 - DNA, 395 bp, Glycine max
  Clone ID: LIB3039-047-Q1-E1-D9
agtacggctgcgagaagacgacagaaggggatgagtttatagggaagaaagctgcctatgctttgagccaaggtcttggggtgattgcatgcattggagaattgttagaagaaagggaggctggaaaaacttttgatgtttgttttcagcaattgaaggcttatgcagacgcagttgctagttgggacaacattgttattgcatatgaacctgtatgggccattggaacgggcaaagtggccactccccaacaagctcaggaagtacatgtagctgttcgggattggctaaaaaagaatgtctcagatgaagttgcgtctaaaacacgaattatttatggagggtctgtaaatggaggcaacagtgctgaactggcaaagcaagaagatattgat

SEQ ID NO: 3918 - DNA, 403 bp, Glycine max
  Clone ID: LIB3039-048-Q1-E1-D12
agtacggctgcgagaagacgacagaaggggatgagtttatagggaagaaagctgcctatgctttgagccaaggtcttggggtgattgcatgcattggagaattgttagaagaaagggaggctggaaaaacttttgatgtttgttttcagcaattgaaggcttatgcagacgcagttgctagttgggacaacattgttattgcatatgaacctgtatgggccattggaacgggcaaagtggccactccccaacaagctcaggaagtacatgtagctgttcgggattggctaaaaaagaatgtctcagatgaagttgcgtctaaaacacgaattatttatggagggtctgtaaatggaagcaacagtgctgaactggcaaagcaagaagatattgatggatttct

SEQ ID NO: 3919 - DNA, 298 bp, Zea mays
  Clone ID: 700026544H1
ccattcctccccaaaacacatcctgcgatcctcgaagcctccgccgagcatcgatcatgtcggcctactgcggcaagtacgcgggtacgttccatcgtctcctccttcgttgctgatctgcttgtgatgtcgtttggcctcgtgtgtcgtagatctacgatctactagttgttcgttgttgatgccctcagatctacctgcgtttgacgagtatgttaacgattcgtctagctctgagagacccaagggatttgcggatccttttttagatccgtacaggctcttgcggtcgtgccta

SEQ ID NO: 3920 - DNA, 288 bp, Zea mays
  Clone ID: 700073329H1
cgctcagatctcgctgtgattgatgggtatgctaaggctaacggctatatggacgggagaacactctttgtagactgtactgtccacagatcggagtttgaaatggaatgtgtggacagaaatctggtggcctagcctaacgattcgtataggtctgagagactcgttcagttgtaggatttgtggattttttttagatccgtacaggattgtgctgtcgtgtgcccgccaagtgcttggtggttgccaaaaggtgatgcctctgatcggtttggatatgggatttgc

SEQ ID NO: 3921 - DNA, 61 bp, Zea mays
  Clone ID: 700151987H1
ctcccagcaccacctcgccgcgatctccgtagcgtccgtcgcgtcgagcatcgatcatgtc

SEQ ID NO: 3922 - DNA, 325 bp, Zea mays
  Clone ID: 700206575H1
agtcagatatgtaaatcgtttaaagctttgtgctagtctaatcttgatctgtggttccttttagtcatgatgtttatgccgatacaattatatataaagcagtttttggttaataaacagtaaacttcctgaattaataattaaagtttattttgtattattcaggatggcctcctgatttgataatggaagtcattttgtattattcagtatagccttggtacctggtagatagccatgcttattatgcatattgttttgcagatgagctcatcaagaatgctgcctacattggcacccccggcaagggtatccttgctgctga

SEQ ID NO: 3923 - DNA, 297 bp, Zea mays
  Clone ID: 700333727H1
tgcaccacaggaaagcgctgccaccggcaccatgccccacccatacccagcactgaccccggaccatataaaggagcttgctgacatcgctcaccgcattgtagctccgggcaagggcatcctggctgcagacgagtccactggaagcactgccaagcgcctgcagtccattggcagcgagaacaccgaggagaacaggcgcttctaccgccaactgctgctgactgccgatgaccgtgtgaatccctgcattggaagggtgatccttttccacgagacactataccagaaggcaga

SEQ ID NO: 3924 - DNA, 196 bp, Zea mays
  Clone ID: 700335938H1
cgaccggcagagcacttcgtcgaacagtgcgccctgccgtccctggggtcactttgcctgtctggagggcagattgaggaagaggcatccatcaacctcaatgctatcaacaagtgtcccctgcggaagccatggtccttgactttctcctatggccgagccctgcaggcctctgctctaaaggcttggggtggga

SEQ ID NO: 3925 - DNA, 167 bp, Zea mays
  Clone ID: 700429795H1
tgtctatctggaaggcacactgctgaagctcatcattgtcacccctggccatgcttgcacccagaaattttccaatgaggaaattgccatggctatatacacagcacttcgtcgaacagtgccccctgccgtccctggggtcactttcctgtctggagggcagagtg

SEQ ID NO: 3926 - DNA, 208 bp, Zea mays
  Clone ID: 700453040H1
gtcgagaacgtggcggagaaccggcgggctctccgtgagctcctcgtctgctgccctggtgcccttcagtacatcagcggtgtgatcctcttcgaggagaccctcttacagaagaccaagggtggcaaacctctttggcgaagtcccccaagaaggaagcgtccttcctgggatcaaagtcgacaaagggaccatttaaggtgtttgg

SEQ ID NO: 3927 - DNA, 257 bp, Zea mays
  Clone ID: 700804137H1
ctcgagccgaatcggctcgaggtattagttagataaccgtgctagtgcttattgattgtcaagtcccactgttcttgctctaaatctgtgtctgttgttttgcagatgagctcatcaagaatgctgcctacatcggcacccctggcaagggtatccttgctgctgatgagtcaactggcaccagtggcaagcgcctttccagcatcaatgtcgagtacgtggaggagaaccggcgggctctccgtgagctcctgttc

SEQ ID NO: 3928 - DNA, 273 bp, Zea mays
  Clone ID: 700449930H1
ggttgacaagggtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatggtttagtgccaattgtggagccagagattcttcttgatggagaccatgggatcga

SEQ ID NO: 3929 - DNA, 255 bp, Zea mays
  Clone ID: 701185559H1
ggttgacaagggtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatggtttagtgccaattgtggagccagagattcttcttga

SEQ ID NO: 3930 - DNA, 320 bp, Zea mays
  Clone ID: 700203130H1
agtttggttccattgcctggatccaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctcaggataatagtttagtgccaattgtggagccagagattcttcttgatggagaccatgggatcgacggagctcttgaggtggcagagaaagtgtggtctgaggtgtttttctacttagccga

SEQ ID NO: 3931 - DNA, 284 bp, Zea mays
  Clone ID: 700083459H1
cctttatcaatcaactacagacggcaagaagtttgttgactgcttgaaggatcagaatatcatgcctggcatcaaggttgacaagggtttggttccattgcctggactcaacaatgaatcatggtgccaaggtcttgatggtttggcttcaaggtgtgctgagtactataagcagggggcgcgcttcgcaaagtggaggactgttgttagcatcccttgtggtccatctgcattagcagtcaaggaagcagcatggggacttgctcgatatgctgctattgctc

SEQ ID NO: 3932 - DNA, 285 bp, Zea mays
  Clone ID: 700465449H1
ggagaccctttatcaatcaactacaacggcaagaagtttgatgactgcttgaaggatcagaatatcatgcctggcatcaaggttgacaagggtttagttccattgcctggatccaacaatgaatcatggtgccaaggtcttgatggtttttattcaaggtgtgctgagtactataagcagggggcgcgcttcgcaaagtggaggactgttgttagcatcccttgtggtccatctgcattagcagtcaaggaagcagcatggggacttgctcgattgctgctattg

SEQ ID NO: 3933 - DNA, 267 bp, Zea mays
  Clone ID: 701165344H1
tttggcttcaaggtgtgctgagtactataagcagggggcccgcttcgcaaagtggaggactgttgttagcatcccttggggtccatctgcattagctgtgaaggaagcagcatggggacttgctcgatatgctgctatcgctcaggataatgtcttagtgccaattgtggagccagagatccttcttgatggagaccatgggatcgaaaggactctcgagtggcagagaagtgtggctgaggtgtcttctactgcccagacaatgtc

SEQ ID NO: 3934 - DNA, 287 bp, Zea mays
  Clone ID: 700101296H1
aagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctac

SEQ ID NO: 3935 - DNA, 269 bp, Zea mays
  unsure (1)...(269): unsure at all n locations
  Clone ID: 700101839H1
ccacgcgtccgcgacggtgcnatgacgcgtggaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgc

SEQ ID NO: 3936 - DNA, 258 bp, Zea mays
  Clone ID: 700044840H1
ggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgccc

SEQ ID NO: 3937 - DNA, 260 bp, Zea mays
  Clone ID: 700045985H1
aagaagacgagtgtcaagtgaacctgaaacttgcggtgtcactggctggtacagctgagtgtgagtgagtgatcgagctagctgagctccgatcctcgctagctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgccca

SEQ ID NO: 3938 - DNA, 318 bp, Zea mays
  Clone ID: 700101549H1
agaagaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccagggcgcccaccgtcttcatggacagtcgcgccttcgcctacgccgatgagctcgtgaagacc

SEQ ID NO: 3939 - DNA, 304 bp, Zea mays
  Clone ID: 700100334H1
gacgagtgtcaagtgaacctgaaacttgcggtgtcagtggctggtagcctgagtgtgagtgagtgatggagctagctgagctccgatcctcgctaggtaggataccgccataccacaagtcttgttcacaagtttaggagtgacagcaacaagagatcggtggcctctgccaccgtgctcgagtcctccttccttcccaagaagtccgaatggggcgccaccaggcaggccgccgcgcccaggccgcccaccgtgtccatggtcgtccgcggctccgcctacgccgatgagctcgtgaagaccg

SEQ ID NO: 3940 - DNA, 272 bp, Zea mays
  Clone ID: 700100704H1
cccacgcgtccggaagacgagtgtcaagtgaacctgaaacttgcggtgtcactggctggtatagcctgagtgtgagtgagtgatcgagctagctgagctccgatcctcgctagctagctaggataccgccataccacaagtcttcttcacaagtctaggagtgacagcaacaagagatctcgatggcctctgccaccgtgctcaagtcctccttccttcccaagaagtccgaatggggcgccaccaggcaggccgccgcgcccaggccgccc

SEQ ID NO: 3941 - DNA, 269 bp, Zea mays
  Clone ID: 700041744H1
atccacttctgaaagggtcaccatgtctgcctttgtggggaagtacacagatgagctgatcaagaccgccaagtgcctcgcaacgccgggcaagggcatcctggcctccgacgagtcgacgggcaccatcggcaagcgcctgtccagcatcaacctcgagaacgtggagtcgaaccggcaggcgctccgcgagctgctcttcacggcgcccggcgtgttcgactacctctccggggtcatcctcttcgaggagacgctgtaccagaaga

SEQ ID NO: 3942 - DNA, 277 bp, Zea mays
  Clone ID: 700224356H1
gttgttttgcagatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagccttttgtcgatgtcctcaaggagggaggcgt

SEQ ID NO: 3943 - DNA, 203 bp, Zea mays
  Clone ID: 700048169H1
ggatgatggttatctttatatttgtatgttaattagtctctttgctgttaaatttcgtgtaagttggtcctgccgatggagaatcgagcagctccctttttttgttctatcaactatgctgtaattctggctatgtatcggcaaaaacaattctatatgctgagttggagtcggcaaaaattcatatatgctgagttggagac

SEQ ID NO: 3944 - DNA, 158 bp, Zea mays
  Clone ID: 700616610H1
ccacctcgccgcgatctccgtagcctccgtcgcgtcgagcatcgatcatgtcggcctactgcggaaagtacaaggatgagctcatcaaggattgctgcctacattggcacccctggcaagggtatccttgctgctgatgagtccactggcaccattgg

SEQ ID NO: 3945 - DNA, 93 bp, Zea mays
  Clone ID: 700355765H1
cgaccttggcaagcgttgcgccaagtactacgaggcaggtgcccgctttgccaagtggcgcgctgttctcaagattggccctaatgagccatc

SEQ ID NO: 3946 - DNA, 287 bp, Zea mays
  Clone ID: 700342330H1
gtgtgtgtcaaagagagaaccagcacacagcagagtagcacctgatcgatcgatctcctactactagctcgttcgctttcacaaccagggagcagcaatggcatctgctgctactactctcctcaagtcgtcattcctccccaagaaggctgaatggggatccaagcaccagctggttgccgctcatcccaggccggcgaccgtcgtcgtctccatggttgcccgcgctaggcctacgctgacgagcttgtccagaccgcgaaaaccatcgcgtcgccgggacaggg

SEQ ID NO: 3947 - DNA, 267 bp, Zea mays
  Clone ID: 700223989H1
gtgtcaaagagagaaccagcacacagcagagtagcacctgatcgatcgatctcctactactagctcgttcgctttcacaaccagggagcagcaatggcatctgctgctactactctcctcaagtcgtcattcctccccaagaaggctgaatggggatccaagccccagctggttgccgctcatcccaggccggcgaccgtcgtcgtctccatggttgcccgcgctacgcctacgctgacgagcttgtccagaccgcgaaaaccatcg

SEQ ID NO: 3948 - DNA, 257 bp, Zea mays
  Clone ID: 700194431H1
gaacaatccagtgtgcctatcagtgtccactatgaccacggcatttccaagtcagacttgcttcaagctcttgaagcgggatttgattcagtcatggtggatggttctcatctaactttaggggataacatcttatacacaaagagcatatcttccttggctcatgcaaaaggtttacttgtggaagctgagttgggtaggctctcaggctctgaagatggcatgaccgttgaagaatatgaagcaagatttactga

SEQ ID NO: 3949 - DNA, 268 bp, Zea mays
  Clone ID: 700469777H1
ctaaagcaaggtggagtcccactggtagcatgttgcattgctgctgcagaacaatccagtgtgcctatcagtgtccactatgaccacggcatttccaagtcagacttgcttcaagctcttgaagcgggatttgattcagtcatggtggatggttctcatctaactttaggggataacatcttatacacaaagagcgtatcttccttggctcatgcaaaaggtttacttgtggaagctgagttgggtaggctctcaggctctgaagatg

SEQ ID NO: 3950 - DNA, 274 bp, Zea mays
  Clone ID: 700426129H1
tcgctgtccttctccttcggccgcgcgctgcagcagagcaccctcaagacgtgggtcggcaagacggagaacgtcgccgccgcgcaagccaccagcgtcgtccgctgcaaggccaactccgaggccgcgctgggcaagtacgccggctccggcgccggggacgccgccgcctccgagagcctgtacgtcaaggggtacaagtactaaagccgccactgctgactgtgccgacccaatccttgtgtcccacgtcgcagcgctcggactgtgccga

SEQ ID NO: 3951 - DNA, 136 bp, Zea mays
  Clone ID: 700425929H1
cgctgtccttctccttcggccgcgcgctgcagcagagcaccctcaagaagtgggtcggcaagaaggagaacgtcgccgccgcgcatgccaccttcgtcatccgctgcaaggccaactccgaggccgcgctgggcaa

SEQ ID NO: 3952 - DNA, 207 bp, Zea mays
  unsure (1)...(207): unsure at all n locations
  Clone ID: LIB3060-046-Q1-K1-G7
ggtggacaagggccttgtcccgctcgccggctccaacaacgagtcgtggtgccaggggctggacggcctggcgtcccgcgaggccgnctactaccaacaaggcgcgccggtccgccaagtgccccaccgtggcaagaatccttaacggcccttccaagttcgccgtcaaggaggccccttggggcttggaacgttaggccgcctttt

SEQ ID NO: 3953 - DNA, 126 bp, Zea mays
  Clone ID: LIB3060-022-Q1-K1-C10
ctagctagctaggataccgccataccacaagtcttcttcacaagtttaggagtgacagcaacaggagatcttgatggcctctgtcagcgtgctcaagtcctccttccttcccaagaagtccgaatg

SEQ ID NO: 3954 - DNA, 301 bp, Zea mays
  Clone ID: LIB3060-046-Q1-K1-B12
aacttcccttcatactctccatcttcccctccccagctctaatcaagcctacgacagaatcaacatgggtgtcattgagaagctcagccgcaaggccggtgtcatcgtcggtgacgatgtcctccgcctcttcgagtacgctcaggagaagcagttcgccattcccgccattaacgtcacctcttcctccaccgtcgtggctgccctcgaggccgctcgcgaccaaaagtcccccattgccctccaggtctcccagggtggtgccgctttcttcgccggtaaaggtgtcagcaacgatggc

SEQ ID NO: 3955 - DNA, 482 bp, Zea mays
  unsure (1)...(482): unsure at all n locations
  Clone ID: LIB3079-006-Q1-K1-H8
gtggggnnnnccgaccccacctaaacnncnnatctctctccctctccgaataaccggctggacccacgcgtccgggcacttgatcagtcaaatgcaacatgtggcaagaggttatcatctattggcttgcggaacacataattgaaccgtcaggcttacaggcagctattgctgacaactgctgttcttggtgaatatatcactggcgctattcttttcgaacgagaccctttatcaatcaactacagacggcaagaagcttgttgactgcttgaaagatcagaatatcatgcctggcatcaatgttgacaagggtttgattccattgcctggatccaacaatgaatcatggtaccaaagtcttgatggcttggcttcaaggcgtgctgactactataagcaggtggcgcgcttcgcatagcgcatgactgttgctagcatccatcgtggtgcatctgcattatcagtcaatgaatcatcat

SEQ ID NO: 3956 - DNA, 411 bp, Zea mays
  Clone ID: LIB3060-017-Q1-K1-F3
cgagtgtcaagtgaacctgaaacttgcggtgtcactggctggtatagcctgagtgtgagtgagtgatcgagctagctgagctccgatcctagctagctagctaggataccgccataccacaagtcttcttcacaagtttaggagtgacagcaacaagagatctcgatggcctatgccaccgtgctcaagtacttcttccttagcaagaagtccgaatggggcgccaccagtgcaggccggcgcgcccaggccggacaccgtctacatggtcgtacgcgcctactgctacgccgatgagctcgtgaagaccgcgaaaacgatcgcgtcgtcggggcggtgcatcctggcgatggacgagtcgaacgcgacgtgctgtaagcggctggcgtccatcgagctggagaacacgga

SEQ ID NO: 3957 - DNA, 415 bp, Zea mays
  unsure (1)...(415): unsure at all n locations
  Clone ID: LIB3059-040-Q1-K1-C12
gaagaagacgagtgtcaagtgaacctgaaacttgcggtgtcactggctggtggagccggagtgtgagtgagtgatcgagctagctgagctccgatcctcgctagctagctaggataccgccataccacaagtcttcttcacaagtttaggagtgacagcaacaagagatctcgatggcctctgccaccgtgctcaagtcctccttccttcccaagaagtccgaatggggcgccaccaggcaggccgccgcgcccaggccgcccaccgtctccatggtcgtccgcgccttcgnctacgccgatgagctcgtgaagaccgcgaaaacgatcgcgtcgccggggcggngcatcctggcgatggacgagtcgaacgcgacgtgcgggaagcggctggcgtccatcgggctggagaacac

SEQ ID NO: 3958 - DNA, 430 bp, Zea mays
  Clone ID: LIB3060-030-Q1-K1-H11
aagaagacgagtgtcaagtgaacctgaaactttcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtcttcatggtcgtccgcgcctccgcctacgccgatgagctcgtgaagaccgcgaaaacaatcgcgtcgccggggcggggcatcctggcgatggacgagtcaaacgcgacttgcgggaagcggctgacgtccatcgggctgaagaacacggaggccaaccggaaggcttaccg

SEQ ID NO: 3959 - DNA, 414 bp, Zea mays
  Clone ID: LIB3062-015-Q1-K1-G12
gtaaacctcattatatcattgcaaagggaggaatcacttcatctgatattgctacaaaggcgctggaagctaaacgtgccaaagtcatgggacaagcattagctggtgtacccttgtggcagcttggtcctgagagtagatttcctggggtcccttacattgtttttcctggtaatgttggtgataacagtgctcttgctaaagtggtgaaaagttgggcttccccatctagaagttctacaaaagaaattcttcttgatgcggagaatggcggttatgctgttggtgctttcaatgtgtataaccttgagggaattgaagctgttgttgcagcagcagaggctgaaaagagtcctgctattcttcagattcatccgagtgctctaaagcaaggtggagtcccactggtagcat

SEQ ID NO: 3960 - DNA, 435 bp, Zea mays
  Clone ID: LIB3060-018-Q1-K1-E6
cgcgtttggattttgctcctttgctcccttctgaaagggtcaccatgtctgcctttgtggggaagtacacagatgagctgatcaagaccgccaagtgcctcgcaacgccgggcaagggcatcctggcctccgacgagtcgacgggcaccatcggcaagcgcctgtccagcatcaacctcgagaacgtggagtcgaaccggcaggcgctccgcgagctgctcttcacggcgcccggcgtgttcgactacctctccggggtcatcctcttcgaggagacgctgtaccagaagacctccgacgggaagccgttcgtggacgtgctcatcgcgggcggagtggtccctgggatcaaggtcgacaagggcaccgtggagatcgcgggcaccgacggcgagaccaccacgcagggcctcgactccctgggcgcacgctgcg

SEQ ID NO: 3961 - DNA, 384 bp, Zea mays
  unsure (1)...(384): unsure at all n locations
  Clone ID: LIB3060-044-Q1-K1-F10
cgcgtttggattttgctcctttgctcccttctgaaagggtcaccatgtctgccttggtggggaagtacacagatgagctgatcaagaccgccaagtgcctcgcaacgccgggcaagggcatcctggcctccgacgagtcgacgggcaccatcggcaagcgcctgtccagcatcaacctcgagaacgtggagtcgaaccggcaggcgctccgcgagctgctcttcacggcgcccggcgtgttcgactacctctccggggtcatcctcttcgaggagacgctgtaccagaagacctncgacgggaagccgttcgtggacgtgctcatcgcgggcggagtggtccctgggatcaaggtcgacaagggcaccgtggagatcgcgggca

SEQ ID NO: 3962 - DNA, 355 bp, Zea mays
  Clone ID: LIB3061-025-Q1-K1-C9
attcactataaccttgatacctggtagatagccatgctttatgcatatcgtattgcagatgagctcatcaagaatgctgactacattggcacccctgacaagggtatccttgctgctgatgagtccactggcaccattggcaagcgcctttccagcatcaatgtctagaacgttgacgagaaccgccgtgccctccgtgagctcctattctgctgccctggtgctctccagtacatcagcggtgtgatcctcttcgaggagaccctgtaccagaagaccaaggatggctagccttctgtcgatgtcctgaacgagggaggcgttctccatagcatcaaggttgacaagggcacca

SEQ ID NO: 3963 - DNA, 154 bp, Zea mays
  Clone ID: LIB3059-020-Q1-K1-H3
gtcctgccgatggagaatcgagcagccctttttttttgttctatcaactatgctgtaatgctggctatgtatcggcaaaaacaattctatatgctgagttggagtcggcaaaaattcatatatgctgagttggagacagcaacttgtttggatc

SEQ ID NO: 3964 - DNA, 254 bp, Glycine max
  unsure (1)...(254): unsure at all n locations
  Clone ID: 700565253H1
cttttcttctctctcaacaacntcaccngtcttcctcctngatcatgtccnacttcaagggcnagtaccatnntgagntgntctnctatgctgcgtacntcnncactcctggaaagggtatttcttgctgctgacgagtcaacagggacaacgggcaagcgttnggncagcatcagagtagagaacattgaatccaacaggcgagctcttagggngcagnctttcactgcccnngtgtncttcaatatctcant

SEQ ID NO: 3965 - DNA, 283 bp, Glycine max
  unsure (1)...(283): unsure at all n locations
  Clone ID: 700865276H1
tcacatgttcctaatagccaccatgtcttccttcaagcgcacattctcanatgagttgattgccagtgctacttatattggcaccccaggacttggtatgcttgcagctgatgagttaaccggcacaattgggaaacgtttggcgagcttcaacgtggagaatgttgaaacgaacaggcgcattcttcgtgagctcctattcactgctcccggttgtcttgagtgcctcagtggtgtcatcttgtttgaggaaaccctctaccaaatatcagctgcaggagta

SEQ ID NO: 3966 - DNA, 268 bp, Glycine max
  Clone ID: 700873022H1
tcaagcctagcgtctctcaactcaacaatgggtcttcttgacatcgtgcagccaggcgtcctcaacggtggggacgtcatgaaggtgtacaaatatgctcaggagcacaagtttgccatcccggccgtgaacgtgacatcgtcgtcgacgacgaatgccgctctgcaggccgcccgcgacatcaagtcgcccatcatcatccagacatcaaatggcggcgccgccttctacgctggcaaaggtattgacaacaagaaccagaacgcct

SEQ ID NO: 3967 - DNA, 261 bp, Glycine max
  Clone ID: 700943855H1
ggacgagaacatccccaaggcgcaaagcgcgttgctggtgaggtgcaaggcgaattctgaggctactcttggaacttacaagggggatgccacgcttggggaaggggcttctgagtctcttcatgttaaggattataagtactaagagagaggtgtgagattggttcttttggaatggaattgtttgtttctttgggcctgttttggatattcaagagtgtttttcaaaaaatttctactgaaaaggaaagaaattctcca

SEQ ID NO: 3968 - DNA, 277 bp, Glycine max
  unsure (1)...(277): unsure at all n locations
  Clone ID: 700974965H1
cnnatctacaagggtaactcacagcttnctgatggtgcctcagagagcctccatgtttcgaactacagctactgatcaatcgaagttggngttgtttgnaganactagtgcgagtaggantcggtatnatgggtacnacaaccgnatttcttgttgataagtantatngtggntngactcttcccngaatnatcgnttggnattnacnggatgtttnccagtgnncctnnatggccanttagtcatccagggtgttggtgaactggcaaccnggaag

SEQ ID NO: 3969 - DNA, 276 bp, Glycine max
  Clone ID: 701039850H1
ctttaccagtcgacaacagatggaaataaatttgtggattgcctccgcgatcagaacattgtgcccggcatcaaagttgataagggtctggtccctctgccagggtcaaacaatgagtcttggtgccaagggctggatggttggcttctaggtctgctgaatactacaagcaaggtgctcgatttgccaagtggaggacagttgttagcattccatgtggtccttctgcattagctgtcccggaagcagcgtgggggcttgcacgttatgctgcta

SEQ ID NO: 3970 - DNA, 256 bp, Glycine max
  unsure (1)...(256): unsure at all n locations
  Clone ID: 701206840H1
agttcccagtattaactgatcatatacttacatttggtgaaggacagattaaatttgaagataatgtggatgaagtagtttcncaaaatggcccacgcgacgttngnggnnttctagaacacacttcgttntgttcntctctnttcntggnaagggtnttcttgctgctgatgagtcaacagggacaattggcaagcgtttgggcagcatcagtgtagagaacattgaatccaacaggcgatctcttagggagctg

SEQ ID NO: 3971 - DNA, 191 bp, Glycine max
  unsure (1)...(191): unsure at all n locations
  Clone ID: 700654881H1
ggctttatttgccaggtgcaatgcaaactcacatgcaactttgggaacttacnaaggtgatgctacccttgctgagggtgcctccgagtctctccatgtcnaggactacaaatactaactaaaggtgttgacttctttaatttggagaatttttgcactattggctacaccattctcatgttcttccttca

SEQ ID NO: 3972 - DNA, 248 bp, Glycine max
  Clone ID: 700746016H1
tgcaatgcaagctcacatgcaactttgggaacttgcaaaggtggtgctacccttgctgagggtgcctctgagtctctccatgtcaaggactacaaatactaactaaaggtgttgacttcttttaatttggagaatttttgcgctattggctacaccattctcatgttctttccttcgtagaagttagactcggccgatttgctttctgctctcggttataggatgtctacggattggggtgtaatcgc

SEQ ID NO: 3973 - DNA, 263 bp, Glycine max
  Clone ID: 701037190H1
acaccaaattaacaaagccttctttttcttgtgtgatctcacaagcccctaaaggccaccatgtcttccttcaagagcaaattccaagatgagttgattgccaatgctagttacattggcaccccaggaaagggtatccttgcggctgacgagtcaacagggacaattgggaagcgtttggcgagcatcaacgtggagaatgttgaaacaaacaggcgcattcttcgtgagctcctattcactgcccctggttgtcttgagcg

SEQ ID NO: 3974 - DNA, 258 bp, Glycine max
  Clone ID: 701042664H1
cacaccaaattaacaaagccttctttttcttgtgtgatctcacaagcccctaaaggccaccatgtcttccttcaagagcaaattccaagatgagttgattgccaatgctagttacattggcaccccaggaaacggtatccttgcggctgacgagtcaacagggacaattgggaagcgtttggcgagcatcaacgtggagaatgttgaaccaaaaaggggaatcctccgtgagctcctattcactgcccctggttgtct

SEQ ID NO: 3975 - DNA, 337 bp, Glycine max
  Clone ID: 700651596H1
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtct

SEQ ID NO: 3976 - DNA, 283 bp, Glycine max
  Clone ID: 700750439H1
cctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgt

SEQ ID NO: 3977 - DNA, 382 bp, Glycine max
  unsure (1)...(382): unsure at all n locations
  Clone ID: 700649475H1
ctcccaccaacttcaccgtcttcttcctcgatcatgtctcacttcaagggcaagtaccatgatgagcttattgccaatgctgcttacattggcaattcctggaaagggattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggagctggtgtgcttctggcacaaggtgaccaaggcnagttgacttctggantaatggagaaccacat

SEQ ID NO: 3978 - DNA, 314 bp, Glycine max
  Clone ID: 700652995H1
aggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctc

SEQ ID NO: 3979 - DNA, 288 bp, Glycine max
  Clone ID: 700981967H1
ctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttg

SEQ ID NO: 3980 - DNA, 279 bp, Glycine max
  Clone ID: 700863243H1
ccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcattctctttgaggaaactctctaccagagcacagctgcaggcaagccctttgtggaagtcttgaaggaggctggtgtgcttcctgg

SEQ ID NO: 3981 - DNA, 288 bp, Glycine max
  unsure (1)...(288): unsure at all n locations
  Clone ID: 700558625H1
gagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcanagttgagcttgctggcactaatggagaaaccaccactcagggtctagatggccttggtcagcgttgcgccaagtactatgaagccggtgcacgttttgcc

SEQ ID NO: 3982 - DNA, 319 bp, Glycine max
  unsure (1)...(319): unsure at all n locations
  Clone ID: 700564806H1
gaacgcctatggcttgcgctagttacgctgtcatatgccaggagaatggcctggttcccattgttgagcntgagatcctngttgatggacctcatgacattcacaagtgtgccgccgtcaccgagcgtgtccttgcagcatgctacaaggctttgaatgatcaccntgtccttcttgagggtaccctattgaagccnaacatggtcacccctggntcccaatctgctaaggtttcccctcaggtggttgccgagcacactgtcagagcccttcagagaaccgtgcctgctgcagttcctgctgtcgttttctngtctgg

SEQ ID NO: 3983 - DNA, 276 bp, Glycine max
  Clone ID: 700746368H1
cttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagacagctgcaggcaagccctttgtgaatgtcttgaaggaa

SEQ ID NO: 3984 - DNA, 263 bp, Glycine max
  Clone ID: 700960290H1
cgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttt

SEQ ID NO: 3985 - DNA, 285 bp, Glycine max
  Clone ID: 701055132H1
tcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgc

SEQ ID NO: 3986 - DNA, 278 bp, Glycine max
  Clone ID: 701056109H1
gggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggag

SEQ ID NO: 3987 - DNA, 265 bp, Glycine max
  Clone ID: 701119884H1
ctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaa

SEQ ID NO: 3988 - DNA, 264 bp, Glycine max
  Clone ID: 700898149H1
cgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggca

SEQ ID NO: 3989 - DNA, 349 bp, Glycine max
  unsure (1)...(349): unsure at all n locations
  Clone ID: 700661436H1
tctagatggccttggtcagcgttgtgccaagtgctacgaagctggtgcacgttttgccaaatggcgtgcagtgctgaagattggtcccaacgagccatctgagctgtctatccatgagaacgncctatggcttggctagatacgctgtcatatgccaggagaatggcctggttcccattgttgagcctgagatccttgttgatggacctcatgacattcacaagtgtgccgccgtcaccgagcgtgtccttgcagcatgctacaaggcttgaatgatcaccatgtccttcttgagggtacctatgaagccaaaccatggtcaccctggatcccaatctgtaaggttccc

SEQ ID NO: 3990 - DNA, 273 bp, Glycine max
  Clone ID: 701042223H1
tgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggagaaac

SEQ ID NO: 3991 - DNA, 258 bp, Glycine max
  Clone ID: 700676004H1
atcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatattcagtggtgtcatcctctttgaggaaaccctctaccagagtacagctgcag

SEQ ID NO: 3992 - DNA, 267 bp, Glycine max
  Clone ID: 700747718H1
cttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgt

SEQ ID NO: 3993 - DNA, 259 bp, Glycine max
  Clone ID: 700751133H1
ggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgc

SEQ ID NO: 3994 - DNA, 270 bp, Glycine max
  Clone ID: 701215247H1
tgcgtacattggcactcctggaaagggtattcttgctgctgatgagtcaacagggacaattggcaagcgtttggccagcatcagtgtagagaacattgaatccaacaggcgagctcttagggagctgcttttcactggtcctggtgttcttcaatatctcagtggtgtcatcctctttgaggaaaccctctaccagagcacagctgcaggcaagccctttgtgaatgtcttgaaggaagctggtgtgcttcctggcatcaaggttgacaa

SEQ ID NO: 3995 - DNA, 357 bp, Glycine max
  unsure (1)...(357): unsure at all n locations
  Clone ID: 700652484H1
gtccaacctacccctttttcttctcccaccaacttcaccgtnntcttcctcgatcatgtctcactncaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaatctctaccagcacagctgcaggcaagccctttgtggaatcttgaaggaggctggtgtgcttcctggcatc

SEQ ID NO: 3996 - DNA, 292 bp, Glycine max
  Clone ID: 700981960H1
atcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctgtctatcccatgagaacgctatggcttggctagatacc

SEQ ID NO: 3997 - DNA, 255 bp, Glycine max
  Clone ID: 700869785H1
atcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctg

SEQ ID NO: 3998 - DNA, 292 bp, Glycine max
  unsure (1)...(292): unsure at all n locations
  Clone ID: 700969335H1
ctctttttcttctctctcnacaacttcancttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccaggng

SEQ ID NO: 3999 - DNA, 265 bp, Glycine max
  Clone ID: 700854174H1
gtggttgccgagcacactgtcagagcccttcagagaaccgtgcctgccgcagttcctgctgtcgttttcttgtctggtggccagagtgaggaggaggcatctgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaact

SEQ ID NO: 4000 - DNA, 262 bp, Glycine max
  Clone ID: 700761638H1
tgcagatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaa

SEQ ID NO: 4001 - DNA, 276 bp, Glycine max
  Clone ID: 701005716H1
ctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaacagaagagaatgtgaagaaggctcaggaagcccttt

SEQ ID NO: 4002 - DNA, 266 bp, Glycine max
  unsure (1)...(266): unsure at all n locations
  Clone ID: 700984860H1
accatgatnagcttatcgccaatgctgcgtacattggcactcctggaaagggtattcttgctgctgatgagtcaacagggacaattggcaagcgtttggccagnatcagtgtagagaacattgaatccaacaggcgagctcttagggagctgcttttcactgctcctggtgttcttcaatatctcagtggtgtcatcctctttgaggaaaccctctaccagaggacagctgcangcaagccctttgtgaatgtcttgaagggagct

SEQ ID NO: 4003 - DNA, 248 bp, Glycine max
  Clone ID: 700941053H1
agggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaag

SEQ ID NO: 4004 - DNA, 300 bp, Glycine max
  Clone ID: 700561358H1
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctcgtgttcttcaatatctcagtggtgtcatcctctttgaggaaaccctctaccag

SEQ ID NO: 4005 - DNA, 287 bp, Glycine max
  Clone ID: 700564906H1
gaacgcctatggcttggctagttacgctgtcatatgccaggagaatggcctggttcccattgttgagcctgagatccttgttgatggacctcatgacattcacaagtgtgccgccgtcaccgagcgtgtccttgcagcatgctacaaggcttgaatgatcaccatgtccttcttgagggtaccctattgaagccaaacatggtcacccctggatcccaatctgctaaggtttcccctcaggtggttgccgagcacactgtcagagcccttcagagaaccgtgcctgc

SEQ ID NO: 4006 - DNA, 254 bp, Glycine max
  Clone ID: 700833951H1
ctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgtgcagtgctgaagattggtcccaacgagccatctgagctgtcta

SEQ ID NO: 4007 - DNA, 267 bp, Glycine max
  Clone ID: 701117626H1
caacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctct

SEQ ID NO: 4008 - DNA, 261 bp, Glycine max
  unsure (1)...(261): unsure at all n locations
  Clone ID: 700729103H1
cgatcatgtctcacttcaagggcaagtaccatgatgagcttattgtcaatgctgcttacattggcactcctggaaagggtattcttgctgctgatgagtcaacagggacaattggcaagcgtttggccagcatcgtgtagagaatgttgaatccaacaggcgtgctcttagggagctgcttttcaccgctcccggtgctcttaaatatctcagtggtgtcatcctctttgaggaaactctctaccagagnacagctgcagg

SEQ ID NO: 4009 - DNA, 267 bp, Glycine max
  unsure (1)...(267): unsure at all n locations
  Clone ID: 700670615H1
gggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctncatgtttcgaactacagctactgat

SEQ ID NO: 4010 - DNA, 260 bp, Glycine max
  Clone ID: 701053635H1
ggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgacaagggcacagttgagcttgctggcactaatggagaaaccaccact

SEQ ID NO: 4011 - DNA, 289 bp, Glycine max
  Clone ID: 700982280H1
ctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaacc

SEQ ID NO: 4012 - DNA, 265 bp, Glycine max
  Clone ID: 701119874H1
ctcttagggagctgcttttcacgactcctggtgttcttcaatatctacagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaatccaccactcagggtctagatggccttggtcagcgttgtgccaagtactacgaagctggtgcacgttttgcca

SEQ ID NO: 4013 - DNA, 238 bp, Glycine max
  Clone ID: 700758937H1
tctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttctgccaagtactacgaagctggtgcacgttttgccaaatggcgtgcagtgctg

SEQ ID NO: 4014 - DNA, 280 bp, Glycine max
  Clone ID: 701214027H1
tacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaa

SEQ ID NO: 4015 - DNA, 256 bp, Glycine max
  Clone ID: 700972858H1
ccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcacagttgagcttgctggcactaatggagaaaccaccactcagggtctagatggctt

SEQ ID NO: 4016 - DNA, 274 bp, Glycine max
  Clone ID: 701099780H1
tctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgagg

SEQ ID NO: 4017 - DNA, 250 bp, Glycine max
  Clone ID: 700829560H1
tggaaagggtattcttgctgctgatgagtcaacagggacaattggcaagcgtttggccagcatcagtgtagagaatcttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgttcttcctggcatcaaggttgac

SEQ ID NO: 4018 - DNA, 256 bp, Glycine max
  Clone ID: 700971973H1
ccatgatgagcttattgccaatgctgcttacattggcactcctggaaagggtattcttgctgctgatgagtcaacagggacaattggcaagcgtttgccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttga

SEQ ID NO: 4019 - DNA, 295 bp, Glycine max
  Clone ID: 701142336H1
tctttttcttctctctcaacaacttcaccttcttcctcctcgatcatgtctcacttcaacggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttaggggcgcgcttttcactgctcctggtgttcttcaatatctcagtggtgtcatcctctttgatgaaccctctaccagagcacagc

SEQ ID NO: 4020 - DNA, 269 bp, Glycine max
  Clone ID: 701132605H1
ctcgagccgcttcttcctcctcgatcatgtctcacttcaagggcaagtaccatgatgagctcatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccag

SEQ ID NO: 4021 - DNA, 252 bp, Glycine max
  unsure (1)...(252): unsure at all n locations
  Clone ID: 700969222H1
ggcaagtaacatgatgagcttatcgccaatgctgcgtncatnggcactcctgganagggtattcttgctgctgatgagtcaacagggncaattggcaagcgtttggccagnatcagtgtagagnacattgaatccaacaggcgagctcttagggagctgcttttnactgctcctggtgttcttcaatatctcagtggtgtcatcctctttgaggaaaccctctaccagagcacagctgcaggcaagcccttt

SEQ ID NO: 4022 - DNA, 256 bp, Glycine max
  Clone ID: 700670956H1
ggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactac

SEQ ID NO: 4023 - DNA, 269 bp, Glycine max
  Clone ID: 701013771H1
attcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaactgtgcctgctgcagttcctgctgtcgttttcttgtctggtggccagagtgaggaggaggcatccgtcaacctcaacgccattaacca

SEQ ID NO: 4024 - DNA, 261 bp, Glycine max
  Clone ID: 700895725H1
ctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagcca

SEQ ID NO: 4025 - DNA, 294 bp, Glycine max
  Clone ID: 701055481H1
acctacctctttttcttctctctcaacaacttcaccttcttcctcctcgatcatgtctcacttcaagggcaagtaccatgatgagcttatcgccaatgctgcgtacattggctctcctgtgaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaacctctacca

SEQ ID NO: 4026 - DNA, 248 bp, Glycine max
  Clone ID: 700753940H1
tgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaggactcagggtctagatggccttggtcagcgttgtg

SEQ ID NO: 4027 - DNA, 267 bp, Glycine max
  unsure (1)...(267): unsure at all n locations
  Clone ID: 700974141H1
tggatctcatgacattcacaagtntgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagcacactgttagagcccttcagagaaccgtgcctgctgcagttcctgctatcgttttcttgtctggtgggcagagtgaggaggaggcatccgttaacct

SEQ ID NO: 4028 - DNA, 285 bp, Glycine max
  Clone ID: 700562408H1
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgag

SEQ ID NO: 4029 - DNA, 267 bp, Glycine max
  Clone ID: 700685292H1
ctgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactcagaggcaactctgggaa

SEQ ID NO: 4030 - DNA, 285 bp, Glycine max
  Clone ID: 700985157H1
tctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgagg

SEQ ID NO: 4031 - DNA, 284 bp, Glycine max
  Clone ID: 701038194H1
ctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgagg

SEQ ID NO: 4032 - DNA, 261 bp, Glycine max
  unsure (1)...(261): unsure at all n locations
  Clone ID: 700986633H1
cagagaaccgtgcctgctgcagttcctgctatcgttttcttgtctngtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggctaactcagaggcaactctgggaactacaagg

SEQ ID NO: 4033 - DNA, 274 bp, Glycine max
  unsure (1)...(274): unsure at all n locations
  Clone ID: 700564282H1
tgcctncngcagttcctgctatcgttttcttgtctggtgggcagagtgaggaggaggcatccgttaacctcaatgccatnaaccaggtcaatggaaagaagccatggtcactctctttctcctttggaagggcacttcaagnagcacccttaaggcatggagtggaaaagaggagaatgtgaagaaggctcaggaagcccttttggtaagagccaaggccaactcagaggcaactctgggaacctacaagggtaactcaaagcttgctgatggt

SEQ ID NO: 4034 - DNA, 248 bp, Glycine max
  Clone ID: 700733754H1
gtctcacttcaagggcaagtaccatgatgagcttatcgccaatgctgcgtacattggcactcctggaaccggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacag

SEQ ID NO: 4035 - DNA, 278 bp, Glycine max
  Clone ID: 700988179H1
aacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctcttt

SEQ ID NO: 4036 - DNA, 271 bp, Glycine max
  Clone ID: 700555591H1
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctcttt

SEQ ID NO: 4037 - DNA, 273 bp, Glycine max
  Clone ID: 701206717H1
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtatagaacattgaatccaacaggcgagctcttagggagctgcttttcactgctcctggtgttcttcaatatctcagtggtgtcatcctctttga

SEQ ID NO: 4038 - DNA, 238 bp, Glycine max
  Clone ID: 700968494H1
gaatccaacaggcgagctcttagggagctgcttttcactgctcctggtgttcttcaataggtcagtggtgtcatcctctttgaggtaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtc

SEQ ID NO: 4039 - DNA, 257 bp, Glycine max
  Clone ID: 700677674H1
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggg

SEQ ID NO: 4040 - DNA, 258 bp, Glycine max
  Clone ID: 700906271H1
aacagggacaattggcaagcgtttggccagcatcagtgtagagaatgttgaatccaacaggtgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcacagttgagcttgctggcactaatggagaaac

SEQ ID NO: 4041 - DNA, 272 bp, Glycine max
  Clone ID: 700970391H1
cgagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactcagaggcaactctgggaactacaagggtaatcaaagct

SEQ ID NO: 4042 - DNA, 273 bp, Glycine max
  Clone ID: 700753641H1
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttga

SEQ ID NO: 4043 - DNA, 270 bp, Glycine max
  Clone ID: 700646593H1
tgacattcacaagtgtgctgccgtcaccgagcgtgtccttgcagcatgctacaaggctttgaatgatcaccacgtccttcttgagggtaccctattgaagccaaacatggtcacccccggatccaattctgctaggtttcccctcaggtggttgcggagacactgttagagcccttcagagaaccgtgcctgctgcagttcctgctatcgttttcttgtctggtgggcagagtgaggaggaggcatccgttaacctcaatgccattaacc

SEQ ID NO: 4044 - DNA, 284 bp, Glycine max
  unsure (1)...(284): unsure at all n locations
  Clone ID: 700565615H1
gtgcctgctgcagttcctgctatcgttttcttgtctggtgggcagagtgaggnggaggcatccgttaaccctnaangccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactnagaggcaactctgggaacctacaagggnaatcaaagcntgctgatggtgcctcaga

SEQ ID NO: 4045 - DNA, 268 bp, Glycine max
  unsure (1)...(268): unsure at all n locations
  Clone ID: 700746523H1
cttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggacagnnctttgtgaatgtcttgaaggaagctggtgtgcttcctggcatcaaggttgacaagggcacagtcgagcttgctggaactaatg

SEQ ID NO: 4046 - DNA, 260 bp, Glycine max
  Clone ID: 700899019H1
ggttgacggatgcctcctcctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagct

SEQ ID NO: 4047 - DNA, 264 bp, Glycine max
  Clone ID: 701127167H1
caacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattgcaagcgtttggccagcatcagtgtagagaatgttgaatccaacaggcgtgctcttagggagctgcttttcaccgctcccggtgctcttaaatatctcagtggt

SEQ ID NO: 4048 - DNA, 260 bp, Glycine max
  Clone ID: 701131053H1
ctctctcaacaacttcaccttcttcctcctcgatcatgtcttacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctcttt

SEQ ID NO: 4049 - DNA, 286 bp, Glycine max
  Clone ID: 701055811H1
ctctcaagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctt

SEQ ID NO: 4050 - DNA, 251 bp, Glycine max
  unsure (1)...(251): unsure at all n locations
  Clone ID: 700670980H1
ggaggaggcatccgtcaacctcaacgccattnaccaggtcaatgggaagaagccatggtcactctctttctcctttggaagggcacntcaacagagcacccttaaggcntggggcggaaaagaagagaatgtgaagaaggctcaggaagcccttttggtaagagccaaggctaactcagaggcaactctgggaacctacaagggtaactcacagcttgctgatggtgcctcagagagcctccatgtttcga

SEQ ID NO: 4051 - DNA, 251 bp, Glycine max
  Clone ID: 700900103H1
gaatgcctatggcttggccagatacgctgtcatatgccaggagaatggcctggttcccattgttgagcctgagatccttgttgatggatctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcgg

SEQ ID NO: 4052 - DNA, 294 bp, Glycine max
  unsure (1)...(294): unsure at all n locations
  Clone ID: 700975609H1
cnaacctctcaagtccaacctacccctttttnttctcccaccaacttcaccgttcnnttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttga

SEQ ID NO: 4053 - DNA, 300 bp, Glycine max
  Clone ID: 701102865H1
tcggcattcggctcgatctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctct

SEQ ID NO: 4054 - DNA, 294 bp, Glycine max
  Clone ID: 701145255H1
tgacgacagaaggggttgccgagcacactgtcagagcccttcagagaaccgtgcctgctgcagttcctgctgtcgttttcttgtctggtggccagagtgaggaggatgcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaa

SEQ ID NO: 4055 - DNA, 242 bp, Glycine max
  Clone ID: 701210875H1
ctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagc

SEQ ID NO: 4056 - DNA, 269 bp, Glycine max
  Clone ID: 700646664H1
cacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttacatatctcagtggtgtcat

SEQ ID NO: 4057 - DNA, 230 bp, Glycine max
  Clone ID: 700897337H1
ctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaag

SEQ ID NO: 4058 - DNA, 246 bp, Glycine max
  Clone ID: 700736783H1
atacgctgtcatatgccaggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccatacatggtcacccctggatcccaatctgctaaggtttcccctcaggtggttgccgagcacactgtcagagc

SEQ ID NO: 4059 - DNA, 262 bp, Glycine max
  Clone ID: 701059586H1
ctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcc

SEQ ID NO: 4060 - DNA, 280 bp, Glycine max
  Clone ID: 701127063H1
tctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgttggccagcatcagtgtagagcccattgaatccaacaggcgagctcttagggagctgcttttcactgctcctggtgttcttcaatatctcagtggtgtcatcctctttgaggaaaccctctaccagagca

SEQ ID NO: 4061 - DNA, 294 bp, Glycine max
  Clone ID: 700556614H1
caacctctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgtgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgagg

SEQ ID NO: 4062 - DNA, 290 bp, Glycine max
  unsure (1)...(290): unsure at all n locations
  Clone ID: 700672681H1
tctaacctacctctttttcttctctctcaacaacttcaccttcttcctcctcgatcatgtctncacttccaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaa

SEQ ID NO: 4063 - DNA, 266 bp, Glycine max
  Clone ID: 700727057H1
acctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 4064 - DNA, 258 bp, Glycine max
  Clone ID: 701042141H1
ctgagctggctatccatgagaatgcctatggcttggccagatacgctgtcatatgccaggagaatggcctggttcccattgttgagcctgagatccttgttgatggatctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctc

SEQ ID NO: 4065 - DNA, 279 bp, Glycine max
  unsure (1)...(279): unsure at all n locations
  Clone ID: 700561860H1
aacctctaacctacctctttttcttctctctcaacaacttcaccttcttcctcctcgatcatgtctcacttcaagggcaagtaccatgatgagcttatcgccaatgctgcgtacattggcactcctggaaagggtattctngctgctgatgagtcaacagggacaattggcaagcgtttggccagcatcagtgtagagaacattgaatccaacaggcgagctcttagggagctgcttttcactgctcctggtgttcttcaatatctcagtggtgtcatc

SEQ ID NO: 4066 - DNA, 244 bp, Glycine max
  Clone ID: 700677460H1
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacc

SEQ ID NO: 4067 - DNA, 269 bp, Glycine max
  Clone ID: 700749578H1
aacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtc

SEQ ID NO: 4068 - DNA, 264 bp, Glycine max
  Clone ID: 700971671H1
cctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtca

SEQ ID NO: 4069 - DNA, 268 bp, Glycine max
  unsure (1)...(268): unsure at all n locations
  Clone ID: 700672288H1
cctctttttcttctctctcaacaacttcaccttcntcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcct

SEQ ID NO: 4070 - DNA, 271 bp, Glycine max
  Clone ID: 701068481H1
aacctacctctttttcttctctctcaacaacttcaccttcttcctcctcgatcatgtctcacttcaagggcaagtaccatgatgagcttatcgccaatgctgcgtacattggcactcctggaaagcgtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcat

SEQ ID NO: 4071 - DNA, 265 bp, Glycine max
  Clone ID: 700729913H1
gatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaac

SEQ ID NO: 4072 - DNA, 251 bp, Glycine max
  Clone ID: 700739449H1
ctgctcctggtgttcttcaatatctcagttctgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtgccaagtactacgaagctggtgcacgttttgccaaatggcgt

SEQ ID NO: 4073 - DNA, 265 bp, Glycine max
  Clone ID: 700830902H1
gctcgaagcgcaattggacaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccacc

SEQ ID NO: 4074 - DNA, 264 bp, Glycine max
  Clone ID: 700895304H1
tctcgagccgattcggctcgaggtgcctgctgcagttcctgctgacgttttcttgtctggaggccagagtgaggaggagacatccgtcaacctcaacgccattaaccaggtcaatgggaagaagccatggtcactctctttctcctttggaagggcacttcaacagagcacccttaaggcatggggcggaaaagaagagaatgtgaagaatgctcaggaagcccttttggtaagagccaaggctaactcagaggcaactctggg

SEQ ID NO: 4075 - DNA, 247 bp, Glycine max
  unsure (1)...(247): unsure at all n locations
  Clone ID: 700605676H2
ctctcaacaacttcaccttcttcctcctcgatcatgtctcacttcaagggcaagtaccatgatgagcttatcgccaatgctgcgtacattggcactcctggaaagggnattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 4076 - DNA, 241 bp, Glycine max
  Clone ID: 700677453H1
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagc

SEQ ID NO: 4077 - DNA, 267 bp, Glycine max
  unsure (1)...(267): unsure at all n locations
  Clone ID: 700983108H1
aacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcntcaatatctcagtggtg

SEQ ID NO: 4078 - DNA, 268 bp, Glycine max
  Clone ID: 700889170H1
gtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggt

SEQ ID NO: 4079 - DNA, 266 bp, Glycine max
  Clone ID: 701004956H1
taacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtgg

SEQ ID NO: 4080 - DNA, 259 bp, Glycine max
  Clone ID: 700958213H1
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggt

SEQ ID NO: 4081 - DNA, 249 bp, Glycine max
  Clone ID: 701129305H1
tcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatc

SEQ ID NO: 4082 - DNA, 272 bp, Glycine max
  Clone ID: 701014446H1
cgaagctggtgcacgttttgccaaatggcgtgcagtgctgaagattggtcccaacgagccatctgagctgtctatccatgagaacgcctatggcttggctagatacgctgtcatatgccaggagaatggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattga

SEQ ID NO: 4083 - DNA, 253 bp, Glycine max
  Clone ID: 700832047H1
gaacattgaatccaacaggcgagctcttagggagctgcttttcactgctcctggtgttcttcaatatctcagtggtgtcatcctctttgaggaaaccctctaccagagcacagctgcaggcaagcccttgtgaatgtcttgaaggaagctggtgtgcttcctggcatcaaggttgacaagggcacagtcgagcttgctggaactaatggagacaccaccactcagggtctagcatggcttagtcagcgttgtg

SEQ ID NO: 4084 - DNA, 258 bp, Glycine max
  Clone ID: 700669966H1
ctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctca

SEQ ID NO: 4085 - DNA, 237 bp, Glycine max
  Clone ID: 700659491H1
attgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaaca

SEQ ID NO: 4086 - DNA, 248 bp, Glycine max
  Clone ID: 701003560H1
cttgagggtacctattgaagccaaacatggtcacccccggatccaattctgctaaggtttcccctcaggtggttgcggacacactgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaac

SEQ ID NO: 4087 - DNA, 248 bp, Glycine max
  Clone ID: 700758028H1
gccaggagaatggcctggttcccattgttgagcctgaggtccttgttgatggacctcgtgacattcacaagtgtgccgccgtcaccgagcgtgtccttgcagcatgctacaaggctttgggtgatcaccgtgtccttcttgagggtaccctattgaagccaaacatggtcacccctggatcccagtctgctaaggtttcccctcaggtggttgccgagcacactgtcagagcccttcagagaaccgtg

SEQ ID NO: 4088 - DNA, 252 bp, Glycine max
  Clone ID: 701060964H1
agtcggatctagctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagtacagctgcaggcaacccctttgtggaactcttgaaggagg

SEQ ID NO: 4089 - DNA, 264 bp, Glycine max
  Clone ID: 700548284H1
ctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcag

SEQ ID NO: 4090 - DNA, 253 bp, Glycine max
  Clone ID: 700894957H1
gccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaacc

SEQ ID NO: 4091 - DNA, 280 bp, Glycine max
  Clone ID: 700646551H1
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcct

SEQ ID NO: 4092 - DNA, 258 bp, Glycine max
  Clone ID: 700967633H1
ctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 4093 - DNA, 242 bp, Glycine max
  Clone ID: 700754430H1
acttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcat

SEQ ID NO: 4094 - DNA, 252 bp, Glycine max
  Clone ID: 700865919H1
cctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatc

SEQ ID NO: 4095 - DNA, 272 bp, Glycine max
  unsure (1)...(272): unsure at all n locations
  Clone ID: 700980426H1
acctacctctttntcttctctctcaacaacttcancttcttcctcctcgatcatgtctcacttcaagggcaagtaccatgatgagcttatcgncaatgctgcgtacattggcactcctggaaagggtattcttgctgctgatgagtcaacagggacaattggcaagcgtttggccagcatcagtgtagagaacattgaatccaacaggcgagctcttagggagctgctttncactgctcctggtgntcttcaatatctcaggtgtcatcctc

SEQ ID NO: 4096 - DNA, 246 bp, Glycine max
  Clone ID: 701048203H1
atcaccatgtccttcttgagggtaccctattgaagccaaacatggtcacccctggatcccaatctgctaaggtttcccctcaggtggttgccgagcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcct

SEQ ID NO: 4097 - DNA, 252 bp, Glycine max
  Clone ID: 700846414H1
ctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatct

SEQ ID NO: 4098 - DNA, 251 bp, Glycine max
  Clone ID: 700851608H1
ctttttcttctctctcaacaacttcaccttcttcctactcgatcatgtctcacttcaagggcaagtaccatgatgagcttattgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctc

SEQ ID NO: 4099 - DNA, 266 bp, Glycine max
  unsure (1)...(266): unsure at all n locations
  Clone ID: 700970160H1
ccctttttnttctcccaccaacttcnccgtcttcttcctcgatcatgtctcacttaaagggcaagtaccatgatgagcttnttgccaatgctgcttacnttggcactcctggaaagggtattcttgctgctgntgagtcaacanggacaattggcaagcgtttggccagcatcagtgtanagaatgttgantccaacaggcgtgctcttagggagctgcttttcnccgctcccggtgctcttaaatatctcagtggtgtcatcctc

SEQ ID NO: 4100 - DNA, 265 bp, Glycine max
  Clone ID: 701206312H1
caagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctc

SEQ ID NO: 4101 - DNA, 258 bp, Glycine max
  Clone ID: 700834462H1
ctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccagcaggcgagctcttagggagctgcttttcactgctcctggtgttcattcatatctcagggtgt

SEQ ID NO: 4102 - DNA, 278 bp, Glycine max
  Clone ID: 700562478H1
ttccaacctctcaagtccaacctacccctttttcttctcccaccaacttcaccgtcttcttcctcgatcatgtctcacttcaagggcaagtaccatgatgagcttattgccaatgctgcttacattggcactcctggaaagggtttcttgctgctgatgagtcaacagggacaattggcaagcgtttggccagcatcagtgtagagaatgttgaatccaacaggcgtgctcttagggagctgcttttcaccgctcccggtgctcttaaatatctcagt

SEQ ID NO: 4103 - DNA, 277 bp, Glycine max
  Clone ID: 700788114H1
tcaagtccaacctacccctttttcttctcccaccaacttcaccgtcttcttcctcgatcatgtctcacttcaagggcaagtaccatgatgagcttattgtcaatgctgcttacattggcactcctggatcagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtca

SEQ ID NO: 4104 - DNA, 224 bp, Glycine max
  Clone ID: 700753792H1
cgggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttctggaagtcttgaaggaggctggtgtg

SEQ ID NO: 4105 - DNA, 238 bp, Glycine max
  Clone ID: 700837427H1
ctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctc

SEQ ID NO: 4106 - DNA, 265 bp, Glycine max
  Clone ID: 700753668H1
ctcaagtccaacctacccctttttcttctcccaccaacttcaccgtcttcttcctcgatcatgtctcacttcaagggcaagtaccatgatgagcttattgccaatgatacttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatc

SEQ ID NO: 4107 - DNA, 271 bp, Glycine max
  Clone ID: 700667315H1
acctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatattcagtggtgtcatcc

SEQ ID NO: 4108 - DNA, 261 bp, Glycine max
  Clone ID: 700808315H1
gtcaccgagcgtgtccttgcagcatgctacaaggctttgaatgatcaccatgtccttcttgagggtaccctattgaagccaaacatggtcaccctggatcccaatctgctaaggtttcccctcaggtggttgcgagcacactgtcagagcccttcagagaaccgtgcctgctgcagttcctgctgtcgttttcttgtctggtggccagagtgaggaggaggcatccgtcaacctcaacgccattaaccagtcaatgggaag

SEQ ID NO: 4109 - DNA, 234 bp, Glycine max
  Clone ID: 700839033H1
gagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagaggacagctgcaggcaagccctttgtgaatgtcttgaaggaagctggtgtgcttcctggcatcaaggttgacaagggcaca

SEQ ID NO: 4110 - DNA, 261 bp, Glycine max
  unsure (1)...(261): unsure at all n locations
  Clone ID: 700670207H1
caacctctcaagtccaacctacccctttttcttctcccaccaacttcaccgtcntcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgct

SEQ ID NO: 4111 - DNA, 240 bp, Glycine max
  Clone ID: 700849886H1
ctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaatattgaatccaacaggcgagctcttagggagctgcttttcactgctcctggtcttcttcaatatc

SEQ ID NO: 4112 - DNA, 261 bp, Glycine max
  Clone ID: 700751117H1
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaa

SEQ ID NO: 4113 - DNA, 260 bp, Glycine max
  Clone ID: 700851803H1
ctcaagtccaacctacccctttttcttctcccaccaacttcaccgtcatcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaa

SEQ ID NO: 4114 - DNA, 242 bp, Glycine max
  unsure (1)...(242): unsure at all n locations
  Clone ID: 700669164H1
cgtcaccgagcgtgtccttgcagcatgctacaaggctttgaatgatcaccatgtccttcttgagggtaccctattgaagccaaacatggtcacccctggatcccaatctgcnaaggtttcccctcaggtggttgccgagcacactgtcagagcccttcagagaaccgtgcctgctgcagttcctgctgtcgntttcttgtctggtggccagagtgaggaggaggcatccgtcaacctcaacg

SEQ ID NO: 4115 - DNA, 266 bp, Glycine max
  Clone ID: 700548285H1
cctacctctttttcttctctctcaacaacttcaccttcttcctcctcgattcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtg

SEQ ID NO: 4116 - DNA, 260 bp, Glycine max
  Clone ID: 701065620H1
ctttcttctctctcaacaacttcaccttcctcctcctcgatcatgtctcacttcaacggcaagtaccatgatgagcttatcgccaatgctgcgtacattggcactcctggaaagggtactcttgctgctgatgagcaacagggacaattggcaagcgtttggccagcatcagtgtagagaaccttgaatccaacaggcgagctcttagggagctgcttttcactgctcctggtgttcttcaatatctcagtggtgtcatc

SEQ ID NO: 4117 - DNA, 264 bp, Glycine max
  Clone ID: 700727996H1
ctctaacctacctctttttcttctctctcaacaacttcaccttcttcctcctcgatcatgtctcacttcaagggcaagtaccatgatgagcttatcgccaatgctgcgtacattggcactcctggaaagggtattttgctgctgatgagtcaacagggacaattggcaagcgtttggccagcatcagtgtagagaacattgaatccaacaggcgagctcttagggagctgcttttcactgctcctggtgttcttcaatatctca

SEQ ID NO: 4118 - DNA, 256 bp, Glycine max
  Clone ID: 700869176H1
gtccaacctacccctttttcttctcccaccaacttcaccgtagacttcctcgatcatgtctcacttcaagggcaagtaccatgatgagcttattgccaatgctgcttacattggcactcctggaaagggtattcctgctgctgatgagtcaacagggacaattggcaagcgtttggccagcatcagtgtagagaatgttgaatccaacaggcgtgctcttagggagctgcttttcaccgctcccggtgctcttaaa

SEQ ID NO: 4119 - DNA, 256 bp, Glycine max
  Clone ID: 700973141H1
cctacctctttttcttctctctcaacaacttcaccttcttcctcctcgatcatgtctcacttcaagggcaagtaccatgatgagcttatcgccaatgctgcgtacattggcactcctggaaagggtattcttctgctgatgagtcaacagggacaattggcaagcgtttggccagcatcagtgtagagaacattgaatccaacaggcgagctcttagggagctgcttttcactgctcctggtgttcttcaatatct

SEQ ID NO: 4120 - DNA, 247 bp, Glycine max
  Clone ID: 700969555H1
ccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagacactgttagagcccttcagagaaccgtgcctgctgcagttcctgctatcgttttcttgtctggtgggcagagtgaggaggaggcatccgttaacctcaatgccatt

SEQ ID NO: 4121 - DNA, 256 bp, Glycine max
  Clone ID: 700866138H1
gctgtgtttttaattgatggatttgcttgcagatccgcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcatggtgtcatcctctttgaggaaaccctctaccagagcacagctg

SEQ ID NO: 4122 - DNA, 266 bp, Glycine max
  Clone ID: 700904813H1
gaagggcacttcaacagagcacccttaaggcatggagtggaaaagaggagaatgtgaagaaggctcaggaagcccttttggtaagagccaaggccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgact

SEQ ID NO: 4123 - DNA, 264 bp, Glycine max
  unsure (1)...(264): unsure at all n locations
  Clone ID: 700669945H1
ctacctctttttcttctctctcaacaacttcaccttcttcctccncgatcatgtctncacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggt

SEQ ID NO: 4124 - DNA, 247 bp, Glycine max
  Clone ID: 700894146H1
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctg

SEQ ID NO: 4125 - DNA, 269 bp, Glycine max
  Clone ID: 701060489H1
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctaccggtgctcttaaatatctcag

SEQ ID NO: 4126 - DNA, 250 bp, Glycine max
  Clone ID: 701125675H1
cctcgagctcgattcggctcgagggccaagtaccatgatgagcttacgcgccaatgctgcgaccattggcactcctggaaagggtattcttgctgctgatgagtcaacagggacaattggctcgcgtttggccagcatcagtgtagagaacattgaatccaacaggcgagctcttagggagctgcttttcactgctcctggtgttcttcaatatctcagtggtgtcatcctctttgaggaaaccctctac

SEQ ID NO: 4127 - DNA, 259 bp, Glycine max
  Clone ID: 700754750H1
ctcaagtccaacctacccctttttcttctcccaccaacttcaccgtcttcttcctcgatcatctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaa

SEQ ID NO: 4128 - DNA, 249 bp, Glycine max
  Clone ID: 701142770H1
ccaacctacccctttttcttctcccaccaacttcaccgtcatcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttatcaccgctcccggtgctc

SEQ ID NO: 4129 - DNA, 243 bp, Glycine max
  Clone ID: 700731095H1
ctcaagtccaacctacccctttttcttctcccaccaacttcaccgtcttcttcctcgatcatgtctcacttcaagggcaagtaccatgatgagcttattgtcaatgctgcttacattggcactcctggaaagggtattcttgctgctgatgagtcaacagggacaattggcaagcgtatggctcgcatcagtgtagagaatgttgaatccaacaggcgtgctcttagggagctgcttttcacc

SEQ ID NO: 4130 - DNA, 254 bp, Glycine max
  unsure (1)...(254): unsure at all n locations
  Clone ID: 700667966H1
acctctcaagtccaacctacccctttttcttctcccaccancttcnccgtcttcttcctcgatcatgtctcacttcaagggcaagtaccatgatnagcttattgccaatgctgcntncattggcactcctggaaagggtattcttgctgctgatgagtcaacagggncaattggcaagcgtttggccagcatcngtgtaganaatgttgaatccnacaggcgtgctcttagggagctgcttttcaccgctcccg

SEQ ID NO: 4131 - DNA, 252 bp, Glycine max
  Clone ID: 700673606H1
aacctacctctttttcttctctctcaacaacttcacctacttcctcctcgatcatgtctcacttcaagggcaagtaccatgatgagcttatcgccaatgctgcgtacattggcactcctggaaagggcattcttgctgctgaggagtcaacagggacaattggcaagcgtttggccagcatcagtgtcgagaacattgaatccaacaggcgagctcttagggagctgcttttcactgctcctggtgttcccc

SEQ ID NO: 4132 - DNA, 244 bp, Glycine max
  Clone ID: 700965253H1
tcaagtattaacccttttctctctgaatactctctactcaatacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgc

SEQ ID NO: 4133 - DNA, 294 bp, Glycine max
  Clone ID: 700605289H2
caacctctcaagtccaacctacccctttttcttctcccaccaacttcaccgtcttcttcctcgattcatgtctcacttcaaggggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcaacctcttga

SEQ ID NO: 4134 - DNA, 244 bp, Glycine max
  Clone ID: 700732985H1
ctcaagtccaacctacccctttttcttctcccaccaacttcaccgtcctcttcctcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccg

SEQ ID NO: 4135 - DNA, 259 bp, Glycine max
  Clone ID: 700986523H1
ccaacctctcaagtccaacctacccctttttcttctcccaccaacttcaccgtcttcttcctcgatcatgtctcacttcaagggcaagtaccatgatgagcttattgtcaatgctgcttacattggcactctggaaagggtattcttgctgctgatgagtcaacagggacaattggcaagcgtttggccagcatcagtgtagagaatgttgaatccaacaggcgtgctcttagggagctgcttttcaccgctcccggtg

SEQ ID NO: 4136 - DNA, 258 bp, Glycine max
  Clone ID: 701100040H2
gtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaata

SEQ ID NO: 4137 - DNA, 268 bp, Glycine max
  Clone ID: 700895328H1
tctcgagccgattcggctcgaggtgcctgctgcagttcctgctgacgttttcttgtctggtggccagagtgaggaggaggacatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaac

SEQ ID NO: 4138 - DNA, 251 bp, Glycine max
  Clone ID: 701141083H1
cttttcttctctctcaacaacttcaccttcgtccacctcgatcatgtctcacttcaagggcaagtaccatgatgagcttatcgccaatgctgcgtacattggcactcctggaaagggtattcttgctgctatgagtcaacagggacaattggcaagcgtttggccagcatcagtgtagagaacattgaatccaacaggcgagctcttagggagctgcttttcactgctcctggtgttcttcaatatctcag

SEQ ID NO: 4139 - DNA, 239 bp, Glycine max
  Clone ID: 700829878H1
caggtgagttcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaactaatggagaaaccaccactcagggtctagatggccttggtcagcgttgtg

SEQ ID NO: 4140 - DNA, 261 bp, Glycine max
  unsure (1)...(261): unsure at all n locations
  Clone ID: 700671825H1
ctaacctacctctttttcttttctctcaacaacttcacnttcttcctcctcgatcatgtctnacttncaagggcaagtaccatgatgagcttatcgccaatgctgcgtacattggcactcctggaaagggtattcttgtgctgatgagtcaacagggacaattggcaagcgtttggccagcatcagtgtagagaacattgaatccaacaggcgagctcttagggagctgcttttcactgctcctggtgttcttcaatatct

SEQ ID NO: 4141 - DNA, 239 bp, Glycine max
  Clone ID: 700755240H1
ccaacctctcaagtccaacctacccctttttcttctcccaccaacttcaccgtcctcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagc

SEQ ID NO: 4142 - DNA, 256 bp, Glycine max
  unsure (1)...(256): unsure at all n locations
  Clone ID: 701011659H1
ctttcttccaacctctcaagtccacactacccctttttcttctcccaccaacttcaccgatcacntcntcgatcatgtctcacttcaagggcaagtaccatgatgagcttattgtcaatgctgcttacattggcactcctggaaagggtattcttgctgctgatgagtcaacagggacaattggcaagcgtttggccagcatcagtgtagagaatgttgaatccaacaggcgtgctcttagggagctgcttttcac

SEQ ID NO: 4143 - DNA, 264 bp, Glycine max
  Clone ID: 701011547H1
acctacctctttttcttctctctcaacaacttcaccttcttcctcctcgatcatgtctcacttcaagggcaagtaccatgatgagcttatcgccaatgctgcgtacattggcactcctggacagggtattcttgctgctgatgagtcaacagggacaattggcaagcgtttggccagcatcagtgtagagaacattgaatccaacaggcgagctcttagggagctgcttttcactgctcctggtgttcttcaatatctcagtgg

SEQ ID NO: 4144 - DNA, 255 bp, Glycine max
  Clone ID: 700835614H1
ctaacctacctctttttcttctctctcaacaacttcaccttcttcctcctcgatcatgtctcacttcaagggcaagtaccatgatgagcttatcgccaatgctgcgtacattggcactcctggaaagggtattttgctgctgatgagtcaacagggacaattggcaagcgtttggccagcatcagtgtagagaacattgaatccaacaggcgagctcttagggagctgcttttcactgctcctggtgttcttcaa

SEQ ID NO: 4145 - DNA, 254 bp, Glycine max
  unsure (1)...(254): unsure at all n locations
  Clone ID: 700671849H1
ctttcttccaacctctcaagtccaacctacccctttttcttctcncaccaacttcaccgtcttcttcctcgatcatgtctcacttcaagggcaagtaccatgatgagcttattgccaatgctgcttacattgcactcctggaaagggtattcttgctgctgatgagtcaacagggacaattggcaagcgtttggccagcatcagtgtagagaatgttgaatccaacaggcgtgctcttagggagctgcttttca

SEQ ID NO: 4146 - DNA, 255 bp, Glycine max
  Clone ID: 700734822H1
cctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatat

SEQ ID NO: 4147 - DNA, 238 bp, Glycine max
  Clone ID: 700830223H1
cctcgagccgaatcggctcgagcacttcaagggcaagtaccatgacgagcttattgtcaaacctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctc

SEQ ID NO: 4148 - DNA, 271 bp, Glycine max
  unsure (1)...(271): unsure at all n locations
  Clone ID: 700659970H1
ggcctggttcccattgttgagcctgagatccttgttgatggacctcatgacattcacaagtgtgccgccgtcaccgagcgtgtccttgcagcatgctacaaggctttgaatgatcaccatgtccttcttgagggtaccctattgaagccaaacatggtcacccctggatcccaatctgctaaggtttcccctcaggtggttgccgagcaaatgtcagagccttcagagaacggtgcctgctgcagtcctgngtcgttttctggnngggggg

SEQ ID NO: 4149 - DNA, 283 bp, Glycine max
  Clone ID: 701101779H1
ctctaacctacctctttttcttctctctcaacaacttcaccttctacctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacatcgaatccaacaggcgagctcttagggagctgcttttcactgctcctggtgttcttcaatatctcagtactgtcatcctctttg

SEQ ID NO: 4150 - DNA, 253 bp, Glycine max
  Clone ID: 700852553H1
tttcttccaacctctcaagtccaacctacccctttttcttctcccaccaacttcaccgtcactcttcctcgatcatgtctcacttcaagggcaagtaccatgatgagcttattgccaatgctgcttacattggcactcctggaaagggtattcttgctgctgatgagtcaacagggacaaccggcaagcgtttggccagcatcagtgtagagaatgttgaatccaacaggcgtgctcttagggagctgctttt

SEQ ID NO: 4151 - DNA, 242 bp, Glycine max
  Clone ID: 700853857H1
ctttcttccaacctctcaagtccatcctacccctttttcttctcccaccaacttcaccgtacacttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagg

SEQ ID NO: 4152 - DNA, 257 bp, Glycine max
  unsure (1)...(257): unsure at all n locations
  Clone ID: 700980358H1
ctctaacctacctctttntcttctctctcaacaacttcaccttcttcctcctncgatcatgtctccacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttctt

SEQ ID NO: 4153 - DNA, 248 bp, Glycine max
  unsure (1)...(248): unsure at all n locations
  Clone ID: 700672182H1
cttccaacctctcaagtccaacctaccnctttttcttctcccaccaacttcaccgtccttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctctagggagctgcttt

SEQ ID NO: 4154 - DNA, 243 bp, Glycine max
  Clone ID: 700748455H1
cttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatc

SEQ ID NO: 4155 - DNA, 268 bp, Glycine max
  Clone ID: 700657257H1
gccattaaccaggtcaatggaaagaagccatggtcactctctttctcctttggaagggcacttcaacagagcacccttaaggcatggagtggaaaagaggagaatgtgaagaaggctcaggaagcccttttggtaagagccaaggccaactcagaggcaactctgggaacctacaagggtaacttcaaagcttgctgatggtgcctcagagagcctccagttgaggactacaattactgattcaatctaagtgcgggtaggaatcggt

SEQ ID NO: 4156 - DNA, 253 bp, Glycine max
  Clone ID: 700729301H1
tgctgatgagtcaacagggacaattggcaagcgtttggccagcatcagtgtagagaatgttgaatccaacaggcgtgctcttagggagctgcttttcaccgctcccggtgctcgtaaatatctcagtggtgtcatcctctttaaggaaactctctaccagagcacagctgcaggcaagccctttgtggaagtcttgaatgaggctggtgttcttcctggcatcaaggtttacagggcacagtttcgcttgctg

SEQ ID NO: 4157 - DNA, 228 bp, Glycine max
  Clone ID: 700726175H1
cggctcgagggtcacccccggatccaattctgctaaggtttcccctcaggtggttgcggagacactgttagagcccttcagagaaccgtgcctgctgcagttcctgctatcgttttcttgtctggtgggcagagtgaggaggaggcatccgttaacctcaatgccattaaccaggtcaatggaaagaagccatggtcactctctttctcctttggaagggcacttcaa

SEQ ID NO: 4158 - DNA, 252 bp, Glycine max
  Clone ID: 700966844H1
caacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttg

SEQ ID NO: 4159 - DNA, 245 bp, Glycine max
  Clone ID: 700960965H1
tttcttccaacctctcaagtccaacctacccctttttcttctcccaccaacttcaccgtctacttcctcgatcatgtctcacttcaagggcaagtaccatgatgagcttattgccaatgctgcttacttggcactcctggaaagggtattcttgctgctgatgagtcaacagggacaattggcaagcgtttggccagcatcagtgtagagaatgttgaatccaacaggcgtgctcttagggagct

SEQ ID NO: 4160 - DNA, 255 bp, Glycine max
  Clone ID: 700678326H1
atcatgtctcacttcaagggcaagtaccatgatgagcttatcgccaatgctgcgtacattggcactcctggaaagggtattcttgctgctgatgagtcaacagggacaattggcaagcgtatgccagcatcagtgtagagaacattgaatccaacaggcgagctcttagggagctgcttttcactgctccgggtgttcttcaatatctcagtggtgtcatcctctttgaggaaaccctctaccagagcacagctg

SEQ ID NO: 4161 - DNA, 233 bp, Glycine max
  Clone ID: 700751042H1
caacctctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttagccagcatcagtgtagagaatgttgaatccaacaggcgtgctcttag

SEQ ID NO: 4162 - DNA, 237 bp, Glycine max
  Clone ID: 700830863H1
ctttttcttctctctcaacaacttcaccttcttcctcctcgcatccgtctcacttcaagggcaagtaccatgatgagcttatcgccaatgctgcgtacattggcactcctggaaagggtattcttgaagctgatgagtcaacagggacaattggcaagcgtttggccagcatcagtgtagagaacattgaatccaacaggcgagctcttagggagctgcttttcactgctcctggtg

SEQ ID NO: 4163 - DNA, 243 bp, Glycine max
  Clone ID: 700870215H1
ctcctttggaagggcacttcaacagagcacccttaaggcatggggcggaaaataagagaatgtgaagaaggctcaggaagcccttttggtaagagccaaggctaactcagaggcaactctgggaccctacaagggtaactcacagcttgctgatggtgcctcagagagcctccatgtttcgaactacagctactgatcaatcgaagttggtgttgtttgaagagactagtgcgagtaggaatc

SEQ ID NO: 4164 - DNA, 237 bp, Glycine max
  Clone ID: 701213640H1
tctcgagccgattcggctcgagctaacctacctctttttcttctctcgcaacaacttcacctacttcctcctcgatcatgtcacacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgag

SEQ ID NO: 4165 - DNA, 249 bp, Glycine max
  unsure (1)...(249): unsure at all n locations
  Clone ID: 700658278H1
ctttcttccaacctctcaagtccaacctacccctttttcttctcncaccancttcaccgtcntcttcctcgancatgtctcacttcaagggcaagtaccatgtgagcttattgccaatgcnncttacattggcactcctggaaagggtattcttgctgctgatgagtcaacagggacaattggcaagcgtttggccagcatcagtgtagagaatgaatccaacaggcgtgctcttagggagctgctttt

SEQ ID NO: 4166 - DNA, 242 bp, Glycine max
  Clone ID: 700942532H1
cctctaacctacctctttagcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattcaatccaacaggcgagcttagggagctgcttttcactgct

SEQ ID NO: 4167 - DNA, 248 bp, Glycine max
  unsure (1)...(248): unsure at all n locations
  Clone ID: 700986276H1
cnttggaagggcacttcaacagagcacccttaaggcatgggacngaaaagaagagaatgtgaagnaggctcaggaagccctnntggtaagagccaaggctaactcanaggcaactctgggaacctacaagggtaactcacagcttgctgatggtgcctcagagagcctccatgtttcgaactaagctactgatcaatcgaagttggtgttgtttgaagagnctagtgcgagtaggaatcggtattatg

SEQ ID NO: 4168 - DNA, 243 bp, Glycine max
  Clone ID: 700870216H1
ctcctttggaagggcacttcaacagagcacccttaaggcatgaggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctattgtcaatcgagttgggggtggtttaagagacctagttcgagtaggaatcg

SEQ ID NO: 4169 - DNA, 261 bp, Glycine max
  Clone ID: 700899828H1
gaagaaggctcaggaagcccttttggtaagagccaaggccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgactcttcccagaataataatcgtttggaattttgctttttgtttttcctagtg

SEQ ID NO: 4170 - DNA, 253 bp, Glycine max
  Clone ID: 700678816H1
cggctcgagcggctcgagcggctcgagaacctacctctttttcttctctctcaacaacttcaccttcttccacctcgataatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagct

SEQ ID NO: 4171 - DNA, 260 bp, Glycine max
  Clone ID: 700666809H1
aacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgata

SEQ ID NO: 4172 - DNA, 257 bp, Glycine max
  unsure (1)...(257): unsure at all n locations
  Clone ID: 701098073H1
aagcaacctctaacctacctctttttcttctctctcaacaacttcaccttcttcactctcgatcatgacacacntcaaaggcaagtaccatgatgagcttatcgccaatgctgcgtacattggcactcctggaaagggcattcttgctgctgatgagtcaacagggacaattggcaagcgtttggccagcatcagtgtagagaacattgaatccacaggcgagctcttagggagctgcttttcactgctcctggtgt

SEQ ID NO: 4173 - DNA, 263 bp, Glycine max
  unsure (1)...(263): unsure at all n locations
  Clone ID: 700669492H1
ggagaatgtgaagaaggctcaggaagcccttttggtaagagccaaggccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgactcttcccagaataataatcgtttggaatttncctttggnttccc

SEQ ID NO: 4174 - DNA, 260 bp, Glycine max
  unsure (1)...(260): unsure at all n locations
  Clone ID: 700975340H1
ctctaacctacctctttttcttctctctcaacnacttcancttcttcctcctgcgatcatgtctcacttcaagggcaagtacnatgacngagcttatcgccaatgctgcgtacattggcactcctggaaagggtattcttgctgctgatgagtcaanagggacaattggcaagcgtttggccagcatnngtgtanngaanattgaatccaacaggcgagctcttagggagctgcttttcactgctcctggtgttcttcaa

SEQ ID NO: 4175 - DNA, 221 bp, Glycine max
  Clone ID: 700753528H1
gatggctctcatgacattcacaagtgtgctgccgtcaccgagcgtgtccttgcagcatgctacaaggctttgaatgatcaccacgtccttcttgagggtaccctattgaagccaaacatggtcacccccggatccaattctgctaaggtttcccctcaggtggttgcggagacactgttagagcccttcagagaaccgtgcctgctgcagttcctgctatc

SEQ ID NO: 4176 - DNA, 262 bp, Glycine max
  Clone ID: 700665923H1
ccaactcagaggcaactctgggaacctacaagggtaactcaaagcttgctgatggtgcctcagagagcctccatgttgaggactacaagtactgatcaatctaagtgcgggtaggaatcggtattttatgggtacaaccgaattttcttgttaatgagtattgtgcttcgactcttcccagaataataatcgtttggaattttgctttttgttttcctagtgttccttcatatcaattttagtaattcggtgtattggtcaa

SEQ ID NO: 4177 - DNA, 145 bp, Glycine max
  Clone ID: 701038320H1
cgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggca

SEQ ID NO: 4178 - DNA, 239 bp, Glycine max
  Clone ID: 700755605H1
gctcaggaagcccttttggtaagagccaaggccaactcagaggcaactctgggaagctacaagggtaactcaaagcttgctgatggtgcctcagagagctccatgttgaggactacaagtactgatcaatctaagtgcgggtaggaatcggtattttatgggtacaaccgaattttcttgttaatgagtattgtgcttcgactcttcccagaataataatcgtttggaattttgctttt

SEQ ID NO: 4179 - DNA, 238 bp, Glycine max
  Clone ID: 700890349H1
tccaacctctcaagtccaacctacccctttttctgctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttaggga

SEQ ID NO: 4180 - DNA, 210 bp, Glycine max
  unsure (1)...(210): unsure at all n locations
  Clone ID: 700669817H1
ctttcttccaacctctcaagtccaacctaccccttnttcttctcccaccaacttcaccgtnnttcttcctcgatcatgtctcacttcaagggcaagtaccatgatgagcttattgccaatgctgcttacattggcactcctggaaagggattcttgctgctgatgagtcaacngggacatttggnagcgtttgccaagcnganatntaac

SEQ ID NO: 4181 - DNA, 263 bp, Glycine max
  Clone ID: 701097640H1
aacctctcaagtccaacctacccctttttcttctcccaccaacttcaccgtcttcttcctcgatcatgtctcacttcaagggcaagtaccatgatgagcttattgccaatgctgcttacattggcactcctggaaaggggtatcttgctgctgatgagtcaaccaggaccattggcaagcgttttgccaacatccgtgtagaagatgttgaattccacaaggcggctcctaaggaactggttttcaacggttcccgtgctcct

SEQ ID NO: 4182 - DNA, 271 bp, Glycine max
  Clone ID: 700562959H1
gagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgataagtattattgtggtttgactcttcccagaataatcgtttggaattt

SEQ ID NO: 4183 - DNA, 241 bp, Glycine max
  Clone ID: 700852454H1
acctacctctttttcttctctctcaacgacttcttcttcttcctcctctatcatgtcttacttcaagggcaagtaccatgatgagcttattgccaatgctgcgtacattggcagtcctggaaagggtattcttgctgctgatgagtcagcagggacagttggcaatcgtttggccacaatcagtgtagacgacattgtatccaacaggcgagctcttatggagctgcttttcactgctcct

SEQ ID NO: 4184 - DNA, 274 bp, Glycine max
  unsure (1)...(274): unsure at all n locations
  Clone ID: 701121443H1
ancnacctntntttcttctctctcaacaacttcanccggnttcctcntcnatcangtctcacntnaaggggcaagtacnatgntgagcttatcgccaatgctgcgtacattggcactcctggaaagggtattcttgctgctgatgngtcaacagggacaattggcaagcgtttggccagncatcagtgtagagaacattgaatccaacaggngnnctcttagggagcnggctttnactgctcctggnnatctcantnnnnnnntngtgtcgtcc

SEQ ID NO: 4185 - DNA, 228 bp, Glycine max
  Clone ID: 701118247H1
ctcaagtccagcctacccctttttcttctcccaccaacttcaccgtcttcttcctcgatcatgtctcacttcaagggcaagtaccatgatgagcttattgtcaatgctgcttacattggcactcctggaaagggtattcatgctgctgatgagtcaacagggacaattggcaagcgtttgtccagcatcagtgtaggcgatgttgaatccaacaggcgtgctcttagg

SEQ ID NO: 4186 - DNA, 112 bp, Glycine max
  Clone ID: 700665401H1
gtcccaacgagccatctgagctggctatccatgagaatgcctatggcttggccagatacgctgtcatatgccaggagaatggcctggttcccattgttgagcctgagatcct

SEQ ID NO: 4187 - DNA, 190 bp, Glycine max
  Clone ID: 700750038H1
gcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatt

SEQ ID NO: 4188 - DNA, 92 bp, Glycine max
  Clone ID: 700665414H1
ggccaactcagaggcaactctggggaacctacaagggtaactcaaagcttgctgatggtgcctcagagagcctccatgttgaggactacaag

SEQ ID NO: 4189 - DNA, 232 bp, Glycine max
  Clone ID: 700889072H1
ggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgggtacaacaaccgaatttcttgttgataagtattattgtggtttgactcttcccagaataatcgtttggaattttgctt

SEQ ID NO: 4190 - DNA, 148 bp, Glycine max
  Clone ID: 700727964H1
ctctaacctacctctttttcttctctctcaacaacttcaccttcttcctcctcgatcatgtctcacttcaagggcaagtaccatgatgagcttatcgccaatgctgcgtacattggcactcctggaaaggctgtctggccacagactt

SEQ ID NO: 4191 - DNA, 92 bp, Glycine max
  Clone ID: 700680648H1
cggctcgagagaatgttgaatccatcaggcggcgtcttagggagatgcttttaaccgctaccggtgatcttaaatatctcagtggtgtcatc

SEQ ID NO: 4192 - DNA, 144 bp, Glycine max
  Clone ID: 701044547H1
ctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagt

SEQ ID NO: 4193 - DNA, 152 bp, Glycine max
  unsure (1)...(152): unsure at all n locations
  Clone ID: 700649174H1
accacgtccttcttgagggtaccctattgaagccaaacatggtcacccccggatccaattctgctaagggttcccctcaggtggttgcggagacactgntagagccttcagagaaccgtgctgctgcagttctgtatcgtttcttgtctggt

SEQ ID NO: 4194 - DNA, 284 bp, Glycine max
  Clone ID: 701120682H1
gcgaactgttcccgctgctgttccggccattgtcttcttgtctggtgggcagagcgaggaggaggcaaccctcaacctcaacgccatgaacaagtcccagggaaagaagccgtggtccctttctttctcttttggaagggcacttcagcaaagcactctcaaggcatggggtgggaaagatgaaaacattaagaaggctcaggatgctttatttgccaggtgcaatgcaaactcacatgcaactttgggaacttacaaaggtgatgctacccttgctgagggtg

SEQ ID NO: 4195 - DNA, 283 bp, Glycine max
  unsure (1)...(283): unsure at all n locations
  Clone ID: 700993909H1
anagattcaacaatgggcctctggcttctgctactcttctncaagtcatctcctgttcttgacaagtgcgagtgggtctcaggccagacccttcgccaacctctcgtgagatgtaacccttcctcagcatcagctctcaccatcaaagctgcttcctatgctgacgagctcgtcaaaaccgccaaaacagtggctcaccggggcgtggtattttggcgatggatgagtcaaatgcaactgcgggaagcgtttggcatctattgggttagagaacacagaagta

SEQ ID NO: 4196 - DNA, 257 bp, Glycine max
  Clone ID: 700955490H1
ggttgcttggcggggataagattaaagattcaacaatggcctctgcttctgctactcttctcaagtcatctcctgttcttgacaagtgcgagtgggtcaaaggccagacccttcgccaacctctcgtgagtgtaacccttcctcagcatcagctctcaccatcaaagctgcttcctatgctgacgagctcgtcaaaaccgccaaaacagtggcctcaccggggcgtggtattttggcgatggatgagtcaaatgcaa

SEQ ID NO: 4197 - DNA, 240 bp, Glycine max
  unsure (1)...(240): unsure at all n locations
  Clone ID: 700682081H1
gcggggataagattagagattcactgtatngnctctgcttctgctactcgtctcaagtcatctcctgttcttgacaagtgcgggtgggtcagaggccagacccttcgccaacctctcgtgagatgtaacccttcctcagcatcagctctcaccatcaaagctgcttcctatgctgacgacgtcgtcaaaaccgccaaaacagtggcctcaccggggcgtggtattttggcgatggatgag

SEQ ID NO: 4198 - DNA, 280 bp, Glycine max
  unsure (1)...(280): unsure at all n locations
  Clone ID: 700988843H1
ggggataagattaaagattcaacaatggcctctgcttctgctactcttctcaagtcatctcctgttcttgacaagtgcgagtnggtcaaaggccagacccttcgccaacctctcgtgagatgtaacccttcctcagcatcagctctcaccatcaaagctgcttcctatgctgacgagctcgtcaaaaccggccaaaacagtgggcttcaccgggggncgtgggaatttgggngatggatgnngtcaanggcaaccttgggggaaggnntttggcntnnnt

SEQ ID NO: 4199 - DNA, 240 bp, Glycine max
  Clone ID: 700740531H1
cggggataagattaaagattcaacaatggcctctgcttctgctactcttctcaagtcatctcctgttcttgacaagtgcgagtgggtcaaaggccagacccttcgccaacctctcgtgagatgtaaccctccctcagcatcagctctcaccatcaaagctgcttcctatgctgacgagctcgtcaaaaccgccaaaacagtggcctcaccggggcgtggtattttggcgatggatgagtc

SEQ ID NO: 4200 - DNA, 174 bp, Glycine max
  Clone ID: 700790059H2
ataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttcctatgctgacgagc

SEQ ID NO: 4201 - DNA, 234 bp, Glycine max
  Clone ID: 700872670H1
aagattaaagattcaacaatggcctctgcttctgctactcttctcaagtcatctcctgttgttgacaagtgcgagtgggtcaaaggccagacccttcgccaacctctcgtgagatgtaacccttcctcagcatcagctctcaccatcaaagctgcttcctatgctgacgagctcgtcaaaaccgccaaaacagtggcctcaccggggcgtggtattttggcgatggatgagtca

SEQ ID NO: 4202 - DNA, 186 bp, Glycine max
  unsure (1)...(168): unsure at all n locations
  Clone ID: 700990591H1
cggggataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcanagctgcttcctatgctgacgagancgnnaa

SEQ ID NO: 4203 - DNA, 175 bp, Glycine max
  Clone ID: 700743120H1
cggggataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttcctatgctgac

SEQ ID NO: 4204 - DNA, 168 bp, Glycine max
  Clone ID: 700994931H1
cggggataagattaaagattcaacaatggcctctgcttctgctactcttctcaagtcatctcctgttcttgacaagtgcgagtgggtcaaaggccagacccttcgccaacctctcgtgagatgtaacccttcctcagcatcagctctcaccatcaaagctgcttccta

SEQ ID NO: 4205 - DNA, 120 bp, Glycine max
  Clone ID: 700738074H1
atcggtttcccgccatatatccaataagctttaaccatgtctgcctttgttggaaagtacgcagatgagcttatcaagaatgccaagtacatagccacacctgggaagggcatcttggca

SEQ ID NO: 4206 - DNA, 256 bp, Glycine max
  Clone ID: 701126904H1
caaagctcaacaccttgtcttcccagtggctcgcccacaattccttctctcctcgccgtggatcctcttctcgccgagtctctcttccgatccgcgcttcttcttaccaacacgaactcttccaaaccgccaaatctattgcatctcccggtcgtggaattcttgcaattgatgaatcaaatgccacatgtgggaagcgtttagcatccattggattggacaatactgaggtgaatcgccaggcctataggcaact

SEQ ID NO: 4207 - DNA, 280 bp, Glycine max
  unsure (1)...(280): unsure at all n locations
  Clone ID: 700668532H1
accactttctgtttctcttcactctaatggccatggcagcgtctncaaagctcaacaccttgtcttcttcccagtggatcgcccacaattccttctctcctcgccgtggatcctcttctcgccgagtctctcttccgatccgcgcttcttcttaccaacacgaactcgtccaaaccgccaaatccattgcatcacccggccgtggaattcttgcaattgatgaatcaaatgccacatgtgggaaacgattagcatccattggattggacaataccgaggt

SEQ ID NO: 4208 - DNA, 166 bp, Glycine max
  unsure (1)...(166): unsure at all n locations
  Clone ID: 700666028H1
gncgtggatcctcttctcgccgagtctctcttccgatccgcgcttcttcttaccaacacgaactcgtccaaaccgccaaatctattgcatctcccggtcgtggaattcttgcaattgatgaatcaaatgccacatgtgggaagcgtttagcatccattggattgga

SEQ ID NO: 4209 - DNA, 262 bp, Glycine max
  Clone ID: 701009915H2
actttctgtttctcttcactctaatggccatggcagcgtctgcaaagctgcacaccttgtcttcttcccagtggatcgcccacaattccttctctcctcgccgtggatcctcttctcgccgagtctctcttccgatccgcgcttcttcttaccaacacgaactcgtccaaaccgccaaatccattgcatcacccggccgtggaattcttgcaattgatgaatcaaatgccacatgtgggaaacgattagcatccattggatt

SEQ ID NO: 4210 - DNA, 268 bp, Glycine max
  Clone ID: 700943660H1
ctttctctttctcttcactctaaagtctaagcatccatggccatggcgtctgcaaagctcaacaccttgtcttcccagtggatcgcccacaattccttctctcctcgccgtggatcctcttctcgccgagtctctcttccgatccgcgcttcttcttaccaacacgaactcgtccaaaccgccaaatctattgcatctcccggtcgtggaattcttgcaattgatgaatcaaatgccacatgtgggaagcgtttagcatccattggat

SEQ ID NO: 4211 - DNA, 262 bp, Glycine max
  Clone ID: 701100047H2
ctctaagcatccatggccatggcgtctgcaaagctcaacaccttgtcttcccagtggatcgcccacaattccttctctcctcgccgtggatcttcttctcgctgagttctgtcttccgatccgcgcttcttcttaccaacacgaactcgtccaaaccgccagatctattgcatctcccggtcgtggaattcttgcaattgatgaatcaaatgccacatgtgggaagcgtttagcatccattggattggacaatactgaggtg

SEQ ID NO: 4212 - DNA, 187 bp, Glycine max
  Clone ID: 700794458H1
gcaaagctcaacaccttgtcttcttcccagtggatcgcccacaattccttctctcctcgccgtcgatcctcttctcgccgagtctctcttccgatccgcgcttcttcttaccaacacgaactcttccaaaccgccaaatccattgcatcacccggccgtggaattcttgcaattgatgaatccaaat

SEQ ID NO: 4213 - DNA, 246 bp, Glycine max
  Clone ID: 700738441H1
tacagccccactttctctttctctttctcttcactctaaagtctaagcatccatggccatggcgtctgcaaagctcaacaccttgtcttcccagtggatcgcccacaattccttctctcctcgccgtggatcctcttctcgccgagtctctcttccgatccgcgcttcttcttaccaacacgaactcgtccaaaccgccaaatctattgcatctcccggtcgtggaattcttgcaatggatgaatc

SEQ ID NO: 4214 - DNA, 289 bp, Glycine max
  Clone ID: 700984050H1
ctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaagacagcttcaggaaaacccttc

SEQ ID NO: 4215 - DNA, 284 bp, Glycine max
  Clone ID: 701014509H1
cctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcggaatgttgaagcaaataggcgtgctcttcgtgaactcctattcaccacacctggtgcttttgagtgcctcagtggtgtgatcttgtttgaggaaaccctataccaaaagacagcttcaggaaaacccttcgtaga

SEQ ID NO: 4216 - DNA, 290 bp, Glycine max
  Clone ID: 701138819H1
cttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaa

SEQ ID NO: 4217 - DNA, 264 bp, Glycine max
  unsure (1)...(264): unsure at all n locations
  Clone ID: 700977309H1
cctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctnttcaccacacctggtgcttttgagtgcctcagtggtgtgatcttgtttgaggaaaccctatacc

SEQ ID NO: 4218 - DNA, 264 bp, Glycine max
  Clone ID: 700984876H1
caattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaggaaaccctataccaaaaga

SEQ ID NO: 4219 - DNA, 274 bp, Glycine max
  Clone ID: 701046151H1
gtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgctttagagtgcctcagtggtgtgatct

SEQ ID NO: 4220 - DNA, 280 bp, Glycine max
  Clone ID: 700976571H1
ccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatctt

SEQ ID NO: 4221 - DNA, 240 bp, Glycine max
  Clone ID: 700889668H1
cctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtga

SEQ ID NO: 4222 - DNA, 277 bp, Glycine max
  Clone ID: 701045371H1
cgatgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatc

SEQ ID NO: 4223 - DNA, 266 bp, Glycine max
  Clone ID: 700548283H1
ccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctc

SEQ ID NO: 4224 - DNA, 260 bp, Glycine max
  Clone ID: 701103461H1
cttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctca

SEQ ID NO: 4225 - DNA, 247 bp, Glycine max
  Clone ID: 700898446H1
cgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacct

SEQ ID NO: 4226 - DNA, 272 bp, Glycine max
  Clone ID: 701006432H1
cctcgagcgaatcggctcgagcgttgtcttctcacttcgtcaacgaccaaccaaacccctccccaattctcaagccaaccatgtcgtccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggt

SEQ ID NO: 4227 - DNA, 263 bp, Glycine max
  Clone ID: 701041476H1
cgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcc

SEQ ID NO: 4228 - DNA, 299 bp, Glycine max
  unsure (1)...(299): unsure at all n locations
  Clone ID: 700568335H1
gtcttcnnanttcgtcaaaaccaaccaaacccctccccaattctcaagccaaccatgtntcnccttcaagagcaagtacnaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcatggtgtgatcttgtttgaggaaaccctataccaaaa

SEQ ID NO: 4229 - DNA, 235 bp, Glycine max
  Clone ID: 701046312H1
ttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctatccacca

SEQ ID NO: 4230 - DNA, 261 bp, Glycine max
  Clone ID: 701050171H1
cgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtg

SEQ ID NO: 4231 - DNA, 256 bp, Glycine max
  Clone ID: 700685063H1
ctcgagccgcgttgtcttctcacttcgtcaaaaccaaccaaagcactccccaattctcaagccaaccatgtcgtccttcaagagcaagtaccaagatgaactcattgccaatgctgcttacattggcaccccagggaagggtatccttgctgctgatgagtcagctggtacaattggcaagcgaggggccagcattaatgtcgagaatgttgaagcagataggcgtgctctgcgtgaactcctattcaccacacct

SEQ ID NO: 4232 - DNA, 216 bp, Glycine max
  Clone ID: 701010250H2
agaaccgttgtcttctcacttcgtcaaaaccaaccaaacccctccccaattctcaagccaaccatgtcttccttcaagagcaagtaccaagatgaactcattgccaatgctgcttacattggcaccccagggaagggtatccttgctgctgatgagtcaactggtacaattggaaagcgattggccagcattaatgtcgagaatgttgaaccaata

SEQ ID NO: 4233 - DNA, 212 bp, Glycine max
  unsure (1)...(212): unsure at all n locations
  Clone ID: 700665454H1
ccgttgtnttctcacttcgtcanaaccaaccaaacccctccccaattctcaagccaaccatgtcttccttcaagagcangtaccaagntgaactcattgccaatgctgctnacattggcaccccagggaagggtatccttgctgctgatgngtcaactggtacaattggcaagcgattggccagcattantgtcgagnntgttgaagcaaat

SEQ ID NO: 4234 - DNA, 147 bp, Glycine max
  Clone ID: 701043888H1
ccaattctcaagccaaccatgtcttccttcaagagcaagtaccaagatgaactcattgccaatgctgcttacattggcaccccagggaagggtatccttgctgctgatgagtcaactggtacaattggcaagcgattggccagcatt

SEQ ID NO: 4235 - DNA, 276 bp, Glycine max
  Clone ID: 700726806H1
caaggttgaacatcatcacattcgtacaacaaccaaccaaacccctccacaattctcagccaaccatgtcttccttcacaagcaagtaccaagatgaactcattgccaatgctgcttacattggcaccccagggaagggtctccttgctgctgatgaatcactggtacaattggcaagcgcttggccagcattaatgtcgagaatgttgaagcacataggcgtgctcttcgtgaactcctattcaccacacctggtgcttttgagtgcctcagtgg

SEQ ID NO: 4236 - DNA, 272 bp, Glycine max
  unsure (1)...(272): unsure at all n locations
  Clone ID: 700997879H1
gcctctgcatcagcatctctgctcaagtcttcacttgttcttgacaagtctgantgggtgaagggacaaanccttcgccaaccttctgcatcagttgtnagatgcaaccccaccaccccatcaggcctcaccatcagagctggttcctatgctgatgagctcgttaagaccgcgaaaacagtggcttcaccagggaggggtattttggccatggatgantccaatgctacctgtgggaagcgtttggcttcaattgggctagagaacactga

SEQ ID NO: 4237 - DNA, 295 bp, Glycine max
  Clone ID: 700646208H1
tgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtccaatgctacctgtgggaagcgtttggcttcaattg

SEQ ID NO: 4238 - DNA, 286 bp, Glycine max
  Clone ID: 700559796H1
gcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtccaatgctacctgtgggaagcgtttggcttcattgggctagagacatgaagct

SEQ ID NO: 4239 - DNA, 229 bp, Glycine max
  Clone ID: 700789784H1
catctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtccaatgctacctgtgggaagcg

SEQ ID NO: 4240 - DNA, 263 bp, Glycine max
  Clone ID: 700683122H1
gacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaccagtggcttcaccagggaggggtattatggccatggatgagtccaatgctacctgtgggaagcgtttggcttcaattgggctagagaacactgaagctaaccgccagcataccgtaccctcctt

SEQ ID NO: 4241 - DNA, 274 bp, Glycine max
  Clone ID: 701105914H1
gcagtagtgctaagtgctaacacctgcagtgaacaatggcctctgcatcagcatctctgctcaagtcttcacttgttcttgccaagtctgagtgggtgaagggacaaacccttcgccaaccttctgcatcagttgtcagatgcaaccccaccaccccatcaggcctcaccatcagagctggttcctatgctgatgagctcgttaagaccgcgaaaacagtggcttcaccagggaggggtattttggccatggatgagtccactgctacctgtgg

SEQ ID NO: 4242 - DNA, 293 bp, Glycine max
  unsure (1)...(293): unsure at all n locations
  Clone ID: 700558789H1
tacaaaggntgctgtaggagataagattncagtagtgctaagtgctaacacctgcagtgaacantggcctctgcatcagcatctctgctcaagtcttcacttgttcttgacaagtctgagtgggtgaagggncaaacccttcgccaaccttctgcatcagttgtgagntgcaaccccaccaccccatcaggcctcaccatcagagctggttcctatgctgatgagctcgttaagaccgcgaaaacagtggcttcaccaaggaggggtattttggccatggntgagtccaatgc

SEQ ID NO: 4243 - DNA, 265 bp, Glycine max
  Clone ID: 700873051H1
gattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgagtcca

SEQ ID NO: 4244 - DNA, 282 bp, Glycine max
  Clone ID: 700684010H1
aaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatggatgag

SEQ ID NO: 4245 - DNA, 251 bp, Glycine max
  Clone ID: 700786096H2
tagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggacatggatg

SEQ ID NO: 4246 - DNA, 273 bp, Glycine max
  Clone ID: 700731865H1
cggctcgagggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatgg

SEQ ID NO: 4247 - DNA, 286 bp, Glycine max
  Clone ID: 701108111H1
cagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggcggggtattcctcccatggatgagctcaatgctccctgtgggaagcg

SEQ ID NO: 4248 - DNA, 272 bp, Glycine max
  Clone ID: 700740887H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttgg

SEQ ID NO: 4249 - DNA, 280 bp, Glycine max
  Clone ID: 700559579H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttggccatgg

SEQ ID NO: 4250 - DNA, 284 bp, Glycine max
  Clone ID: 700996104H1
aaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggttcaccagggaggggtattttggccatggatgagtcca

SEQ ID NO: 4251 - DNA, 274 bp, Glycine max
  Clone ID: 700682145H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattttgg

SEQ ID NO: 4252 - DNA, 252 bp, Glycine max
  Clone ID: 700737263H1
aggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggt

SEQ ID NO: 4253 - DNA, 269 bp, Glycine max
  Clone ID: 700547963H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggtattt

SEQ ID NO: 4254 - DNA, 256 bp, Glycine max
  Clone ID: 700686296H1
ctcgagccgataagattgcagtagtgctaagtgctaacacctgcagtgaacaatggcctctgcatcagcatctctgctcaagtcttcacttgttcttgacaagtctgagtgggtgaagggacaaacccttcgcaaccttctgcatcagttgtgagatgcaaccccaccaccccatcaggcctcaccatcagagctggttcctatgctgatgagctcgttaagaccgcgaaaacagtggcttcaccagggaggggta

SEQ ID NO: 4255 - DNA, 273 bp, Glycine max
  Clone ID: 700646072H1
ggctcatacaaaggttgctgaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggta

SEQ ID NO: 4256 - DNA, 262 bp, Glycine max
  Clone ID: 701106662H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggagg

SEQ ID NO: 4257 - DNA, 262 bp, Glycine max
  Clone ID: 700684335H1
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggag

SEQ ID NO: 4258 - DNA, 268 bp, Glycine max
  Clone ID: 701000609H1
catacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggagggg

SEQ ID NO: 4259 - DNA, 267 bp, Glycine max
  Clone ID: 700685658H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccacgccatcaggcctcaccatcagagctggttcctatgctgatgagctcgttaagaccgcgaaaacagtggcttcaccagggaggggt

SEQ ID NO: 4260 - DNA, 248 bp, Glycine max
  Clone ID: 700875532H1
gattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttatcaccgcgaaaacagtggcttcaccagggaggggtatttt

SEQ ID NO: 4261 - DNA, 258 bp, Glycine max
  Clone ID: 700685813H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcacca

SEQ ID NO: 4262 - DNA, 249 bp, Glycine max
  Clone ID: 700872948H1
aggttgctgtaggagataagattgcagtagtgctaagtgctaatgcctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttc

SEQ ID NO: 4263 - DNA, 258 bp, Glycine max; identical to SEQ ID NO: 4261
  Clone ID: 700730264H1

SEQ ID NO: 4264 - DNA, 257 bp, Glycine max
  Clone ID: 701104554H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccag

SEQ ID NO: 4265 - DNA, 256 bp, Glycine max
  Clone ID: 700960601H1
tacaaatgttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcac

SEQ ID NO: 4266 - DNA, 253 bp, Glycine max
  Clone ID: 700876633H1
ggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccag

SEQ ID NO: 4267 - DNA, 273 bp, Glycine max
  Clone ID: 700739662H1
tacaaaggttgctgtaggagataagattgcagtagtgctaagtgctaacacctgcagtgtacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagatggcgaaaacagtggcttcaccagggaggggtattttg

SEQ ID NO: 4268 - DNA, 265 bp, Glycine max
  Clone ID: 700685904H1
aaaggttgctgtaggagataagattgcagtagtgctaagtgctaacacctgcagtgaacaatggcctctgcatcagcatctctgctcaagtcttcacttgttcttgacaagtctgattgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccagggaggggta

SEQ ID NO: 4269 - DNA, 265 bp, Glycine max
  unsure (1)...(265): unsure at all n locations
  Clone ID: 700995183H1
ctaaggtttnctgtaggagataagattgcagtagagctaagtgctaacacctgcagtgaacaatggcctctgcatcagcatctctgctcaagtcttcacttgttcttgacaagtctgagtgggtgaagggacaaacccttcgccaaccttctgcatcagttgngagatgcaaccccaccaccccatcaggcctcaccatcagagctggttcctatgctgatgagctcgttaagaccgcgaaaacagtggcttcaccagggagggg

SEQ ID NO: 4270 - DNA, 257 bp, Glycine max
  Clone ID: 700901996H1
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcacca

SEQ ID NO: 4271 - DNA, 265 bp, Glycine max
  Clone ID: 700727070H1
caaaggttgctgtaggagataagattgcagtagtgctaagtgctaacacctgcagtgaacaatggcctctgcatcagcatctctgctcaagtcttcagttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccatggaggggt

SEQ ID NO: 4272 - DNA, 255 bp, Glycine max
  Clone ID: 700685790H1
atacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttc

SEQ ID NO: 4273 - DNA, 264 bp, Glycine max
  unsure (1)...(264): unsure at all n locations
  Clone ID: 700998652H1
caaaggttgctgtaggagataagattgcagtagtgctaagtgctaacacctgcagtgaacaatggccttctgcatcagcatctctgctcaagtcttcacttgttcttgacaagtctgagtgggtgaagggacaaacccttcgccaaccttctgcatcagttgtgagatgcaaccccaccaccccatcaggcctcnncatcagagctggttcctatgctgatgagctcgttaagaccgcgaaaacagtggcttcaccanggaggg

SEQ ID NO: 4274 - DNA, 250 bp, Glycine max
  Clone ID: 700740465H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggct

SEQ ID NO: 4275 - DNA, 250 bp, Glycine max; identical to SEQ ID NO: 4274
  Clone ID: 700682621H2

SEQ ID NO: 4276 - DNA, 246 bp, Glycine max
  Clone ID: 700874316H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagt

SEQ ID NO: 4277 - DNA, 252 bp, Glycine max
  Clone ID: 700686477H1
acaaaggttgctgtaggagataagattgcagtagtgctaagtgctaacacctgcagtgaacaatggcctctgcatcagcatctctgctcaagtcttcacttgttcttgacaagtctgagtgggtgaggggacaaacccttcgccaaccttctgcatcagttgtgagatgcaaccccaccaccccatcaggcctcaccatcagagctggttcctatgctgatgagctcgttaagaccgcgaaaacagtggctt

SEQ ID NO: 4278 - DNA, 248 bp, Glycine max
  Clone ID: 700739979H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagt

SEQ ID NO: 4279 - DNA, 260 bp, Glycine max
  Clone ID: 700739416H1
caaaggttgctgtaggagataagattgcagtagtgcaaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccaggga

SEQ ID NO: 4280 - DNA, 254 bp, Glycine max
  Clone ID: 700685976H1
caaaggttgctgtaggagataagattgcagtagtgctaagtgctaacacctgcagtgaacaatggcctctgcatcagcatctctgctcaagtcttcacttgttcttgacaagtctgagtgggtgaagggaaaacccttcgccaaccttctgcatcagttgtgagatgcaaccccaccaccccatcaggcctcaccatcagagctggttcctatgctgatgagctcgttaagaccgcgaaaacagtggcttcacc

SEQ ID NO: 4281 - DNA, 258 bp, Glycine max
  Clone ID: 700739629H1
acgttgctgtaggagataagattgcagtagtgctaagtgctaacacctgcagtgaacaatggcctctgcatcagcatctctgctcaagtcttcacttgttcttgacaagtctgagtgggtgacgggacaaacccttcgccaaccttctgcatcagttgtgagatgcaaccgcaccaccccatcaggcctcaccatcagagctggttcctatgctgatgatctcgttaggaccgcgacaacagtggcttcaccagggag

SEQ ID NO: 4282 - DNA, 267 bp, Glycine max
  unsure (1)...(267): unsure at all n locations
  Clone ID: 700989163H1
gcagtagcgctangtgctaacacctgcagtgaacaatggcctctgcatcagcatctctggtncaagtcttcacttgttcttgacaagtctgngtgggtgaagggacaaacctttcgccaaccttctgcatcagttgtgagatgcaaccccaccaccccatcaggcctcaccatcagagntggttcctatgctgatgagctcgttaagaccgcgaaaacagtggcttcaccncggaggggtattttggcctggntgagtccaatgcnc

SEQ ID NO: 4283 - DNA, 270 bp, Glycine max
  unsure (1)...(270): unsure at all n locations
  Clone ID: 701000555H1
acaaaggnngctgtaggagataagattgcagtagtgctangtgctaacacctgcagtgaacaatggcctctgcatcagcatctgctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcaccanggaggggtatt

SEQ ID NO: 4284 - DNA, 273 bp, Glycine max
  Clone ID: 700872702H1
acgcgttcggctcgagattgcagtagtgctaagtgctaacacctgcagtgtacaatggcctctgcatcagcatctctgctcaagtcttcacttgttcttgacaagtctgagtgtgtgaagggacaaacccttcgccaaccttctgcatcagttgtgagatgcaaccccaccaccccatcaggcctcaccatcagagctggttcctatgctgatgagctcgttaagaccgcgaaaacagtggcttcacctcggaggggtattttggccatggat

SEQ ID NO: 4285 - DNA, 255 bp, Glycine max
  Clone ID: 701000781H1
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacgtggcttcacc

SEQ ID NO: 4286 - DNA, 265 bp, Glycine max
  unsure (1)...(265): unsure at all n locations
  Clone ID: 700682760H1
cggctcgagcaaaggttgctgtaggagataagattgcagttcatgctaagtgctaacacctgcagtgaacaatggcctctgcatcagaatctctgnctcagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttcacc

SEQ ID NO: 4287 - DNA, 241 bp, Glycine max
  Clone ID: 700740390H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcga

SEQ ID NO: 4288 - DNA, 266 bp, Glycine max
  Clone ID: 700685346H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccctacaaccccatcaggcctcaccatcagagctggttcctatgctgatgagctcgttaagaccgcgaaaacagtggcttcaccagggaggggtt

SEQ ID NO: 4289 - DNA, 277 bp, Glycine max
  Clone ID: 700557272H1
taagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagtgcaaccccaccaccccatcaggcctcaccatcagagctggttctatgctgatgagctcgttaagaccgcgaaaacagtggttcaccagggaggggtattttggccatggatgagtccatgctacctgtgg

SEQ ID NO: 4290 - DNA, 261 bp, Glycine max
  Clone ID: 700953343H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgagagctcgttaagaccgcgaaaacagtggcttcaccaggga

SEQ ID NO: 4291 - DNA, 237 bp, Glycine max
  Clone ID: 700741960H1
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccg

SEQ ID NO: 4292 - DNA, 258 bp, Glycine max
  Clone ID: 700680247H2
gttgctgtaggagataagattgcagtagtgctaagtgctaacacctgcagtgaacaatggcctctgcatcagcatctctgctcaagtcttcacttgtacttgacaagtctgagtgggtgaagggacaaacccttcgccaaccttctgcatcagttgtgagatgcaaccccaccattacatcaggcacaccatcagagctggttcctatgctgatgagctcgttaagaccgcgttaacagtagcttcaccatggagggg

SEQ ID NO: 4293 - DNA, 277 bp, Glycine max
  Clone ID: 700680002H2
acaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaagaccgcgaaaacagtggcttcaccagggagggg

SEQ ID NO: 4294 - DNA, 258 bp, Glycine max
  Clone ID: 700684827H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctggcatcagttgtgagatgcaaccccaccaccccatcaggcctcaccatcagagctggttcctatgctgatgagctcgttaagaccgcgaaaacagtggcttcacc

SEQ ID NO: 4295 - DNA, 234 bp, Glycine max
  Clone ID: 700956353H1
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaaga

SEQ ID NO: 4296 - DNA, 247 bp, Glycine max
  Clone ID: 700787513H1
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaaga

SEQ ID NO: 4297 - DNA, 260 bp, Glycine max
  Clone ID: 700725070H1
caactacaaaggttgctgtaggagataagatattgaagtagtgctaagtgcctaacacctgcagtgaacaatggcctctgcatcagcatcttttctcaagtcttcatatgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaacagtgg

SEQ ID NO: 4298 - DNA, 259 bp, Glycine max
  Clone ID: 700741111H1
ctcatacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagctcgttaagaccgcgaaaacagtggcttca

SEQ ID NO: 4299 - DNA, 238 bp, Glycine max
  Clone ID: 700738230H1
ggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccg

SEQ ID NO: 4300 - DNA, 278 bp, Glycine max
  unsure (1)...(278): unsure at all n locations
  Clone ID: 700985308H1
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttccctatgctgatgagctcgttaagaccgcgaaaacagtggcttnaccagggaggggt

SEQ ID NO: 4301 - DNA, 260 bp, Glycine max
  unsure (1)...(260): unsure at all n locations
  Clone ID: 700991396H1
ctacaaaggttgctgtaggagataagattgcagtagtgctaagtgctaacacctgcagtgancaatggcctctgcatcagcatctctgctcaagtcttcacttgtncttgacaagtctgagtgggtgaagggacaaacccttcgccaaccttctgcntcagtngtgagatgcaaccccaccaccccatcaggcctcaccatcaganctggttcctatgctgatgagtcgttaagaccgcgaaaacagtggttcnccaggg

SEQ ID NO: 4302 - DNA, 223 bp, Glycine max
  Clone ID: 700741276H1
aaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgatgagc

SEQ ID NO: 4303 - DNA, 243 bp, Glycine max
  Clone ID: 700740223H1
aactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaag

SEQ ID NO: 4304 - DNA, 245 bp, Glycine max
  Clone ID: 700738808H1
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaaga

SEQ ID NO: 4305 - DNA, 273 bp, Glycine max
  Clone ID: 700997995H1
gcaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatggctgatgagctcgttaagaccgcgaaaacagtggcttcaccaggg

SEQ ID NO: 4306 - DNA, 263 bp, Glycine max
  unsure (1)...(263): unsure at all n locations
  Clone ID: 700989713H1
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctgnttcctatgctgatncagctcgttaagaccgcgaaaacagtgg

SEQ ID NO: 4307 - DNA, 245 bp, Glycine max
  Clone ID: 700875139H1
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcacaatcagagctggttcctatgctgatgagctcgttaa

SEQ ID NO: 4308 - DNA, 245 bp, Glycine max
  Clone ID: 700958366H1
gcatacaactacaaaggttgctgtaggagataagatattgaagtagtgctaagtgcctaacacctgcactgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgt

SEQ ID NO: 4309 - DNA, 220 bp, Glycine max
  Clone ID: 700683887H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctg

SEQ ID NO: 4310 - DNA, 221 bp, Glycine max
  Clone ID: 700740788H1
cggctcgaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgct

SEQ ID NO: 4311 - DNA, 256 bp, Glycine max
  Clone ID: 700743058H1
caactacaaaggttgctgtaggagataagatattgaagtagtgctaagtgcctaacacctgcagtgaacaatggcctctgcatcagcatctcttctcaagtcttcacttgttcttgacaagtctagtgggtgaagggacaaacacttcgccaaccttctgctgcatcagttgtgagatgcaaccccaccaccccatcaggcctcaccatcagagctggttcctatgctgatgagctcgttaagaccgcgaaaacag

SEQ ID NO: 4312 - DNA, 288 bp, Glycine max
  unsure (1)...(288): unsure at all n locations
  Clone ID: 700996423H1
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaancttctgctgcatcagttgtgagatgcaaccccaccaccccatcagggccttcaccatcagagctggttccctatgctgatgagcnncgttaagaccgcgaaaacagtggcttcaccagggaggggtatttc

SEQ ID NO: 4313 - DNA, 236 bp, Glycine max
  Clone ID: 700686075H1
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatga

SEQ ID NO: 4314 - DNA, 240 bp, Glycine max
  Clone ID: 700738811H1
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacattcacttcgccaaccttctgctgcatcagttgtgagatgcaaccccaccaccccatcaggcctcacaatcagagctggttcctatgctgatgagctcgt

SEQ ID NO: 4315 - DNA, 254 bp, Glycine max
  unsure (1)...(254): unsure at all n locations
  Clone ID: 700998312H1
acaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgncgcatcagttgtgagatgcaancccaacaacccattcaggcctcaaaatcngagntggntcctatgcngatgagntcggcaagaccgcgaa

SEQ ID NO: 4316 - DNA, 260 bp, Glycine max
  Clone ID: 700681825H1
acaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaacagtg

SEQ ID NO: 4317 - DNA, 224 bp, Glycine max
  Clone ID: 701109105H1
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcttcaccatcagagctggttgctatgctgatga

SEQ ID NO: 4318 - DNA, 239 bp, Glycine max
  Clone ID: 701203741H2
tacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaa

SEQ ID NO: 4319 - DNA, 220 bp, Glycine max
  Clone ID: 700740785H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggttcctatgctgat

SEQ ID NO: 4320 - DNA, 227 bp, Glycine max
  Clone ID: 700738486H1
atacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctcaccatcagagctggtccctatgctgatgagc

SEQ ID NO: 4321 - DNA, 252 bp, Glycine max
  Clone ID: 700739078H1
caactacaaaggttgctgtaggagataagatattgaagtagtgctaagtgcctaacacctgcagtgcacaatggcctctgcatcagcatctcttctcaagtcttcacttgttcttgacaagtctgagtgggtaagggacaaacacttcgccaaccttctgctgcatcagttgtgagatgcaaccccaccaccccatcaggcctcaccatcagagctggttcctatgctgatgagctcgtagaccgcgaaaac

SEQ ID NO: 4322 - DNA, 265 bp, Glycine max
  unsure (1)...(265): unsure at all n locations
  Clone ID: 701002287H1
caaaggttgctgtaggagataagattgcagtagtgcncagtgctaacacctgcagtgaacaatggcctctgcatcagcatctctgctcaagtcttcacttgttcttgacaagtctgagtgggtgaagggacaaacccttcgccaaccttctgcatcagttgtgagatgcaacccccaccaccccatcagggcctcaccatcngagctggttctatgctgatgagcncgttaaagaccgcggaaacnntgggtttcacnagggggg

SEQ ID NO: 4323 - DNA, 194 bp, Glycine max
  Clone ID: 700742470H1
caaaggttgctgtaggagataagaatgcagtagtgctaagtcctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccatcaggcctca

SEQ ID NO: 4324 - DNA, 191 bp, Glycine max
  Clone ID: 700743421H1
ctcatacaaaggttgctgtaggagataagattgcagtagtgctaagtgctaacaggtgcagtgaacaatggcctctgcatcagcatctctgctcaagtcttcacttgttcttgacaagtctgagtgggtgaagggacaaacccttcgccaaccttctgcatcagttgtgagatgcaaccccaccaccccat

SEQ ID NO: 4325 - DNA, 189 bp, Glycine max
  Clone ID: 700744039H1
catacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccaccccat

SEQ ID NO: 4326 - DNA, 236 bp, Glycine max
  Clone ID: 700789444H2
ctacaaaggttgctgtaggagataagatattgaagtagtgctaagtgcctaacacctgcagtgaacaatggcctctgcatcagcatctcttctcaagtcttcacttgttcttgacaagtctgagtgggtgagggacaaacacttcgccaaccttctgctgcatcagttgtgagatgcaaccccaccaccccatcaggcctcacaatcagagctggttcctatgctgatgagctcgt

SEQ ID NO: 4327 - DNA, 244 bp, Glycine max
  Clone ID: 700741074H1
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggcaaacacttcgccaaccttctgctgcatcagttgtgagatgcaaccccaccaccccatcaggcctcaccatcagagctggttcctatgctgatgagctcgttaaga

SEQ ID NO: 4328 - DNA, 130 bp, Glycine max
  Clone ID: 700998877H1
gtgctaagtgctaacacctgcagtgaacaatggcctctgcatcagcatctctgctcaagtcttcacttgttcttgacaagtctgagtgggtgaagggacaaacccttcgccaaccttctgcatcagttgt

SEQ ID NO: 4329 - DNA, 260 bp, Glycine max
  Clone ID: 700740005H1
tacaactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcaccatcagagctggttcctatgctgatgagctcgttaagaccgcgaaaacagt

SEQ ID NO: 4330 - DNA, 269 bp, Glycine max
  Clone ID: 700872703H1
tcggattctgctcgaggtgaacaatggcctctgcatcagcatctcttctcaagtcttcacttgttcttgactagtttgagtgcgtgaagggacaaacacttcgccaaccttctgctgcatcagttgtgagatgcaaccccaccactccttcaggcctcaccatcagagctgtttcctatgctgatgagctctttaagaccgcgaaaacagtggcttcacctcggaggggtattttggccatgtctgagtccactgctccctgttcgaag

SEQ ID NO: 4331 - DNA, 189 bp, Glycine max
  unsure (1)...(189): unsure at all n locations
  Clone ID: 700990557H1
caactacaaaggttgctgtaggaganaagatattgaagtagtgctaagtgcctaacacctgcagtgaacaatngcctctgcatcagcatctcttctcaagtcttcacttgttcttgacaagtctgagtgggtgaagggacaaacacttcgccaaccttctgctgcatcagttgtgagangcaaccccac

SEQ ID NO: 4332 - DNA, 170 bp, Glycine max
  unsure (1)...(170): unsure at all n locations
  Clone ID: 701001909H1
caactacaaaggttgctgtaggagataagatattgaagtantgctaagtgcctaacacctgcagtgaacaatggcctctgcatcagcatctcttctcaagtcttcacttgttcttgacaagtctgagtgggtgaagggacaaacacttcgccaaccttctgctgcatcag

SEQ ID NO: 4333 - DNA, 165 bp, Glycine max
  Clone ID: 700875039H1
caaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgag

SEQ ID NO: 4334 - DNA, 199 bp, Glycine max
  Clone ID: 700743495H1
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatca

SEQ ID NO: 4335 - DNA, 197 bp, Glycine max
  Clone ID: 700743995H1
ggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcac

SEQ ID NO: 4336 - DNA, 197 bp, Glycine max
  Clone ID: 700743301H1
aaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcct

SEQ ID NO: 4337 - DNA, 192 bp, Glycine max
  Clone ID: 700742515H1
ctacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccacccc

SEQ ID NO: 4338 - DNA, 273 bp, Glycine max
  unsure (1)...(273): unsure at all n locations
  Clone ID: 701001445H1
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggaaaacacttcgccaaccttctgctgcatcagttgtgagatgcaaccccaccaccccatcaggcctcacaatcagagctgcctcctatgcngatgagctcgttaagaccgcgaaaacagtggcttcaccagggagg

SEQ ID NO: 4339 - DNA, 272 bp, Glycine max
  unsure (1)...(272): unsure at all n locations
  Clone ID: 700554881H1
tacaactacaaaggttgctgtaggagataagatattgaagtagtgctaagtgnctaacacctgcagtgaacaatggcctctgcatcagcatctcttctcaagtcttcacttgttcttgacaagtctgagtgggtgaaggacaaacacttcgccaaccttctgctgcatcagttgtgagatgcaaccccaccaccccatcaggcctcaccatcagagctggttcctatgctgatgagctcgttaagaccgcgaaaacagtggcttcaccaggg

SEQ ID NO: 4340 - DNA, 268 bp, Glycine max
  Clone ID: 700954194H1
caactacaaaggttgctgtaggagataagatattgaagtagtgctaagtgcctaacacctgcagtgaacaatggcctctgcatcagcatctcttctcaagtcttcacttgttcttgacaagtctgagtgggtgaagggacaaacacttcgccaaccttctgctgcatcagttgtgagatgcaaccccaccaccccatcaggcctcagcatcagagctggttcctatgctgatgagctcgttaagaccgcgaaaacagtggcttcacca

SEQ ID NO: 4341 - DNA, 153 bp, Glycine max
  Clone ID: 700996869H1
acaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctg

SEQ ID NO: 4342 - DNA, 222 bp, Glycine max
  Clone ID: 700897820H1
ctcgagccgaatcggctcgagcgggctcgagcaacgtacaaaggttacgctttaggagataagatattgtagtagtgctaagtgcctagcacttgcagtgaacaatggcctctgcatcagcatctcttctcaagtcttcacttgttcttgacaagtctgagtgggtgaagggacaaacacttcgccaaccttctgctgcatcagttgtgagatgcaacccca

SEQ ID NO: 4343 - DNA, 188 bp, Glycine max
  Clone ID: 700742574H1
atacaactacaaaggttgctgtaggagataagatattgaagtagtactaagtgcctaacacctgcagtgaacaatggcctctgcatcagcatctcttctcaagtcttcacttgttcttgacaagtctgagtgggtgaagggacaaacacttctccaaccttctgctgcatcagttgtgagatgcaacc

SEQ ID NO: 4344 - DNA, 227 bp, Glycine max
  Clone ID: 700684738H1
ctcgagccgcaaaggttgctgtaggagataagattgcagtagtgctaagtgctaacacctgcagtgaacaatggcctccggctcagcatctctgctcaagtcttcacttgttcttgacaagtctgagtgggtgaagggacaaacccttcgccaaccttctgcatcagctgtgagatgcaaccccaccaccccatcaggcgtcaccatcagagctggttcctatgctg

SEQ ID NO: 4345 - DNA, 106 bp, Glycine max
  Clone ID: 700739343H1
tgaacaagttggaggtgttgaagccatggactctctcattctcattcgggcgagcactgcaacaaagcacactcaagacatggggtggaaagaaggagaatgtcgc

SEQ ID NO: 4346 - DNA, 278 bp, Glycine max
  unsure (1)...(278): unsure at all n locations
  Clone ID: LIB3051-015-Q1-E1-B12
gacgacgcgtcaatatggcatggccagatacgctgtcatatgccagaaaaagggctgggtccattgttgagcctgagatccntgttgatggatctcatgacattcacaagtgtgctgccgtcaccgaacgtgtccctgcagcatgctacaaagctttgaatgatcaccacgtccttcttgaggggtacctattgaagccaaacatggtcacccccgggatcaaatctgctaagggttcccctcaggttggtgcggancacaacggttaaagcccttca

SEQ ID NO: 4347 - DNA, 338 bp, Glycine max
  Clone ID: LIB3039-048-Q1-E1-F11
agtacggctgcgagaagacgacagaagggggttcactttcttccaacctctaacctacctctttttcttctctctcaacaacttcaacttcttcctcctcgattaagttccaatttaaaggcaaattacaagattaacctaaccgcaaaaccgccttcaattggaatccctgaaaagggtattcttcctgccgataattcaacagggacaattggcaaccttttggccagcatcattgtaaaaacaattgaatccaacaggcaagctcttagggagctgcttttcattgctcctgatgttcttcaatatctcattggtgtcatcctctttaaggaaac

SEQ ID NO: 4348 - DNA, 369 bp, Glycine max
  Clone ID: LIB3027-010-Q1-B1-B7
gatgagcttattgcgaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttgaaggaggctggtgtgcttcctggcatcaaggttgacaagggcacagttgagcttgctggcactaatggagaaaccaccactcagggtctagatggccttggtcagcgttgcgccaag

SEQ ID NO: 4349 - DNA, 432 bp, Glycine max
  Clone ID: LIB3039-049-Q1-E1-B8
agacggctgcgagaagacgacagaagggggttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaacgaagctggtgtgcttcctggcatcaaggttgacaagggcacagtcga

SEQ ID NO: 4350 - DNA, 379 bp, Glycine max
  Clone ID: LIB3051-061-Q1-K1-E11
ctacctctttctcttctatctcaacaactacaccttcttgctactggatcatgtctcgagttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaagaagctggtgtgcttcctggcatcaagggtgacaagggcacagtcg

SEQ ID NO: 4351 - DNA, 411 bp, Glycine max
  Clone ID: LIB3056-009-Q1-N1-A10
acctacctctttttcttctctctcaacaacttcaccttggtcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaagaaaccctctaccagagcacagctgcaggcaagccctttgtgaatgtcttgaaagaagctggtgtgcttcctggcatcaaggttgacaagggcacagtcgagcttgctggaactaatggagaaaccaccac

SEQ ID NO: 4352 - DNA, 446 bp, Glycine max
  Clone ID: LIB3051-025-Q1-K1-E11
aaaaaccctacttggctcttttcttcacttgttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaagccaactcttaaggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatcaaggttgacaagggcacagtcgagcttgctggaact

SEQ ID NO: 4353 - DNA, 418 bp, Glycine max
  Clone ID: LIB3056-014-Q1-N1-E1
ctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgggaatgtcttgaaggaaacctgtgtgctttcttgcattaaaggttgacaagggcacagtcgagcttgctggaactaatggagaaaccaccact

SEQ ID NO: 4354 - DNA, 417 bp, Glycine max
  Clone ID: LIB3055-005-Q1-N1-A8
agcacactgtcagagcccttcagagaaccgtgcctgctgcagttcctgctgtcgttttcttgtctggtggccagagtgaggaggaggcatccgtcaacctcaacgccattaaccaggtcaatgggaagaagccatggtcactctctttctcctttggaagggcacttcaacagagcacccttaaggcatggggcggaaaagaagagaatgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaaatcgtattatgggtacaacaaccgaatt

SEQ ID NO: 4355 - DNA, 404 bp, Glycine max
  Clone ID: LIB3040-045-Q1-E1-A4
acggctgcgagaagacgacagaagggggttcactttcttccaacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggc

SEQ ID NO: 4356 - DNA, 356 bp, Glycine max
  Clone ID: LIB3028-010-Q1-B1-G9
ctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaggcaagccctttgtgaatgtcttgaaggaagctggtgtgcttcctggcatc

SEQ ID NO: 4357 - DNA, 369 bp, Glycine max
  Clone ID: LIB3056-010-Q1-N1-G8
ctcgagccgaatcggctcgagaacctacctgtttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttaaggagctgcttttcactgctcctggtgttcttcaatatctcagtggtgtcatcctctttgaggaaaccctctaccagagcacagctgcaggcaagccctttgtgaatgtcttgaaggaagctggtgtgc

SEQ ID NO: 4358 - DNA, 390 bp, Glycine max
  Clone ID: LIB3039-029-Q1-E1-A6
acggctgcgagaagacgacagaaggggacttgttcactttcttccaacctctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccagagcacagctgcaggcaagccctttgtggaagtcttga

SEQ ID NO: 4359 - DNA, 427 bp, Glycine max
  unsure (1)...(427): unsure at all n locations
  Clone ID: LIB3051-014-Q1-E1-D2
cacgcgtccagctattcctccctcctcacaaacttcactttcttcttcttcattaatgtctcacttcaagggcaagtaccatgatgagcttatcgcaaatgctgcgtacattggcactcctggaaagggtattcttgctgctgatgagtcaacagggacaattggcaagcgtttggccagcatcagtgtanagaacattgaatccaacatgcgagctcttagggagctgcttttcactgctcctggtgttcttcaatatctcagtggtgtcatcctctttgaggaaaccctctaccagagcacagctgcatgcaagccctttgtgaatgtcttgaangaagctggtgtgcttcctggcatcaatgttgacaagggcacagtcgagcttgctggaactaatggagaaaacaccactcatggtctagat

SEQ ID NO: 4360 - DNA, 392 bp, Glycine max
  Clone ID: LIB3030-010-Q1-B1-D7
caacctctaacctacctctttttcttctctctcaacaacttcaccttcttcctcctcgatcatgtctcacttcaagggcaagtaccatgatgagcttatcgccaatgctgcgtacattggcactcctggaaagggtattcttgctgctgatgagtcaacagggacaattggcaagcgtttggccagcatcagtgtagagaacattgaatccaacaggcgagctcttagggagctgcttttcactgctcctggtgttcttcaatatctcagtggtgtcatcctctttgaggaaaccctctaccagagcacagctgcaaggaaaccccttggtgaaggtcttgaaggaagctggtgtgcttcctgccatcaaggttgacaagggcacagtcgag

SEQ ID NO: 4361 - DNA, 370 bp, Glycine max
  Clone ID: LIB3051-094-Q1-K1-A9
cccacgcgtgcgcccacgcgtacgcctacctatttttcttctctctcaacagcttcaggttcttcctcctcgatcatgtctcacttcaagggcaagtaccatgatgagcttatcgccaatgctgcgtacattggcactcctggaaagggtattctcgctgctgatgagtcaacagggacaattggcaagcgtttggccagcatcagtgtacagaacattgaatccaacaggcgagctcttagggagctgcttttcactgctcctggtgttcttgaatatctcagtggtgtcatcctgtttgaggaaaccctttaccagagcacagctgcaggcaagccctttgtgaatgtcttgaaagaagctggtgtgc

SEQ ID NO: 4362 - DNA, 405 bp, Glycine max
  Clone ID: LIB3028-030-Q1-B1-C9
ctcaagtccaacctacccctttttcttctcccaccaacttcaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttagggagctgcttttcaccgctcccggtgctcttaaatatctcagtggtgtcatcctctttgaggaaactctctaccaaagcacagctgcaggcaaccccttgtggaagtcttgaaggaggctggtgtgcttcctggcatccaagttgacaagggcacagtttgagcttgctggcactaat

SEQ ID NO: 4363 - DNA, 276 bp, Glycine max
  Clone ID: LIB3052-004-Q1-N1-D8
ctcaagtccaacctacccctttttcttctcccacgcaacttgaccgtcttcttcctcgatcatgtctcacttcaagggcaagtaccatgatgagcttattgccaatgctgcttacattggcactcctggaaagggtattcttgctgctgatgagtcaacagggacaattggcaagcgtttggccagcatcagtgtagagaatgttgaatccaacaggcgtgctcttatggagctgcttttcaccgctcccggtgctcttaaatatctcagtggtgt

SEQ ID NO: 4364 - DNA, 401 bp, Glycine max
  unsure (1)...(401): unsure at all n locations
  Clone ID: LIB3065-014-Q1-N1-A3
aagtgtgtctgagcctgacgtcgtagctattgcatcactctataagagctatgacgcacgctgacctaagcccgggattcgggttcgggatgggccccaacgagccttctgagctgtctatccatgagaacgcctatggcttggctagatacgctgtcatatgccatgagaatggcctggttcccattgttgagcctgagatccttgttgatggacctcatgacattcacaagtgtgccgncgtcaccgagcgtgtccttgcagcatgctacaaggctttgaatgatcaccatgtccttcttgagggtaccctattgaagccaaacatggtcacccctggatcccaatctgctaaggttttccctcatgtggttgccgagcacactgtcagagcccttcag

SEQ ID NO: 4365 - DNA, 309 bp, Glycine max
  Clone ID: LIB3050-019-Q1-K1-H1
gacccacgcgtccgcgcactcgtccgtacggctgcgagaagacgacagaagggtacggctgcgagaagaggacagaatggtacggctgcgagaagacgacagaaggatacggctgcgagaagacgacagaagggtacggctgcgagaagacgacagaaggggaccgagcgcgttcttgcagcatgctacaaggctctaaatgatcaccatgttctgcttgagggcactctgttgaagcccaacatggtcacccctggttcaaagtctaagaaggtcaccccagatgtgattgctcaatacactgttaca

SEQ ID NO: 4366 - DNA, 215 bp, Glycine max
  Clone ID: LIB3051-062-Q1-K1-B5
catggcgcggaaaagaagagattgtgaagaaggctcaggaagcccttttggtaagagccaaggctaactcagaggcaactctgggaacctacaagggtaactcacagcttgctgatggtgcctcagagagcctccatgtttcgaactacagctactgatcaatcgaagttggtgttgtttgaagagactagtgcgagtaggaatcggtattatgg

SEQ ID NO: 4367 - DNA, 428 bp, Glycine max
  Clone ID: LIB3051-067-Q1-K1-E7
aaccgttgtcttctcacttcgtcaaaaccaaccaaacccctccccaattctcaagccaaccagggtcttccttcaagagcaagtaccaagatgaactcattgccaatgctgcttacattggcaccccagggaagggtatccttgctgctgatgagtcaactggtacaattggcaagcgattggccagcattaatgtcgagaatgttgaagcaaataggcgtgctcttcgtgaactcctattcaccacacctggtgcttttgagtgcctcagtggtgtgatcttgtttgaagaaaccctataccaaaagacagcttcaggaaaacccttcgtagagttgatgaaggaaagaggagttctccctggtatcaaggttgacaagggcacagtagagcttgcaggaactaatggggagactactacttaaagg

SEQ ID NO: 4368 - DNA, 373 bp, Glycine max
  Clone ID: LIB3050-006-Q1-E1-G7
tacggctgcgagaagacgacagaaggggacactccctttttaaaaccgttgtcttctcacttcgtcaaaaccaacgaggggcgtccccaagtctcaagccaaccatgtcttccttcaagagcaagtaccaggatgaactcattgccaatgctgcttacattggcaccccagggaagggtatccttgcggctgatgagtcaactggtacaagtcgcaagcgattggccagcattaatgtcgagaatgttgaagcaactaggcgtgctcttcgtgaactcggattcagcacacctggtgcttttgagtgcctcagtggtgtgatcttgtctgacgaaaccctatgccaggagacagcttcaggaaaacccttcgt

SEQ ID NO: 4369 - DNA, 370 bp, Glycine max
  Clone ID: LIB3028-011-Q1-B1-B9
tacaaaggttgctgtaggagataagattgcagtagtgctaagtgctaacacctgcagtgaacaatggcctctgcatcagcatctctgctcaagtcttcacttgttcttgacaagtctgagtgggtgaagggacaaacccttcgccaaccttctgcatcagttgtgagatgcaaccccaccagcccatcaggcctcaccatcagagctggttcctatgctgatgagctcgttaagaccgcgaaaacagtggcttcaccagggaggggtattttggccatggatgagtccaatgctacctgtgggaagcgtttggcttcaattgggctagagaacactgaagctaaacgccaggcataccgttacctcctcg

SEQ ID NO: 4370 - DNA, 418 bp, Glycine max
  Clone ID: LIB3028-011-Q1-B1-F2
agataagattgcagtactgctaagtgctaacacctgcaatgaacaatggcctctgcatcagcatctctgctcaagtcgtcacttgttcttgacaagtctgagtgggtgaagggacaaacccttcgccaaccttctgcatcagttgtgagatgcaaccccaccaccccatcaggcctcagcatcagagctggttcctatgctgatgagctcgttaagaccgcgaaaacagtggcttcaccagggaggggtattttggccatggatgactccaatgctacctgtgggaagcgtttggcttcaattgggctatagaacactgaagctaaccgccatgcatagcgtaccctcctcgtgacagttccaggccttggtcagtacatctctggtgccattctctttgaggaaacactctaacaat

SEQ ID NO: 4371 - DNA, 146 bp, Zea mays
  Clone ID: 700262935H1
ggaggccatcttcgtcgacccggccctccgcgggaagtactgcgtctgcttcgacccgctggatggctcctccaacatcgactgtggtgtctcaatcggaacggtgtgtcactgtcactcccggtggtgtttcaaaccttcttacc

SEQ ID NO: 4372 - DNA, 184 bp, Zea mays
  Clone ID: 700432173H1
agcatccgaagaagtactcagctcgctacgtgtgctcactggtggctgatttccaccggacgctcatatatggcggggtcgcatgaacccaagggaccatctgcggctggtttatgaggcgaaccctctcagtttccttgctgaacaggctgggggtagagggtcagatggcaagatcagaatc

SEQ ID NO: 4373 - DNA, 183 bp, Zea mays
  Clone ID: 700455709H1
agcgccagcaagcgcagcagaccaatctccaacctcacgggcgttcagggcgccgtcaatgtgcagggcgaggaccagaagccgctcgatgtcgtctccaacgaggtgttctccaactgcctcaagtcgagcgggcgcaccggcgtgatacgctcggcggcggaggacgtgcccgtagcggtg

SEQ ID NO: 4374 - DNA, 342 bp, Zea mays
  Clone ID: 700573083H1
tcagctcgagcttctgctcgaggtcagagacaatgacaacgtgaccttagaggatgtgctgcagcctggaacaaacatgcttgctgctggctactgcatgtacggaagttcatgtagactgtgctgagcactgggaccacatcaatgagttcactctcgatccttcccttggagagttcattttgactcatccagatatcaaggttaatgataaaaacaactcgacacttcttttctatcctggctgatcgatacccctggttagcactataaaacgaaatggtactacttgagtttgggtatcacgtgttgtgcgtgcttcgttcttttcttgtgcagata

SEQ ID NO: 4375 - DNA, 254 bp, Zea mays
  Clone ID: 701158577H1
ctcctcggctcctcacagtcacagagcctcacgtcacgtgtaccttcaccatcccaaccctgccgaaccctgcccaaaacctagcgtgcgaggcgccagtgaaccgaccgccggacgcggagatggtccacgcggcggaggcgctgcgcacggtcctgatgacgatcacgcggcacgagctcaacgagcagagccgccatccgtagtcccgcggcgacttcaccatcctgctctcccacatcgtcctcggctgc

SEQ ID NO: 4376 - DNA, 309 bp, Zea mays
  Clone ID: 700101851H1
ggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacacccttgattcggtggagcagaggtgcatcgtgaacgtgtgccagccggggag

SEQ ID NO: 4377 - DNA, 295 bp, Zea mays
  Clone ID: 700101541H1
accagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacacccttgattcggtggagcagaggtgcatcgtgaacgtgtg

SEQ ID NO: 4378 - DNA, 276 bp, Zea mays
  Clone ID: 700581510H1
ctcaagtcgagcgggcgcaccggcgtgatcgcctcggaggaggaggacgtgcccgtagcggtggagcagagctactccggcaactacatcgtcgtgttcgaccctctcgacggctcctccaccatcgacgccgccgtctccactgctccatcttcggcatctacaaccccaacgacgagtgcctcgccgacgtcgacgacaatgacacccttgattcggtggagcagaggtgcatcgtgaacgtgtgccagccggggagcaacctgctggccgccg

SEQ ID NO: 4379 - DNA, 269 bp, Zea mays
  Clone ID: 700046054H1
tgcagatccccaaggcgggcaagatctacgccttcaacgagggcaactacgcgctctgggacgacaagctgaagctgtacatggacagcctcaaggagcccggcgactcggggaagccctactccgcgcggtacataggcagcctcgtcggggacttccaccgcactcttctctacggagggatctacgggtaccccagggacaagaagagcaagaacggcaagctgcggcttctctacgagtgcgcccccatgagcttcatcgtcgag

SEQ ID NO: 4380 - DNA, 292 bp, Zea mays
  Clone ID: 700421605H1
ctcggggaagccctactccgcgcggtacataggcagcctcgtcggcgacttccaccgcactcttctctacggagggatctacgggtaccccagggacaagaagagcaagaacggcaagctgcggcttctctacgagtgcgcccccatgagcttcatcgtgagcaggccggtggcaagggctctgacggccaccagagaattcttgacatcacacctacagagatccaccaaagagtgcctctgtacattgggagcgtggaggaagtggacaaggtggagaattcctggcttg

SEQ ID NO: 4381 - DNA, 277 bp, Zea mays
  Clone ID: 700445495H1
cgcgctctgggacgacaaactgaagctgtacatggacagcctcaaggagcccggcgactcggggaagccctactccgcgcggtacatcggcagcctcgtcggcgacttccaccgcactcttctctacggagggatctacgggtaccccagggacaagaagagcaagaacggcaagctgcggcttctctacgagtgcgcccccatgagcttcatcgtcgagcaggccggtggcaagggctctgacggccaccagagaattcttgacatcacacctaca

SEQ ID NO: 4382 - DNA, 268 bp, Zea mays
  Clone ID: 700042188H1
cgggtacccagggacaagaagagcaagaacggcaagctgcggcttctctacgagtgcgcccccatgagcttcatcgtcgagcaggccggtggcaagggctctgacggccaccagagaattcttgacatcacacctacagagatccaccaaagagtgcctctgtacattggcagcgtggaggaagtggacaaggtggagaaattcctggcttgaatgccagagctctctcatcagatggactcccgaagacatcaagtttagggaggga

SEQ ID NO: 4383 - DNA, 324 bp, Zea mays
  unsure (1)...(324): unsure at all n locations
  Clone ID: 700100752H1
gagaccgcgagagtgtacgtgccaccaggagcagcagcagcaatggccgccgccgccaccacctcctcatcctcccacttgctcctcctctcccgccagcagngggcctccctacgatgccgcctctccttcctcggccagcccagaaggcccggcagggtcacggcccaggcgccggccgctaaggacgtgcggtgcatggcggccgtggacactactgcggcgtccacggcggcggcggagacgagccccaagtcgagcagctacgagatcgtgacgctcacgacgtggctgctgcagcaggagcggaccggcgcgatcgac

SEQ ID NO: 4384 - DNA, 267 bp, Zea mays
  Clone ID: 700044805H1
gagagtgtacgtgccaccagcagcagcagcagcagcaatggccgccgccgccgccacctcctcatcctcccacctgctcctcctctcccgccagcaggcggcctccctacgatgccgcctctccttcctcggccagcccagaaggcccggcagggtcacggcccaggcgccggccgctaaggacgtgcggtgcatggcggccgtggacactactgcggcgtccacggcggcggcggagacgagccccaagtcgagcagctacgagat

SEQ ID NO: 4385 - DNA, 310 bp, Zea mays
  Clone ID: 700099217H1
gtgtacgtgccacaagcagcagcagcagcagcaatggccgccgccgccgccacctcctcatcctcccacctgctcctcctctcccgccagcaggcggcctccctacgatgccgcctctccttcctcggccagcccagaaggcccggcagggtcacggcccaggcgccggccgctaaggacgtgcggtgcatggcggccgtggacactactgcggcgtccacggcggcggaggagacgagccccaagtcgagcagctacgagatcgtgacgctcacgacgtggctgctgcagcaagagcggaccggcgcga

SEQ ID NO: 4386 - DNA, 248 bp, Zea mays
  Clone ID: 701166271H1
cggttcctcacagtcacagagcctcaccctcacgtcacgtgtacctcccccaacccaacccagcccagcccaaaacctagcgggcgaggggccggggaaccgaccggcggacgcggagatggaccacgcggcggaggcgcagcggacggacctgatgacgatcacgcggcacgtgctcaacgagcagagccgccacccggagtcccgcggcgacttcaccatcctcctgtcccacatcggcctcggct

SEQ ID NO: 4387 - DNA, 249 bp, Zea mays
  Clone ID: 701163676H1
ctcggttcctcacagtcacagagcctcacgtcacgtgtacctcccccaacccaacccagcccaacccagcccaaaacctagcgggcgaggggccggggaaccgaccgccggacgcggagatggaccacgcggcggaggcgcagcggacggacctgatgacgatcacgcggcacgtgctcaacgagcagagccgccacccggagtcccgcggcgacttcaccatcctcctctcccacatcggcctcggct

SEQ ID NO: 4388 - DNA, 321 bp, Zea mays
  Clone ID: 700097620H1
gcttcacgctcgacccttcacttggggagttcatactaacccatccagacatcaagatacctaagaaggggaagatctattcagtcaacgaagggaacgccaagaactgggacgcgcctgttgccaagttcgtggagaagtgcaagtaccccaaagatggctcgccaccaagatctttgagatacattggaagtatggttgctgacgtgcaccgtaccttgctatacggcggtgtgtttttgtaccctgctgaccagaagaacccaaacggaaagctccgtatcctgtacgaagttttccccatgtcgttcctaatggagc

SEQ ID NO: 4389 - DNA, 283 bp, Zea mays
  Clone ID: 700580175H1
tgacgagaagaacccaaacggacagctccgtatcctgtacgaagttttccccatgtcgttcctaatggagcaggcaggaggccagtccttcacaggcaaagaacgggctcttgatctgatcccaaccaagatccacgacaggtccccgatattcctcggaagctacgacgacgtggaggagatcaaagcgttgtacgccgagcaggcgaagtcgagctcggcttcatcctaagtgagggtgtaaatcgacttttcctggcttaatttgttgcttacctgattc

SEQ ID NO: 4390 - DNA, 326 bp, Zea mays
  Clone ID: 700098780H1
cacacctctatcctgctagctaggtagctgaattcggagccagggtcgagcgagggggtgcggaggcgagatggaccacgcggcggacgcgcaccggacggacctgatgaccatcacgcggcacgtgctgaacgagcagagccggaaccccgagtcccgcggcgacttcaccatccttctctcccacatcgtcctcggctgcaagttcgtcgcctccgccgtcaacaaggccgggctcgcccagctgatcgggctcgccggcgagaccaacgtgcagggagaggagcagaagaagctggacgtcatgtccaacgaggtgttcgtca

SEQ ID NO: 4391 - DNA, 263 bp, Zea mays
  Clone ID: 700043335H1
gctagctaggtagctgaattcggagccaggctcgagcgacgggagggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgca

SEQ ID NO: 4392 - DNA, 266 bp, Zea mays
  Clone ID: 700043111H1
ctttgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctc

SEQ ID NO: 4393 - DNA, 255 bp, Zea mays
  Clone ID: 700442189H1
ccggaaccccgagtcccgcggcgacttcacatccttctctcccacatcgtcctcggctgcaagttcgtcgcctccgccgtcaacaaggccgggctcgcccagctgatcgggctcgccggcgagaccaacgtgcagggagaggagcagaagaagctggacgtcctgtccaacgaggtgttcgtcaaggccctcgtcagcagcggtcgcacctccgtccttgtgtccgaggaggcgaggaagcaacgttcgtggacc

SEQ ID NO: 4394 - DNA, 281 bp, Zea mays
  Clone ID: 700208394H1
gccacgcgtccgctgcccgcgcgctcactgcactccgtgatcaccagcacaccgctatcctgctagctaggtaactgaattcggagccaggctcgagcgacgggatggcggaggcgagatggaccacgcggcggacggcaccggacggacctgatgaccatcacgcggcacgtgctgaaacgagcagacccggaaccccgagtcccgcggcgacttcaccatcctgctctcccacatcgtcctcggctgcaattcgtcgcctccgcgtcaacaaggccggg

SEQ ID NO: 4395 - DNA, 253 bp, Zea mays
  Clone ID: 700045530H1
cgcgcgcgggagcagcagctggttcgtcgtgcccgcgcgctctttgcactccgtgtccgtgatcaccaccacaccgctatcctgctagctaggtagctgaattcggagccaggctcgagcgatggggggcggaggcgagatggaccacgcggcggacgcgcaccggacggacctgatgaccatcacgcggcacgtgctgaacgagcagagccggaaccccgagtcccgcggcgacttcaccatcctgctctcc

SEQ ID NO: 4396 - DNA, 110 bp, Zea mays
  Clone ID: 700098393H1
gctagctaggtagctgaattcggagccaggctcgagcgacgggagggcggaggcgagatggaccacgcggcggacgcgcaccggacggacctgatgaccatcacgcggca

SEQ ID NO: 4397 - DNA, 313 bp, Zea mays
  Clone ID: 700264654H1
gggatgtgcctacagccaaattcgtgaagaaatgcaagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcccttgaacttgctcccgctaaacttcacgacagatccccagtgttcctcgggagctacgatga

SEQ ID NO: 4398 - DNA, 272 bp, Zea mays
  Clone ID: 700479624H1
cttgtggtccttgtgaatggtttgcagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcgcttgaacttgctcccgctaaacttcacgacagatccccagtgttcctcgggagctacgatgacgttgaggagatcaaag

SEQ ID NO: 4399 - DNA, 242 bp, Zea mays
  Clone ID: 700448974H1
caagtatcctgaggatggttcaccgcctagatccttgagatatatcggaagtatggttgctgatgtccatcgcaccttactatacgggggcatatttttgtacccagcagaccagaagagtccaaacgggaaactacgcgttctgtatgaagtcttcccgatgtcattcctgatggaacaagctggaggccaggctttcacaggcaaacaacgggcgcttgaacttgctcccgctaaacttc

SEQ ID NO: 4400 - DNA, 302 bp, Zea mays
  Clone ID: 700100948H1
caacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagata

SEQ ID NO: 4401 - DNA, 281 bp, Zea mays
  Clone ID: 700212964H1
caacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgttgccaagttcgtggagaagtgcaagtaccccaaagatggctcgccac

SEQ ID NO: 4402 - DNA, 254 bp, Zea mays
  Clone ID: 700578027H1
acatcatcaaggacaaggacaacgtcactctggaggacgtgctgcaacctggcaagaacatgctcgccgccggatactgcatgtacggcagttcctgcacgctcgttctgagcactggaactggtgtcaatggcttcacgctcgacccttcacttggggagttcatactaacccatccagacatcaagatacctaagaaggggaagatctattcagtcaacgaagggaacgccaagaactgggacgcgcctgtg

SEQ ID NO: 4403 - DNA, 384 bp, Zea mays
  Clone ID: LIB148-057-Q1-E1-E6
agactaaagcatagtatcatcagcaagggggcccctttctgtaccagagcctcagatcgtgatttcgtcataagccacgctgaattttatgccgtttcagattcgtggataagtgcaagtatcctgaagatggttcaccgcctagatccctgagatatatcggtagtatggttgctgatgtccatcgcaccttactagacgggggcatatttttgtacccagcagaccagaagagtccagacgggaaactacgcgttctgtatgaagtcttcccgatgtcattcctgatggaacaagctggaggccaggctttcacaggcaaacaaagggtgtgtttcagtttcccgttctcagaccccaatccccaactgaaaaatcttgatg

SEQ ID NO: 4404 - DNA, 325 bp, Zea mays
  Clone ID: LIB3066-032-Q1-K1-F11
gcgtccacgcgtgcgcccacgcgttcgctagctttgttgctgaatgcggagccagtctcgagcgaggggggggcttgagcgagatggaccacgcggcggacgcgcaccggacggacctgatgaccatcacgcggcacgtgctgaacgagcagagccggaaccccgagtcccgcggtgacttcaccatgctgctctcccacatcggcctcggctgcaagttcgtcgcatccgccgtcaacaaggccaggcttgcacagatcatcgggctcgccggctagaccgacgcgcagggagaggagctgatgatgctggacgttctgtccaa

SEQ ID NO: 4405 - DNA, 337 bp, Zea mays
  unsure (1)...(337): unsure at all n locations
  Clone ID: LIB3066-035-Q1-K1-F11
atggtcttnnccaggttcacgnacgnatgatcacatcattgatggaattaccggactcgacccatcgcgtcaggccacgcgtacagcatctcgctagcttttcttatgcattcagatcctctctctacaagagaagttcttaagcaagatggaccgcccggcagacacacacctgactgacctgatgaccatcactcaggtcattcttaactaacaaatcccttacctctattgccgctactacttcaccattctgctctaccacatcatcctatgctacaagtatatcacctccgtcagtcaacaaggccgagctctcccagctcatctgactcac

SEQ ID NO: 4406 - DNA, 221 bp, Zea mays
  Clone ID: LIB36-013-Q1-E1-D10
cccacgcgtccgcggcgcgatcgacaacgagatgaccatcgtgctggccagcatatccacggcgtgcaagcagatcgcggcgctggtgcagcgcgcgcccatctccaacctcacgggcgttcacggcgccgtcaacgtgcatggcgaggaccagaagaagctcgatgtcgtctccaacgaggtgttctccaactgcctcaagtcgagcgggcgcaccggcg

SEQ ID NO: 4407 - DNA, 492 bp, Zea mays
  Clone ID: LIB83-003-Q1-E1-B4
aggccggcgtactgatcaccctgcggcacgcgtccgagactcgagggtccacacacgcgtccggacagttcctgcacactcgttctgagcactggaactggtgtcaatggcttcacgctccgacccttcaacttggggagttcataactaacccatccagacatcaaagataactaaagaaggggaagatctattcagtcaaccaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcccaatggagcaagcacgaagccagtccttcacaggcaaagaacgggctcttgatctgatcccaacca

SEQ ID NO: 4408 - DNA, 459 bp, Zea mays
  unsure (1)...(459): unsure at all n locations
  Clone ID: LIB83-005-Q1-E1-D2
cacgggcgttcagggcgccgtcaacgtgcagggcgaggaccagaagaagctcgatgtcgtctccaacgaggtgttctccaactgcctcaagtcgagcgggcgcaccggcgtgatcgcctcggangaggaangaacttcccgttacggttggagcaagaactaactcccgggaaactaacaatccgtncgtntttcaacctnctcgaanggctcctcaaaaatcaacnccgcggttctcnacggggcncnatcttcggnatctacaaccccaacnattnantgcctcgccganttnancaanaatnanaccctnaatncgttgaacaaaagntnaatcttnaacttttgcaanccggggaaccanctngctggcccnccgggnaactgcatttanncaacctcggtgnnttntccggctaaccnttggnaccgggggtttancttntttnacctggaccc

SEQ ID NO: 4409 - DNA, 299 bp, Zea mays
  unsure (1)...(299): unsure at all n locations
  Clone ID: LIB84-023-Q1-E1-F10
cgcacgttgccgaagccncggtccaagtctatccggcccgggccaagcgtccaggcacgccggcgaaaccaacgtacagggagaggagcagacgaagctggacgtcctgtccaacgaggtgttcgtcaacgccctcgtcagcaacggtcgcacctgcgtccctgtgtccgatgaggacgacgaaacaacgttcgtggaccctaagctgcgtggaaggtactgcgtctgccttgatcccctctatcgctcctccaacatctactgtggcgtctccatcggaacgatctttgggatttaca

SEQ ID NO: 4410 - DNA, 422 bp, Zea mays
  unsure (1)...(422): unsure at all n locations
  Clone ID: LIB83-008-Q1-E1-A8
ccatcgtgctggccagcatatccacggcgtgcaagcagatcgcggcgctggtgcagcgcgcgcccatctccaacctcacgggcgttcagggcgccgtcaacgtgcagggcgaggaccagaagaagctcgatgtcgtctccaacgaggtgttctccaactgcctcaagtcgagcgggcgcaccggcgtgatcgcctcggaggaggaggacgtgcccgtagcggtggagcagagctactccggcaactacatcgtcgtgttcgaccctctcgatggctcctccaacatcgacgccgccgtctccactggctccatcttcggcatctacaaccccaacgatgagtgcctcgccgacgtcgacgacaatgacacccttgattcgggtggagcanaggtgcatcgtgaacgtgtnccaaccggggga

SEQ ID NO: 4411 - DNA, 419 bp, Zea mays
  Clone ID: LIB3078-003-Q1-K1-C7
ctcaagtcgagcgggcgcaccggcgtgatcgcctcggaggaggaggacgtgcccgtagcggtggagcagagctactccggcaactacatcgtcgtgttcgaccctctcgacggctcctccaacatcgacgccgccgtctccactggctccatcttcggcatctacaaccccaacgacgagtgcctcgccgacgtcgacgacaatgacaccgtgagtgctaattaatctcatctcccttaccttctttctgttctgactggctcattacgtgacaattctatctccaacactacactacgtacgtacgcgcgcgcagcttgattcggtggagcagaggtgcatcgtgaacgtgtgccagccggggagcaacctgctggccgccggctactgcatgtactcgagctcggtgatcttcgtgc

SEQ ID NO: 4412 - DNA, 430 bp, Zea mays
  Clone ID: LIB3060-052-Q1-K1-D11
gaccgcgagagtgtacgtgccaccaggagcagcagcagcaatggccgccgccgccaccacctcctcatcctcccacttgctcctactctcccgccagcaggcggcctccctacgatgccgcctctccttcctcggccagcccagaaggcccggcagggtcacggcccatgcgccggccgctaaggacgtgcggtgcatggcggccgtggacactactgcggcgtccacggcggcggcggagacgagccccaagtcgagcagctacgagatcgtgacgctcacgacgtggctgctgcaacaggagcggaccggcgcgatcgacaacgagatgaccatcgtgctggccagcatatccacggcgtgcaagcagatcgcggcgctggtgcagcgcgcgcccatctacaacctgacgggcgttcagggcgccgtc

SEQ ID NO: 4413 - DNA, 313 bp, Zea mays
  Clone ID: LIB83-008-Q1-E1-B10
accacgcgtccgcccacgcgtccgagtggacaaggtggagaaattcttgacatcacacctacagagatccaccaaagagtgcctctgtacattgggagcgtggaggaagtggacaaggtggagaaattcctggcttgaatgtccctgcttcatgccagagctctctcatcagatggactccccaagacatcaagtttagggagggaatatgtactctctctttcccaccccaaataagtcttcttcgtctcatatttcgataaatcaaacaatctcaattttgatctaatatatacacacaacattaatattt

SEQ ID NO: 4414 - DNA, 425 bp, Zea mays
  Clone ID: LIB189-010-Q1-E1-C10
acctaagaaggggaagatctattcagtcaacgaagggaacgccaagaactgggacgcgcctgttgccaagtttgtggagaagtgcaagtaccccaaagatggctcgccaccaagatctttgagatacattggaagtatggttgctgacgtgcaccgtaccttgctatacggcggtgtgtttttgtaccctgctgacgagaagaacccaaacggaaagctccgtatcctgtacgaagttttccccatgtcgttcctaatggagcaggcaggaggccagtccttcacaggcaaagaacgggctcttgatctggtcccaaccaagatccacgacaggtccccgatattcctcggaagctacgacgacgtggaggagatcaaagcgttgtacgccgagcaggcgaagtcgagctcggcttcatcctaag

SEQ ID NO: 4415 - DNA, 487 bp, Zea mays
  Clone ID: LIB83-002-Q1-E1-C2
ggcacggacggcattagctgtcacgctagccggcgcagtgacgaggactcgcgggtcgacgcaagcctctacactaattccgcagagacttcaccatccttctctcccacatcgtcctcggctgcaagttcgtcgcctccgccgtcaacaaggccgggctcgcccagctgatcgggctcgccggcgagaccaacgtgcagggagaggagcagaagaagctggacgtcctgtccaacgaggtgttcgtcaaggccctcgtcagcagcggtcgcacctgcgtccttgtgtccgaggaggacgaggaagcaacgttcgtggaccctaagctgcgtggaaggtactgcgtctgctttgatcccctcgacggctcctccaacatcgactgtggcgtctccatcggaacgatctttgggatttacatcatcaaggacaaggacaacgtcactctggaggacgtgctgcaacctggcaagaacatgctcgccgc

SEQ ID NO: 4416 - DNA, 457 bp, Zea mays
  Clone ID: LIB36-016-Q2-E2-H10
cccacgcgtccgcccacgcgtccggctctctgcactccgtgatcaccaccacacctctatcctgctagctaggtagctgaattcggagccagggtcgagcgagggggtgcggaggcgagatggaccacgcggcggacgcgcaccggacggacctgatgaccatcacgcggcacgtgctgaacgagcagagccggaaccccgagtcgcgcggcgacttcaccatccttctctcccacatcgtcctcggctgcaagttcgtcgcctccgccgtcaacaaggccgggctcgcccagctgatcgggctcgccggcgagaccaacgtgcagggagaggagcagaagaagctggacgtcctgtccaacgaagtgttcgtcaaggccctcgtcagcagcggtcgcacctgcgtccttgtgtccgaggaggacgatgaagcaacgttcgtggaccctaagctgcg

SEQ ID NO: 4417 - DNA, 406 bp, Zea mays
  unsure (1)...(406): unsure at all n locations
  Clone ID: LIB189-032-Q1-E1-B6
agtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcagggagaggagcagaagaagctggacgtcctgtccaacgaggtgttcgtcaaggccctcgtcagcagcggtcgcacctgcgtccttgtgtccgangaggacgaggaagcaacg

SEQ ID NO: 4418 - DNA, 442 bp, Zea mays
  unsure (1)...(442): unsure at all n locations
  Clone ID: LIB36-010-Q1-E1-C4
ctgcactccgtgatcaccaccacacctctatcctgctagctaggtagctgaattcggagccagggtcgagcgagggggtgcggaggcgagatggaccacgcggcggacgcgcaccggacggacctgatgaccatcacgcggcacgtgctgaacgagcagagccggaaccccgagtcccgcggcgacttcaccatccttctctcccacatcgtcctcggctgcaagttcgtcgcctccgccgtcaacaaggccgggctcgcccagctgatcgggctcgccggcgagaccaacgtgcaaggagaggagcagaagaagctggacgtcctgtccaacgaggtgttcgtcaaggccctcgtcagcagcggtcgcacctgcgtccttgtgtccgangangacgangaagcaacgttcgtggaccctaagctgcgtggaaggtactgcg

SEQ ID NO: 4419 - DNA, 430 bp, Zea mays
  Clone ID: LIB3060-010-Q1-K1-D2
gatcaccaccacacctctatcctgctagctaggtagctgaattcggagccagggtcgagcgagggggtgcggaggcgagatggaccacgcggcggacgcgcaccggacggacctgatgaccatcacgcggcacgtgctgaacgagcagagccggaaccccgagtcccgcggcgacttcaccatccttctctcccacatcgtcctcggctgcaagttcgtcgcctacgccgtcaacaaggccgggctcgcccagctgatcgggctcgccggcgagaccaacgtgcaaggagaggagcagaagaagctggacgttctgtccaacgaggtgttcgtcaaggccctcgtcagcagcggtcgcacctgcgtccttgtgtccgaggaggactaggaagcaacgttcgtggactctaagctgcgttgaaggtactgc

SEQ ID NO: 4420 - DNA, 417 bp, Zea mays
  Clone ID: LIB189-021-Q1-E1-E10
cagacgcgtgggcggacgcgtgggcggacgcgtgggcgcgcgctctttgcactccgtgtccgtgatcaccaccacaccgctatcctgctagctaggtagctgaattcggagccaggctcgagcgagggggggcggaggcgagatggaccacgcggcggacgcgcaccggacggacctgatgaccatcacgcggcacgtgctgaacgagcagagccggaaccccgagtcccgcggcgacttcaccatcctgctctcccacatcgtcctcggctgcaagttcgtcgcctccgccgtcaacaaggccgggctcgcccagctcatcgggctcgccggcgagaccaacgtgcaggcaagtgcgctgtacggctagctagtttttccttcagagagattgatcgagatgtgacgatgccgctg

SEQ ID NO: 4421 - DNA, 298 bp, Zea mays
  Clone ID: LIB84-013-Q1-E1-F7
gagcagagccggaaccccgagtcccgcggcgacttcaccatccttctctcccacatcgtcctcggctgcaagttcgtcgcctccgccgtcaacaaggccgggctcgcccagctgatcgggctcgccggcgagaccaacgtgcagggagaggagcagaagaagctggacgtcctgtccaacgaggtgttcgtcaaggccctcgtcagcagcggtcgcaccgtacgaatatccctccttgtccactgcgattatatattgtccgtttgagttccgagagtgttctgctttctgactcggg

SEQ ID NO: 4422 - DNA, 267 bp, Glycine max
  Clone ID: 700685384H1
ctcgagccactcgagccgctaaaaactgggatgaccctactaccaagtatgtggagaaatgcaagtataccaagagatggttcatcaccaaagtccctaagatatattggaagcatggtagctgatgttcaccgcacattgctttatggaggtatttttctgtatccggctgataaaaagagtccaaatggaaaacttcgtgtactctatgaagtcttcccaatgtcattcttgatggaacaagcaggaggacaggctttcactggc

SEQ ID NO: 4423 - DNA, 271 bp, Glycine max
  Clone ID: 700737915H1
agaagagaagtggatatgagcttcaaacactcactaactggatgctgaagcaggagcaagctggggtgattgatgcagaactcactattgtgctgtctagcatttccatggcgtgcaatcagattgcttctttggtgcaaagagccaacatttccaacctcactggggttcaaggagctgtcaatgttcagggggaagaccagaaaaagcttgatgttgtttcaaatgaggtcttctcatactgcttgaggtcaagtgggaggacagggat

SEQ ID NO: 4424 - DNA, 261 bp, Glycine max
  Clone ID: 700741457H1
gaaatgccaaaaactgggatcgtcctactgctacttacgttgaaaaatgcaagtttcctgaagatggttcatcaccaaagtctctaagatatattcggaagtatgggtagctgatgttcatcgtacgttgctttatggaggcatctttttgtaccctgttgacaaaaaaagtccaaatggaaaacttcgtgtcctgtatgaagtcttcccaatgtcattcttgatggaacaggcaggaggacagtctttcacgggcaagga

SEQ ID NO: 4425 - DNA, 255 bp, Glycine max
  Clone ID: 700873234H1
ctcttggggagttcattctaactcaccctgacatcaagatcccatagaaaggcaagatctattcagtgaatgaaggaaatgctaaaaactgggatggccctactaccatgtatgtataaatccaatagtgttaaaatgtttcaggcattataatgcagtttgtgacactatgatttcctttccttctttctgttcaggtatgtggaaaactgcaagtatccagaagatggttcatcaccaaagtccctaggatat

SEQ ID NO: 4426 - DNA, 257 bp, Glycine max
  Clone ID: 700874831H1
atcaagtggcaggagaaggcatgtggggggttctggagttaggtgcatggctgtgggggaagcagcaaccactgggacaaagaagagaagtggatatgagcttcaaacactcactagctggttgctgaagcaggagcaagctggggtgattgatgcagaactcactattgtgctgtctagcatttccatggcatgcaaacagattgcttctttggtgcaaagagctaacatttccaacctcactggggttcaaggtg

SEQ ID NO: 4427 - DNA, 302 bp, Glycine max
  Clone ID: 700983024H1
gctaaacttattggactcgctggagaaaccaatgttcagggtgaagaacagaagaaactggatgttctttccaatgaggttttcatcaagggctctcataagcagtggccgaacatgcatcttggtttctgaagaagatgaagaagcgataattgtggagccttctaagcgcggaaagtactgtgtttgctttgacccattggatggctcgtccaacattgattgtggggtttccattggcacaatttttggggtttatgcgttgaaagatgtccatgaaccaaccatagaagatgtcctgc

SEQ ID NO: 4428 - DNA, 257 bp, Glycine max
  unsure (1)...(257): unsure at all n locations
  Clone ID: 700993304H1
tcacattgttctcggctgcaagttcgtctgctctgctgttaacaaggcgggtcttgctaagcttattggacttgcaggagagacaaatgttcagggtgaagagcaaaaganattggatgtcctatccaatgatgtcttcatcaaggcattgatcagcactggacgaacatgcatcttggtgtctgaagaagatgaggaagcaacatttgtggaaccttctaagcgtggaaaatactgtgttgtttttgacccgctng

SEQ ID NO: 4429 - DNA, 271 bp, Glycine max
  unsure (1)...(271): unsure at all n locations
  Clone ID: 700996155H1
gaagtataactgcttactttccctcaaaatgatactttaatctaagtattttatctaaataaattctatagccctgaccggcacatcaaccaaagtctctaagatatattggaagcatggtagctgatgttcatcgtacgttgctttatggaggcatctttttgtaccctgctgacaaaaaaagtccaaatggaaaacttcgtgtcctgtannnagtcttcccaatgtcattcttgatggaacaggcaggaggacagtctttcacgggcaa

SEQ ID NO: 4430 - DNA, 291 bp, Glycine max
  unsure (1)...(291): unsure at all n locations
  Clone ID: 700996632H1
gagcaggcaaaatttatgctttcaatgaagggacttatccagttgtgggatgacaagcttaagaaatatattgatgatctcaaggncccangtcctagcggnaagccttattctgcaaggtacattggtagcttggtaggagacttccacaggnccactgctatatggtgncattnatgggtaccccanggnccaagccaaagtaacnatgggcaattcaagctncantaggangggccnccatnancttccntattngccccggctgggggaaaaggtcccntgcccccc

SEQ ID NO: 4431 - DNA, 258 bp, Glycine max
  unsure (1)...(258): unsure at all n locations
  Clone ID: 700998027H1
gtgaacgtgtgccaacccggaagcaaccttcttgcagctggttactgcatgtattctagctccaataatctttgttctcacccttgggaatggagtgtttgtgtttacattggacccgatgtatggcgaattcgttttgactcaggaaaacctncaaatacctagagcaggcaaaatttatnctttcaatgaagggaatnatcattgtggganccncacntaaggaaantntntggacaancnangncccncgcnccc

SEQ ID NO: 4432 - DNA, 157 bp, Glycine max
  Clone ID: 701209548H1
atggtagctgatgttcatcgtacgttgctttatggaggcatctttttgtaccctgctgacaaaaaaagtccaaatggaaaacttcgtgtcctgtatgaagtcttcccaatgtcattcttgatggaacaggcaggaggacagtctttcacgggcaagg

SEQ ID NO: 4433 - DNA, 262 bp, Glycine max
  Clone ID: 700870828H1
tcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcagggcgaagagcaaaagaaactggatgtcctttccaatgatgtctttatcaaggctttggtc

SEQ ID NO: 4434 - DNA, 241 bp, Glycine max
  Clone ID: 700741669H1
ggatcacagtgccgatgctcaacgcacggacttgatgaccatcacccgcttcgtgctgaaccaacaatccaaccaccctgagtctcgtggcgatttctcaatcttgctcagtcacattgttctcggttgcaagttcctctgctctgctgttaacaaggcgggtcttgctaagcttattggacttgcaggagagacaaatgttcaggggaagagcaaaagaaactggatgtcctttccaatg

SEQ ID NO: 4435 - DNA, 261 bp, Glycine max
  unsure (1)...(261): unsure at all n locations
  Clone ID: 700555754H1
acatacacccacatatttcatatgggtacttgttaatttgggtgtggattgttggtttgtnacttgtnttgttccgttcaggtgattgtntgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgnttgttccgctgtc

SEQ ID NO: 4436 - DNA, 258 bp, Glycine max
  unsure (1)...(258): unsure at all n locations
  Clone ID: 700991527H1
ttattatactttcttcttcttctttattattgttgattaatataacatacacccacatatttcatatgggtacttgttaatttnggtgtggattgttagtttgttacttgtttgttccgttcaggtgattgtttgattgagccttgaagaaatggaccacagcgctgatgcacatcgcacggacttgatgaccataacgcggttcgtgctgaacgagcaatccaagcaccccgagtcacgcggcgatttcaccatctt

SEQ ID NO: 4437 - DNA, 257 bp, Glycine max
  Clone ID: 700898719H1
tccaacctcactggggttcaaggagctgtcaatgttcagggggaagaccagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatccaatattgatgctgcagtgtcaactgggtccatttttgggatata

SEQ ID NO: 4438 - DNA, 253 bp, Glycine max
  Clone ID: 700993540H1
tcagggggaagaccagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatccaatattgatgctgcagtgtcaactgggtccatttttgggatatacagccccaatgatgagtgtctgctgacattg

SEQ ID NO: 4439 - DNA, 228 bp, Glycine max
  Clone ID: 700909657H1
tatcagaaaaagcttgatgttgtttcaaatgaggttttctcaaactgcttgaggtcaagtgggaggacagggataatagcatcagaggaggaagatgtgccagtggcagtagaagagagttattctggaaactacattgtggtgtttgacccacttgatgggtcatcccatattgatgctgcaatgtcaatggggtccatttttgggatatacagccccatgatgagt

SEQ ID NO: 4440 - DNA, 284 bp, Glycine max
  Clone ID: 700555054H1
atcaacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcagg

SEQ ID NO: 4441 - DNA, 276 bp, Glycine max
  Clone ID: 700685264H1
caaaaaggtaaactttttgcaacaaccatggttgcaatggcagcagcaacagcatccacccagttgattttctcaaagccttgttccccttcacgtctatgccccttccaaccatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcaggag

SEQ ID NO: 4442 - DNA, 283 bp, Glycine max
  Clone ID: 700558854H1
caaaaaggtaaactttttgcaacaaccatggttgcaatggcagcagcaacagcatccacccagttgattttctcaaagccttgttccccttcacgtctatgccccttccaactatgtgtctttgacactaaacaagtgctatcaagtggaggagaaggcatgtggggggttctggagttaggtgcatggctgtgggggaagcagcaaccactgggacaaagaagagaagtggatatgagcttcaaacactcactagctggttgctgaagcaggagcagctggg

SEQ ID NO: 4443 - DNA, 289 bp, Glycine max
  Clone ID: 700554755H1
aatcaacaaaccaaaaaggtaaactttttgcaacaaccatggttgcaatggcagcagcaacagcatccacccagttgattttctcaaagccttgttccccttcacgtctatgccccttccaactatgtgtctttgcacactaaacaagtgctatcaagtggcaggagaaggcatgtggggggttctggagttaggtgcatggctgtgggggaagcagcaaccactgggacaaagaagagaagtggatatgagcttcaaacactcactagctggttgctgaagcaggagc

SEQ ID NO: 4444 - DNA, 274 bp, Glycine max
  unsure (1)...(274): unsure at all n locations
  Clone ID: 701000504H1
actttttgcaacaaccatggttgcaatgggcagcagcaacagcatccacccagttgattttctcaaagccttgttcccccttcacgtctatgccccttccaactatgtgtctttnacactaaacaagtgctatcaagtggcaggagaaggcatgtggggggttctggagttaggtgcatggctgtgggggaagcagcaaccatgggacaaagaagagaagtggatatgagcttcaaacactcactagctggttgctgaagcaggagcaagctgg

SEQ ID NO: 4445 - DNA, 252 bp, Glycine max
  Clone ID: 700738115H1
aaaaggtaaactttttgcaacaaccatggttgcaatggcagcagcaacagcatccacccagttgattttctcaaagccttgttccccttcacgtctatgccccttcgaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactcac

SEQ ID NO: 4446 - DNA, 275 bp, Glycine max
  unsure (1)...(275): unsure at all n locations
  Clone ID: 700992933H1
ttttgcaacaaccatggttgcaatgggcagcagcaacagcatccacccagttgattttctcaaagccttgttccccttcacgtctatgccccttccaactatgtgtctttgacactaaacaagtgctatcaagtggcagganaaggcatgtggggggttctggagttaggtgcatggctgtgggggaagcagcaaccactgggacaaagaananaagtggatatgagcttcaaacactcactagtggttgctgaanaggagcaagctggggtgnt

SEQ ID NO: 4447 - DNA, 253 bp, Glycine max
  Clone ID: 701107444H1
caaaaaggtaaactttttgcaacaaccatggttgcaatggcagcagcaacagcatccacccagttgattttctcaaagaccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcttcaaacactc

SEQ ID NO: 4448 - DNA, 254 bp, Glycine max
  Clone ID: 700852823H1
aaaaggtaaactttttgcaacaaccatggttgcaatggcagcagcaacagcatccacccagttgattttctcaaagccttgttccccttcacgtctatgccccttccatctatgtgtctttgacactaaacaagtgctatcaagtggcaggagaaggcatgtggggggttctggagttaggtgcatggctgtgggggaagcagcaaccactgggacaaaaagagaagtggatatgagcttcaaacactcactag

SEQ ID NO: 4449 - DNA, 262 bp, Glycine max
  Clone ID: 700733478H1
ttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgaacttcaaacactcactagctggttgctagaacaggagcaagctggggtgattgatgcagaactcatattgtgctgtctagcatttccatggc

SEQ ID NO: 4450 - DNA, 285 bp, Glycine max
  Clone ID: 701105185H1
caaaaaggtaaacttttgcaacaaccatggttgcaatggcagcagcaacagcatcctcccagttgattttctcaaagcctcgctcaccctcgcgtctctgtcccttccaactaacggtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactcactaactggttgctgaagcaggagcaag

SEQ ID NO: 4451 - DNA, 251 bp, Glycine max
  Clone ID: 700737830H1
atggttgcaatggcagcagcaacagcatccacccagttgattttctcaaagccttgttccccttcacgtctatgccccttccaactatgtgtctttgacactaaacaagtgctatcaagtggcaggagaaggcatgtggggggttctggagttaggtgcatggctgtgggggaagcagcaaccactgggacaaagaagagaagtggatatgagcgtgatcactcactagctggttgctgaagcaggagcaa

SEQ ID NO: 4452 - DNA, 275 bp, Glycine max
  Clone ID: 700685110H1
caaaaaggtaaacttctgcaacaaccatggttgcaatggcagcagcaacagcatcctcccagttgattttctcaaagcctcgttcaccctcgcgtctctgccccttccacactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaacactcactaactggttgctgaag

SEQ ID NO: 4453 - DNA, 248 bp, Glycine max
  Clone ID: 700968307H1
caacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagtgctatcaagtggcaggagaaggcatgtggggggttctggaatagagtgcatggctgtgggggaagcagcaaccactgggacaaagaagagaagtggatatgag

SEQ ID NO: 4454 - DNA, 348 bp, Glycine max
  unsure (1)...(348): unsure at all n locations
  Clone ID: 700653014H1
aaatctttttgctcttagtgccttagtacacaatccatgtaaccaccactagtgctaaaatcatcaaccaaaaaggtaaacttctgcaacaaccatggttgcaatggcagcagcaacagcatcctcccagttgattttctcaaagcctcgttcaccctcgcgtctctgcnccttccaactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactcactaactggttctgaagcaggac

SEQ ID NO: 4455 - DNA, 283 bp, Glycine max
  Clone ID: 700555504H1
caaaaaggtaaacttctgcaacaaccatggttgccaatggcagcagcaacagcatcctcccagttgattttctcaaagcctcgttcaccctcgcgtctctgccccttccaactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactcactaactggttgctgaagcaggagc

SEQ ID NO: 4456 - DNA, 246 bp, Glycine max
  Clone ID: 700751540H1
aaacttctgcaacaaccatggttgcaatggcagcagcaacagcatcctcccagttgattttctcaaagcctcgttcaccctcgcgtctctgacccttccaactatgtgtctttgacaccaaacaagtgctgtcaagttcaagtggcaggagaaggcatgtggggggttctggagttaggtgcatggcggtgggagaagctgcaaccactgagactaagagagaagtggatatgagcttcaaacact

SEQ ID NO: 4457 - DNA, 257 bp, Glycine max
  Clone ID: 700901976H1
caaaaaggtaaacttctgcaacaaccatggttgcaatggcagcagcaacagcatcctcccagttgattttctcaaagcctcgttcaccctcgcgtctctgccccttccaactatgtgtctttgacaccaaacaagtgctgtcaagttcaagtggcaggagaaggcatgtggggggttctggagttaggtgcatggcggtgggagaagctgcaaccactgagactaagaagagaagtggatatgagcttcaaacactc

SEQ ID NO: 4458 - DNA, 278 bp, Glycine max
  unsure (1)...(278): unsure at all n locations
  Clone ID: 700986496H1
caaaaaggtaaacttctgcaacaaccatggttgcaatggcagcagcaacagcatcctcccagttgattttctcaaagcctcgttcaccctcgcgtctctgcnccttccaactatntgtctttgacaccaaacaagtgctgtcagttcaagtggcaggagaaggcctgtggggggntctggagttnggtgcatggcggtgggagaagctgcaaccatgagactangnagagaagtggatatgagcttcaaacatcataactggttgctgaagcaggagc

SEQ ID NO: 4459 - DNA, 246 bp, Glycine max
  Clone ID: 700751580H1
aaacttctgcaacaactatggttgcaatggcagcagcaagagcatcctcccagttgattttctcaaagcctcgttcaccctcgcgtctctgccccttccaactatgtgtctttgacaccaaacaagtgctgtcaagttcaagtggcaggagaaggcatgtggggggttctggagttaggtgcatggcggtgggagaagctgcaagcactgagactaagaagaaagtggatatgagcttcaaacact

SEQ ID NO: 4460 - DNA, 250 bp, Glycine max
  Clone ID: 700751532H1
aaacttctgcaacaaccatggttgcaatggcagcagcaacagcatcctcccagttgattttctcaaagcctcgttcaccctcgcgtctctgccccttccagctatgtgtctttgacaccaaacaagtgctgtcaagttcaagtggcaggagaaggcatgtggggggttctggagttaggtgcatggcggtgggagaagctgcaacacctgagactaagaagagaagtggatatgagcttcaaacactcac

SEQ ID NO: 4461 - DNA, 269 bp, Glycine max
  unsure (1)...(269): unsure at all n locations
  Clone ID: 700990937H1
caaaaaggtaaacttcngcaacaaccatggttnccaatggcagcagcaacagnatcctcccagtngattttctcaaagcctcgttgcancctcgcgtctctgccccttccaactatgngtctttgncaccaaacaagtgctgtcaagttcaagtggcaggagaaggcatgtggggggttctggagttaggtgcatggcggtgggagaagctgcaaccactgagactaagaagagaagtggatatgagcttcaaacactcantaactggt

SEQ ID NO: 4462 - DNA, 222 bp, Glycine max
  Clone ID: 700740789H1
aaaatcaacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagcgctatcaagtggcaggagaaggcatgtggggggttctggagttaggtgcatggctgtgggggaagcagcaac

SEQ ID NO: 4463 - DNA, 192 bp, Glycine max
  Clone ID: 700743994H1
gtaaactttttgcaacaaccatggttgcaatggcagcagcaacagcatccacccagttgattttctcaaagccttgttccccttcacgtctatgccccatccaactatgtgtctttgacactaaacaagtgctatcaagtggcaggagaaggcatgtggggggttctggagttaggtgcatggctgtggggg

SEQ ID NO: 4464 - DNA, 247 bp, Glycine max
  Clone ID: 700754374H1
caaccaaaaaggtaaacttctgcaacaaccatggttgcaatggcagcagcaacagcatcctcccagttgattttctcaaagcctcgttcaccctcgcgtctctgccccttccaactatgtatcttgacaccaaacaagtgctgtcaagttcaagtggcaggagaaggcatgtggggggttctggagttaggtgcatggcggtgggagaagctgcaaccactgagactaagaagagaagtggatatga

SEQ ID NO: 4465 - DNA, 255 bp, Glycine max
  unsure (1)...(255): unsure at all n locations
  Clone ID: 701001295H1
acacaatccatgtaancaccactagcaccataccacactgccaaaatcancaaaccaaaaaggtaaactttttgcaacaaccatggttgcaatggcagcagcaacagcatccacccagttgattttctcaaagccttgttccccttcacgtctatgccccttccaactatgngnctgnactaaacaagtgntatcaagtggcaggagaaggnatgtggggggttctggagtnaggtgcatggctgtgggggaagc

SEQ ID NO: 4466 - DNA, 225 bp, Glycine max
  Clone ID: 701155952H1
tacggctgcgagaagacgacagaaggggaccactagtgctaaaatcatcaaccaaaaaggtaaacttctgcaacaaccatggttgcaatggcagcagcaacagcatcctcccagttgattttctcaaagcctcgttcaccctcgcgtctctggcccttccaactatgtgtctttgacaccaaacaagtgctgtcaagttcaagtggcaggagaaggcatgtgggg

SEQ ID NO: 4467 - DNA, 218 bp, Glycine max
  Clone ID: 700872212H1
ctttgctctcagtgccttagaacacaatccatgtaaccaccacaagcaccataccacactgccaaaatcaacaaaccaaaaaggtaaactttttgcaacaaccatggttgcaatggcagcagcaacagcatccacccagttgattttctcaaagccttgttccccttcacgtctatgccccttccaactatgtgtctttgacactaaacaagtgctat

SEQ ID NO: 4468 - DNA, 135 bp, Glycine max
  Clone ID: 700682196H1
caaaaaggtaaactttttgcaacaaccatggttgcaatggcagcagcaacagcatccacccagttgattttctcaaagccttgttccccttcacgtctatgccccttccaactatgtgtctttgacactaaacaa

SEQ ID NO: 4469 - DNA, 92 bp, Glycine max
  Clone ID: 700738779H1
gtaaacttctgcaacaaccatggttgcgatggcagcagcaacagcatcctcccagttgattttctcaaagcctcgttcaccctcgcgtctct

SEQ ID NO: 4470 - DNA, 236 bp, Glycine max
  Clone ID: 700844816H1
tgagccttctaagcgcggaaagtactgtgtttgctttgacccattggatggctcgtccaacattgattgtggggtttccattggcacaatttttggggtttatgcgttgaaagatgtccatgaaccaaccatagaagatgtcctgcttcctgggaagaacatggtggcagctggttactgtatgtatggaagctcttgcacgcttgtgttaagcactggagcaggtgttaatggtt

SEQ ID NO: 4471 - DNA, 280 bp, Glycine max
  Clone ID: 701128049H1
gcaacagccactaagatgttctttgagtcttggcacgccacgtgtcagaactgccaacagatagcaccatctctttctccttctccctaaacctcgaactcagcacccccatccactggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaag

SEQ ID NO: 4472 - DNA, 302 bp, Glycine max
  Clone ID: 701152064H1
cggaatctcggctcgagacggctgcgagaagacgacagacggggagcgtggaacgagacaactaagtacgacaatcgttatccgccgcaacagccactaagatgttctttgagtcttggcacgccacgtgtcagaactgccaacagatagtcccatctctttctccttctccctaaacctcgaactcagcacccccatcgactggtgattgtttgattgagccttgaagaaatggaccacagcgctgatgcacatcgcacggacttgatgaccataacgcggttcgtgctgaacgagcaatc

SEQ ID NO: 4473 - DNA, 333 bp, Glycine max
  Clone ID: 700649626H1
caaaactttcatatccccgaaattctctctttttccactgttccctaggaaatatttattctcatcttcatcctctacacaacacctaagaaggacaagagggaactcataatttataaaaagaacattgagaaagagagaagggaagaagaatggaccaccaagctgacactaacagaactgatttgatgactatcacacgctttgttctgaatgaacagtcaaagtatcccgaatcacgtggcgatttcaccatccttctcagtcacattgttcttgggctgcaaattcgtttgttctgctgttaacaaggcgggattggcgaaactcata

SEQ ID NO: 4474 - DNA, 363 bp, Glycine max
  unsure (1)...(363): unsure at all n locations
  Clone ID: 700649846H1
caaaactttcatatccccgaaattctctctttttccactgttccctaggaaatatttattctcatcttcatcctctacacaacacctaagatcggacaagagggaactcataatttataaaaagaacattgagaaagagagaagggaagaagaatggaccaccaagctgacactaacagaactgatttgatgacatcacacgctttgttctgaatgaacagtcaaagtatcccgantcacgtggcgatttcaccatccttctcagtcacatggttctgggctgnaatccgtttgttctgctgtnaanaggngggttggcgaaacccaaggattgcggaganncattttcaggggggacaaaaa

SEQ ID NO: 4475 - DNA, 393 bp, Glycine max
  Clone ID: LIB3030-010-Q1-B1-C7
ccccactccatcatttattatactttcttcttcttctttattattgttgattaatataacatacacccacatatttcatatgggtacttgttaatttgggtgtggattgttggtttgttacttgttttgttccgttcaggtgattgtttgattgagccttgaagaaatggaccacagcgctgatgcacatcgcacggacttgatgaccataacgcggttcgtgctgaacgagcaatccaagcaccccgagtcacgcggcgatttcaccatcttgctcagtcacattgttctcggttgcaagttcgtttgttccgctgttaacaaaggctggccttgctaaacttattggactcgctggagaaaccaatgttcaaggtgaagaacagaataaac

SEQ ID NO: 4476 - DNA, 320 bp, Zea mays
  Clone ID: 700097383H1
gagaagtcggtcaacacgatccggttcctggccatcgacgccgtcgagaaggccaactccggccacccgggcctccccatgggctgcgcgcccatgggccacgtcctctacgacgaggtcatgcgctacaaccccaagaacccctactggttcaaccgcgaccgcttcgtcctctccgccggccacggctgcatgctccagtacgccctcctccacctcgccggttacgacagcgttaaggaggaggacttgaagcagttctggcaatggggaagcagaacaccgggccaccctgagaactttgagactccaggagttga

SEQ ID NO: 4477 - DNA, 235 bp, Zea mays
  Clone ID: 701159054H1
gtacaccatctctgacaactctaccggcaacaagccgggcatcattgtgatgggcaccgtctccgagctgtagatcgcggccaaggccgtcgacgagctgaggaaggaggggaagacggtccgcgtcgtctcgttcgtctcctgggaactctttgatgagcagtcggatgagcacaaggagatcgtcctccctgccgccgtcacagcgaggatcagcatcgaagccgggtccact

SEQ ID NO: 4478 - DNA, 276 bp, Zea mays
  Clone ID: 701184582H1
ccagattcgcttaaggctgaaaggcggatggaagctctcatatagtcggtgaagacaaagaacgttgcacaataaggtatcagaccagggctgtgaacagcgatgccattcgaaatggcacccatagcatgctctcgcacaccgaagcgaatgtttctctcttcaggagtatccctctggatttctccaaacttcttaagcagtgtcatgtttgacgttgcgagatccgaactacctccaagaaatccaggtattactttggcaagtgcattcaag

SEQ ID NO: 4479 - DNA, 292 bp, Zea mays
  Clone ID: 700553205H1
gcaaccaggcagaaccttggatggccctatgacacattctttgtaccagaggacgtcaagagtcactggagccgccacacacccgaaggtgctgcacttgaggctgattggaacgctatgtttgcagagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcgcttgctaatgttg

SEQ ID NO: 4480 - DNA, 295 bp, Zea mays
  Clone ID: 700473792H1
tggaagtgcactgggtgccaaagaggttgaagcaaccaggcagaaccttggatggccctacgacacattctttgtaccagaggacgtcaagagtcactggagccgccacacacccgaaggtgctgcacttgaggctgattggaacgctaagtttgcagagtacgagaagaagtatgcagatgatgcagcaaccttgaaaagtatcatcacgggggagttacccactggctgggttgatgctcttcctaaatacactccagagagcccaggagatgccacctaggaactctcccag

SEQ ID NO: 4481 - DNA, 285 bp, Zea mays
  Clone ID: 700405168H1
agagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcccttgctaatgttgtgcctggtcttatcggaggcagtgctgatcttgcatcctccaacatgactctgctgaagatgtttggtgacttccagaaggatacagctgaagagcgcaatgtccgcttcggagtcag

SEQ ID NO: 4482 - DNA, 296 bp, Zea mays
  Clone ID: 700089307H1
ggccacagtcaaggagccggacacaccgaagcggagcacctgaggccgattggaacgctatgtttgcagagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcgcttgctaatgttgtgcctggtcttattggaggcagtgctgatcttgcatcctccaacatgactctgctgaagatg

SEQ ID NO: 4483 - DNA, 293 bp, Zea mays
  Clone ID: 700355533H1
caggagatgccaccaggaacctctcccagcagtgcctgaacgcgcttgctaatgttgtgcctggtcttattggaggcagtgctgatcttgcatcctccaacatgactctgctgaagatgtttggtgacttccagaaggatacagctgaagagcgcaatgtccgctttggagtcagagagcacggaatgggcgccatttgcacaggcattgctctgcacagcccagggtttgttccgtactgtgctacagtctttgtcttcactgtttacatgagaggtgccatgaggatctcg

SEQ ID NO: 4484 - DNA, 271 bp, Zea mays
  Clone ID: 700085136H1
gtcaagagtcactggagccgccacacacccgaaggtgctgcacttgaggctgattggaacgctatgtttgcagagtacgagaagaagtatgcagatgatgcagcaaccttgaaaagtatcatcacgggggagttacccactggctgggttgatgctcttcctaaatacactccagagagcccaggagatgccaccaggaacctctcccagcagtgcctgaacgcgcttgctaatgttgtgcctggtcttattggaggcagtgctgatcttg

SEQ ID NO: 4485 - DNA, 285 bp, Zea mays
  Clone ID: 700382850H1
ccaccaggaccctctcccagcagtgcctgaacgcgcttgctaatgttgtgcctggtcttattggaggcagtgctgatcttgcatcctccaacatgactctgctgaagatgtttggagacttccagaaggatacagctgaagagcgcaatgtccgctttggagtcagagagcacggaatgggcgccatttgcaacggcattgctctgcacagcccagggtttgttccgtactgtgctacattctttgtcttcactgattacatgagaggtgccatgaggatctcgg

SEQ ID NO: 4486 - DNA, 274 bp, Zea mays
  Clone ID: 700454437H1
ctcgagcgaatcggctcgagatcacgggggagttacccactgcctgggttgatgctcaccctaaatacactccagagagcccaggagatgccaccaggaacctctcccagcagtgcctgaacgcccttgctaatgttgtgcctggtcttatcggaggcagtgctgatcttgcatcctccaacatgactctgctgaagatgtttggtgacttccagaaggatacagctgaagagcgcaatgtccgcttcggagtcagagagcacggaatgggcgc

SEQ ID NO: 4487 - DNA, 187 bp, Zea mays
  Clone ID: 700150022H1
ccactggctgggttgatgctcttcctaaatacactccagagagcccaggagatgccaccaggaacctctcccagcagtgcctgaacgcccttgctaatgttgtgcctggtcttatcggaggcagtgctgatcttgcatcctccaacatgactctgctgaagatgtttggtgacttccagaaggatac

SEQ ID NO: 4488 - DNA, 219 bp, Zea mays
  Clone ID: 700212701H1
gaagtatgcagatgatgcagcaaccttgaaaagtatcatcacgggggagttacccactggctgggttgatgctcttcctaaatacactccagagagcccaggagatgccaccaggaacctctcccagcagtgcctgaacgcgcttgctaatgttgtgcctggtcttattggaggcagtgctgatcttgcatcttccaacatgactctgctgaagatgtt

SEQ ID NO: 4489 - DNA, 177 bp, Zea mays
  Clone ID: 700438654H1
tcttattggaggcagtgctgatcttgcatcctccaacatgactctgctgaagatgtggggtgactcccagaaggatacactgaagagcgcaatgtccgctttggagtcagagagcacggaatgggcgccatttgcaacggcattgctctgcacagcccagggtttgttccgtactgt

SEQ ID NO: 4490 - DNA, 261 bp, Zea mays
  Clone ID: 700458530H1
cgctcgagcgcatcggctcgagatcacgggggagttacccactggctgggttgatgctattcctaaatacactccagagagcccaggagctgccacaggaccctctcccagcagtgcctgaacgcccttgctaatgttgtgcctggtcttatcggaggcagtgctgatcttgcatcctccaacatgactctgctgaagatgtttggtgacttccagaaggatacagctgaagagcgccatgtccgcttcggagtcagagag

SEQ ID NO: 4491 - DNA, 203 bp, Zea mays
  Clone ID: 700262031H1
caggggtcttggcaagctgatagctttctacgatgacaaccacatttccatcgacggagacacggagattgcattcacagaggacgtgagcacccgcttcgaggctcttgggtggcacacgatctgggttaagaatgggaacaccggatatgatgacatccgcgcaccattaaggaggcgaaggcagtcactgacaagcccac

SEQ ID NO: 4492 - DNA, 289 bp, Zea mays
  Clone ID: 700075930H1
gagcgcaatgtccgcttcggagtcagagagcacggaatgggcgccatttgcaacggcattgctctgcacagcccagggtttgttccgtactgtgctacattctttgtcttcactgattacatgagaggtgccatgaggatctcggccctgtctgaagccggagtcatctatgtcatgacccacgactctattggtctcggagaagatggcccgacccatcagcccatcgagcacctggtgagcttccgtgcgatgccgaacatactgatgctccgccctgctgatggca

SEQ ID NO: 4493 - DNA, 305 bp, Zea mays
  Clone ID: 700381012H1
gatgtttggtgacttccagaaggatacagctgaagagcgcaatgtccgcttcggagtcagagagcacggaatgggcgccatttgcaacggcattgctctgcacagcccagggtttgttccgtactgtgctacattctttgtcttcactgattacatgagaggtgccatgaggatctcggccctgtctgaagccggagtcatctatgtcatgacccacgactctattggtctcggagaagatggcccgacccatcagcccatcgagcacctggtgagcttccgtgcgatgccgaacatactgatgc

SEQ ID NO: 4494 - DNA, 275 bp, Zea mays
  Clone ID: 700243701H1
attacatgagaggtgccatgaggatctcggccctgtctgaagccggagtcatctatgtcatgacccacgactctattggtctcggagaagatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcg

SEQ ID NO: 4495 - DNA, 288 bp, Zea mays
  Clone ID: 700220485H1
agcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcgatcgagggcgtggagaagggcgggtacaccatctctgacaactcgaccggcaacaagcctgacatcattgtgatgggcaccggctccgagctggagatcgcggccaaggccgccgacgagctgagga

SEQ ID NO: 4496 - DNA, 280 bp, Zea mays
  Clone ID: 700045165H1
ctgccggagcatacaaagtcgcggtcctcaacaggaagaggccgtccatcctcgctctctccaggcaaaagctccctcacctgcctggcacctcgatcgagggcgtggagaagggcgggtacaccatctctgacaactcgaccggcaacaagcctgacatcattgtgatgggcaccggctccgagctggagatcgcggccaaggccgccgacgagctgaggaaggaggggaagacggtccgcgtcgtctcgttcgtctcctgggaactctttgatgagca

SEQ ID NO: 4497 - DNA, 255 bp, Zea mays
  Clone ID: 701185190H1
gtctcggagaagatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcgatcgagggcgtggagaagggcgggtacaccatctctgacactcgaccggcaacaagcc

SEQ ID NO: 4498 - DNA, 254 bp, Zea mays
  Clone ID: 700552475H1
catctatgtcatgacccacgactctattggtctcggagaagatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcgatcgagggcgtggagaagggcgggtaca

SEQ ID NO: 4499 - DNA, 273 bp, Zea mays
  Clone ID: 700044755H1
ggagatcgcggccaaggccgccgacgagctgaggaaggaggggaagacggtccgcgtcgtctcgttcgtctcctgggaactctttgatgagcagtcggatgagtacaaggagagcgtcctccctgccgccgtcacagcgaggatcagcatcgaggccgggtccactctcggctggcagaagtacgtcggagcccagggcaaggccattggcatcgacaagttcggcgcgagtgctcctgccgggacgatctacaaggagtacggcatcaccgt

SEQ ID NO: 4500 - DNA, 301 bp, Zea mays
  Clone ID: 700051910H1
ctatgtcatgacccacgactctattggtctcggagaggatggcccgacccatcagcccatcgagcacctggtgagcttccgtgcgatgccgaacatactgatgctccgccctgctgatggcaacgagactgccggagcatacaaagtcgcggtcctcaacaggaagaggccgtccatcctcgctctctccaggcaaaagctccctcacctgcctggcacctcgatcgacggcgtggagaatggcgggtacaccatctctgacaactcgaccggcaacaagcctgacctcattgtgatgggc

SEQ ID NO: 4501 - DNA, 276 bp, Zea mays
  Clone ID: 700027425H1
gcctgacatcattgtgatgggcaccggctccgagctggagatcgcggccaaggccgccgacgagctgaggtcatgaggggaagacggtccgcgtcgtctcgttcgtctcctgggaactctttgatgagcagtcggatgagtacaaggagagcgtcctccctgccgccgtcacagcgaggatcagcatcgaggccgggtccactctcggctggcagaagtacgtcggagcccagggcaaggccattggcatcgacaagttcggcgcgagtgctcctg

SEQ ID NO: 4502 - DNA, 300 bp, Zea mays
  Clone ID: 700048347H1
cgacgagctgaggaaggaggggaagacggtccgcgtcgtctcgttcgtctcctgggaactctttgatgagcagtcggatgagtacaaggagagcgtcctccctgccgccgtcacagcgaggatcagcatcgaggccgggtccactctcggctggcagaagtacgtcggagcccagggcaaggccattggcatcgacaagttcggcgcgagtgctcctgccgggacgatctacaaggagtacggcatcaccgtggagagcatcattgcagctgccaagagcttttaagagctaacaacggt

SEQ ID NO: 4503 - DNA, 316 bp, Zea mays
  Clone ID: 700380608H1
ggtgccatgaggatctcggccctgtctgaagccggagtcatctatgtcatgacccacgactctattggtctcggagaggatggcccgacccatcagcccatcgagcacctggtgagcttccgtgcgatgccgaacatactgatgctccgccctgctgatggcaacgagactgccggagcatacatcgccgcggtcctcaacaggaagaggccgtccatcctcgctctctccaggcaaaagctccctcacctgcctggcacctcgatcgagggcgtggagaagggcgggtacaccatctctgacaactcgaccggca

SEQ ID NO: 4504 - DNA, 299 bp, Zea mays
  Clone ID: 700448484H1
ctttgatgagcagtcggatgagtacaaggagagcgtcctccctgctgccgtcacagcgaggatcagcatcgaggccgggtccactcttggctggcagaagtacgtcggagcccagggcaaggccattggcatcgacaagttcggcgcgagtgctcctgccgggacgatctacaaggagtacggcatcaccgtggagagcatcattgcagctgccaagagcttttaagagctaacaacggtctggagttttttttattgtcgtcgttgatgccaaaggaacactgtaccttgaggacagt

SEQ ID NO: 4505 - DNA, 242 bp, Zea mays
  Clone ID: 700184906H1
caggcgtcctccctgctgccgtcacagcgaggatcagcatcgaggccgggtccactcttggctggcagaagtacgtcggagcccagggcaaggccattggcatcgacaagttcggcgcgagtgctcctgccgggacgatctacaaggagtacggcatcaccgtggagagcatcattgcagctgccaagagcttttaagagctaacaacggtctggagttttttttattgtcgtcgttgatgc

SEQ ID NO: 4506 - DNA, 287 bp, Zea mays
  Clone ID: 700048819H1
tctcgagccggtcctcaacaggaagaggccgtccatcctcgctctctccaggcaaaagctccctcacctgcctggcacctcgatcgagggcgtggagaagggcgggtacaccatctctgacaactcgaccggcaacaagcctgacatcattgtgatgggcaccggctccgagctggagatcgcggccaaggccgccgacgagctgaggaaggaggggaagacggtccgcgtcgtctcgttcgtctcctgggaactctttgatgagcagtcggatgagtacaaggaga

SEQ ID NO: 4507 - DNA, 265 bp, Zea mays
  Clone ID: 701167994H1
gtccactctcggctggcagaagtacgtcggagcccagggcaaggccattggcatcgacaagttcggcgcgagtgctcctgccgggacgatctacaaggagtacggcatcaccgtggagagcatcattgcagctgccaagagcctttaagagctaacaacggtctggagtttttcttattgtcgtcgttgatgccaaaggaacactgtacctagaggacatcctatgcctcggagcttggaataatgatgatggagggagcggaag

SEQ ID NO: 4508 - DNA, 336 bp, Zea mays
  Clone ID: 700084375H1
cttcgaggctcttgggtggcacacgatctgggttaagaatgggaacaccggatatgatgacatccgcgcaccattaaggaggcgaaggcagttactgacaagcccaccttgatcaaggtgactaccacgatcggttttggatctcccaacaaggccaactcatacagtgttcatggaagtgcactgggtgccaaataggttgaagcaaccaggcagaaccttggatggccctatgacacattctttgtaccagaggacgtcaagagtcactggagccgccacacacccgaaggtgctgcacttgaggctgattggaacgctaagtttgcagagtac

SEQ ID NO: 4509 - DNA, 275 bp, Zea mays
  Clone ID: 700445226H1
tgatcacccgcttcgaggctcttgggtggcacactatctgggttaagaatgggaacaccggatatgatgacatccgcacaccattaaggaggcgaaggcagttactgacaagcccaccttgatcaaggtgactaccacatcggttttggatctcccaacaaggccaactcatacagtgtttatggaagtgcactgggtgccaaagaggttgaagcaaccaggcagaaccttggatggccctatgacacattctctgtaccagaggacgtcaagag

SEQ ID NO: 4510 - DNA, 286 bp, Zea mays
  Clone ID: 700240770H1
ccggatatgatgacatccgcgcaccattaaggaggcgaaggcagttactgacaagcccaccttgatcaaggtgactaccacgatcggttttggatctcccaacaaggccaactcatacagtgttcatggaagtgcactgggtgccaaagaggttgaagcaaccaggcagaaccttggatggccctatgacacattctttgtaccagaggacgtcaagagtcactggagccgccacacacccgaacgtgctgcacttgaggctgattggaacgctaagtttgcagag

SEQ ID NO: 4511 - DNA, 249 bp, Zea mays
  Clone ID: 700045122H1
cttgggtggcacacgatctgggttaagaatgggaacaccggatatgatgacatccgcgcaccattaaggaggcgaaggcagttactgacaagcccaccttgatcaaggtgactaccacgatcggttttggatctcccaacaaggccaactcatacagtgttcatggaagtgcactgggtgccaaagaggttgaagcaaccaggcagaaccttggatggccctatgacacattctttgtaccagaggacg

SEQ ID NO: 4512 - DNA, 423 bp, Zea mays
  Clone ID: LIB3060-013-Q1-K1-A12
agctccctcacctgcctggcacctcgatcgagggcgtggagaagggcgggtacaccatgtctgacaactcgaccggcaacaagcctgacctcattgtgatgggcaccggctccgagctggagatcgcggccaaggccgccgacgagctgaggaaggagggcaagacggtccgcgtcgtctcgttcgtctcctgggaactctttgatgagcagtcggatgagtacaaggagagcgtcctccctgctgccgtcacagcgaggatcagcatcgaggccgggtccactcttggctggcagaagtacgtcggagcccagggcaaggccattggcatcgacaagttcggcgcgagtgctcctgccgggacgatctacaaggagtacggcatcaccgtggagagcatcattgcagctgccaagaagcttt

SEQ ID NO: 4513 - DNA, 385 bp, Zea mays
  Clone ID: LIB3078-007-Q1-K1-G3
caaccggcaccaagcctgacatcattgggttgggcaccggctccgagctggagatcgcgggcaatgcggccgacgagctgaggaaggaggggaagacggtccgcgtcgtctcgttcgtctcctgggaactctttgatgagcagtcggatgagtacaaggagagcgtcctccctgccgacgtcacagcgaggatcagcatcgaggccgggtccactctcggctggcagaagtacgtcggagcccaaggcaaggccattggcatcgacaagttcggcgcgagtgctcctgccgggacgatctacaaggagtacggcatcaccgtggagagcatcattgcaactgccaagagcttttaagagctaacaacggtctgggagtttttttt

SEQ ID NO: 4514 - DNA, 301 bp, Zea mays
  Clone ID: 700045462H1
gtcatcttccacgtctccaagaccggcggccacctcgggtccagcctcggcgtggtggagctcaccgtcgcgctgcactacgtcttcaacgcgccgcaggaccgcatcctctgggacgtcggccaccagtcgtacccgcacaagatcctgacggggcggcgcgacaagatgccgacgatgcggcagaccaacggcctggcgggcttccccaagcgcgccgagagcgagtacgacagcttcggcacgggccacagctccaccaccatctccgcggcgctcgggatggcggtgggccgggacc

SEQ ID NO: 4515 - DNA, 265 bp, Zea mays
  Clone ID: 700223919H1
cggtgccgcccaactacaaaggcactcccctcgaggtcggcaaaggcaggatcctgcttgagggcgaccgggtggcgctgctggggtacgggtcggcagtgcagtactgcctgactgccgcgtccctggtgcagcgccacggcctcaaggtcaccgtcgccgacgcgaggttctgcaagccgctggaccacgccctgatcaggagcctggccaagtcccacgaggtgctcatcaccgtggaggaaggctccatcggcgggttcgg

SEQ ID NO: 4516 - DNA, 245 bp, Zea mays
  Clone ID: 700256830H1
gtgggccgggacctcaagggcggcaagaacaacgtggtcgcggtgatcggcgacggcgccatgacggccgggcaggcgtacgaggccatgaacaacgccgggtacctggactccgacatgatcgtcatcctcaacgacaacaagcaggtgtccttgcccacggcgacgctcgacgggccggtgccgcccgtaggcgcgctcagcagcgacctcagcaagctgcagtcaagcaggccgctcaagga

SEQ ID NO: 4517 - DNA, 156 bp, Zea mays
  Clone ID: 701169515H1
gaagcaggtcggtggctcagtgcacgagctggcggcgaaggtggacgagtacgcccgcgtcatgatcagcgggcccggctcctcgctcttcgaggagctcggtctctactacatcggccccgtcgacggccacaacatcgacgacctcatcaccat

SEQ ID NO: 4518 - DNA, 271 bp, Zea mays
  Clone ID: 700263420H1
gtgtacgtgacggtagccgacgcccggttctgcaagccgctggacacggcgctgatccgggagctcgccgccgagcacgaggtgctgatcaccgccgaggagggatccatcggcgggttcggctcccacgtcgcacactacctcagcctgaccggcctcctggacgggcccctcaaactgagatccatgttcctgccggaccggtacatcgaccatggcgcaccgcaggaccagatcgaggattcagggctgacgccgcggcacatcgccg

SEQ ID NO: 4519 - DNA, 288 bp, Zea mays
  Clone ID: 701185311H1
ccgacgcccggttctgcaagccgctggacacggcgctgatccgggagctcgccgccgagcacgaggtgctgatcaccgccgaggagggatccatcggcgggttcggctcccacgtcgcccactacctcagcctgaccggcctcctggacgggcccctcaaactgagatccatgttcctgccggaccggtacatcgaccatggcgcaccgcaggaccagatcgatgaggcagggctgacgcgcggcacatcgccgccaccgtgctgtccctgctggggaggccattgga

SEQ ID NO: 4520 - DNA, 340 bp, Zea mays
  Clone ID: 700624329H1
aagagcaccaagaccaccggccccgtcctcatccacgtcgtcaccgagaagggccgcggctacccctacgccgagcgagccgccgacaagtaccacggtgtcgccaagtttgatccggcgaccgggaagcagttcaagtcccccgccaagacgctgtcctacaccaactacttcgccgaggcgctcatcgccgaggcgggccaggacagcaagatcgtggccatccacgcggccatgggcggcggcacggggctcaactacttcctccgccgcttcccgaaccggtgcttcgacgtcgggatcgcggacagcacgccgtcacgttcgggccggctggctg

SEQ ID NO: 4521 - DNA, 245 bp, Zea mays
  Clone ID: 700159091H1
gtaccacggtgtcgccaagtttgatccggcgaccgggaagcagttcaagtcccccgccaagacgctgtcctacaccaactacttcgccgaggcgctcatcgccgaggcggagcaggacagcaagatcgtggccatccacgcggccatgggcggcggcacggggctcaactacttcctccgccgcttcccgagccggtgcttcgacgtcgggatcgcggagcagcacgccgtcacgttcgcggccg

SEQ ID NO: 4522 - DNA, 298 bp, Zea mays
  unsure (1)...(298): unsure at all n locations
  Clone ID: LIB3062-048-Q1-K1-D12
cgatctgcagaagctaccggtaaggttcgtcatggacagggccgggctggtcggcgcggacgggccgacccactgcggggcgttcgacgtcgcgtacatggcctgcctgcccaacatggtcgtcatggccccgtccgacgaggccgagctctgccacatggtcgccaccgccgcggcaatcgacgaccgcccgtcctgcttccgctacccgagaggcaacggcgttggcgtcccgttgccgnccaactacaaaggcactcccctcgaggtcgggcaaagcaggatcctgctggagggc

SEQ ID NO: 4523 - DNA, 333 bp, Zea mays
  unsure (1)...(333): unsure at all n locations
  Clone ID: LIB3068-046-Q1-K1-B2
cagggccgggctggtcggcgcggacgggccgacccactgcggggcgttcgacgtcgcgtgcatggcctgcctgcccaacatggtcgtcatggccccgtccgacgaggccgagctctgccacatggtcgccaccgccgcggcaatcgacgaccgcccgtcctgcttccgctacccgagaggcaacggcgttggcgtcccgttgccgcccaactacaaaggcactcccctcgaggtcggcaaaggcaggatcctgctggagggcgacaccggggngctgctggngtacgggtcgggagtgcagnactggctgaccgtcgcgtacctggtgcagcg

SEQ ID NO: 4524 - DNA, 334 bp, Zea mays
  Clone ID: LIB36-007-Q1-E1-F12
ccaagtcccacgaggtgctcatcaccgtggaggaaggctccatcggcgggttcggctcgcacgtcgcccagttcatggccctggacggccttctcgacggcaaactcaagtggcgaccgctggtgcttcctgacaggtacatcgaccatggatcgccggccgatcagctggccgaggctgggctgacgccgtcacacatcgccgcgtcggtgttcaacatcctggggcagaacagggaggctcttgccatcatggcagtgccaaacgcgtagaacttgtgctgatctgggcctatagagatgattgtacattttgtcgttaactagagtgtctg

SEQ ID NO: 4525 - DNA, 279 bp, Glycine max
  Clone ID: 700646481H1
atgctaagtttgctgagtatgaaaagaaatacaaggaggaagctgcagaattgaaatctattatcaatggtgaattccctgctggttgggagaaagcacttccgacatacactccagagagcccagcggatgccaccagaaacctgtctcaaacaaaccttaatgcccttgcaaaggttcttcccggtctgcttggtggcagtgcagatcttgcttcttccaacatgaccttgctcaaaatgttcggggacttccagaaggatactccagcagagcgta

SEQ ID NO: 4526 - DNA, 246 bp, Glycine max
  Clone ID: 700734535H1
ccttgctcaaaatgttcggggacttccaaaaggatactccagcagagcgtaatgttagattcggtgttagagaacacggaatgggagctatctgcaacggcattgctcttcacagccctggactgattccatattgtgcaaccttctttgtattcactgactacatgagaggtgccataaggctttctgcgctgtctgaggctggggttatttatgtcatgacccatgattcaataggacttggag

SEQ ID NO: 4527 - DNA, 221 bp, Glycine max
  Clone ID: 700865886H1
tcaataaccagtgagagtcacaatcaaatagtagggaatgggttaatccttggaacagggctgattccatattgtgcaaccttctttgtattcactgactacatgagaggtgccataaggctttctgcgctgtctgaggctggggttatttatgtcatgacccatgattcaataggacttggagaagatgggccaacccaccagcctattgagcacctagc

SEQ ID NO: 4528 - DNA, 263 bp, Glycine max
  Clone ID: 700943688H1
cagaaacctgtctcaaacaaaccttaatgcccttgcaaaggttcttcccggtctgcttggtggcagtgcagatcttgcttcttccaacatgaccttgctcaaaatgttcggggacttccaaaaggatactccagcagagcgtaatgttagattcggtgttagagaacacggaatgggagctatctgcaatggcattgctcttcacagccctggactgattccatattgtgcaaccttctttgtattcactgactacatgagag

SEQ ID NO: 4529 - DNA, 308 bp, Glycine max
  Clone ID: 700954594H1
tccttcccatcattctctggcctcaagtcacattctacatgcaaagcagcagcagccacgtcctcgcgtagaaggggtgcttgtccatccaccaacgttgttcgagccgctgcggttgagacactcgaccaaaccaccgaggtttctctggtggagaaatccgtcaacaccattcggtttttggccattgatgcagttgagaaggccaactctggtcaccctggtctccccatggggtgtgctccaatgggtcacattctctacgatgagataatgaggtacaatcctaagaaccccgttggttcaac

SEQ ID NO: 4530 - DNA, 262 bp, Glycine max
  Clone ID: 701064360H1
tgctgtttcagccagagttagcattgaggcaggatcaacatttgggtgggagaaaattgttggagcaaaaggacaagcaataggcattgatcgttttggagctagtgctccagctggaagaatatacaaagaatttggtatcactaaggaagctgttgttgctgcagctaaagagcttatctagaacttttgattttttttgccttctggtgttggttgagagcattccatgtcatgaataagaaaaaggttaaatatcctt

SEQ ID NO: 4531 - DNA, 332 bp, Glycine max
  unsure (1)...(332): unsure at all n locations
  Clone ID: 700662776H1
aaccattggttatggttctcctaacaaggctaactcctacagtgtgcatggaagtgcactgggtgccaaagaagttgangccacaaggcagaaccttggatggtcacatgagccattccacgtgcctgaggatgtcaaaaagcattggagtcgccacacccctgagggtgctgcacttgaagctgaatggaatgctaagtttgctgagtatgaaaagaatacaaggaggaagctgcagaattgaaatctattatcaatggtgaattccctgctggttgggagaaagcacttccgacatacactccagagagcccacgggtgccaccagaaac

SEQ ID NO: 4532 - DNA, 247 bp, Glycine max
  Clone ID: 700663764H1
aaccattggttatggttctcctaacaaggctaactcctacagtgtgcatggaagtgcactgggtgccaaagaagttgatgccacaaggcagaaccttggatggtcacatgagccattccacgtgcctgaggatgtcaaaaagcattggagtcgccacacccctgagggtgctgcacttgaagctgaatggaatgctaagtttgctgagtatgaaaagaaatacaaggaggaagctgcagaattgaaa

SEQ ID NO: 4533 - DNA, 238 bp, Glycine max
  Clone ID: 700952282H1
caaggctaactcctacagtgtgcatggaagtgcactgggtgccaaagaagttgatgccacaaggcagaaccttggatggtcacatgagccattccacgtgcctgaggatgtcaaaaagcattggagtcgccacacccctgagggtgctgcacttgaagctgaatggaatgctaagtttgctgagtatgaaaagaaatacaaggaggaagctgcagaattgaaatctattatcaatggt

SEQ ID NO: 4534 - DNA, 253 bp, Glycine max
  Clone ID: 700835426H1
gggtgccaaagaagttgatgccacaaggcagaaccttggatggtcacatgagccattccacgtgcctgaggatgtcaaaaagcattggagtcgccacacccctgagggtgctgcacttgaagctgagtggaatgctaagtttgctgagtatgaaaagaaatacaaggaggaagctgcagaattgaaatctattatcaatggtgaattccctgctggttgggagaaagcacttccgacatacactccagagagc

SEQ ID NO: 4535 - DNA, 171 bp, Glycine max
  Clone ID: 700738038H1
gttctcctaacaaggctaactcctacagtgtgcatggaagtgcactgggtgccaaagaagttgatgccacaaggcagaaccttggatggtcacatgagccattccacgtgcctgaggatgtcaaaaagcattggagtcgccacacccctgagggtgctgcacttgaagctg

SEQ ID NO: 4536 - DNA, 277 bp, Glycine max
  Clone ID: 700606230H1
atacgagcctttccatgtgccagaagatgttaaaaagcattggagtcgccatacccctgagggtgctaaacttgaagctgagtggaatgccaagtttgcagaatatgagaagaaatacagtgaggaagctgcagagctgaaggctattattactgtgaattaccagctggttgggagaaagcacttccgacatacactccagaaagccctgctgatgctacaagaaatctgtctcagcaaaatctaaatgcccttgttaaggttcttcctggtctac

SEQ ID NO: 4537 - DNA, 268 bp, Glycine max
  Clone ID: 700681196H2
gctacaaggaagaatcttggatggccatacgagcctttccatgtgccagaagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagcaagttgggagaaagcacttccgacatacacaccagaaagccctgctgatgctacaagaaatctgtctcagcaaa

SEQ ID NO: 4538 - DNA, 258 bp, Glycine max
  Clone ID: 700876408H1
taaagaagcaaaggctgtcaaagacaaacccactttgatcaaggtaaccactaccattggatttggttctccaaacaaggctaattcctacagtgttcatgggagtgcattaggtgctaaagaagtggatgctacaaggaagaatcttggatggccatacgagcctttccatgtgccagaagatgtcaagaagcattggagtcgccatacacctgagggtgctaaacttgaagctgagtggaatgccaagtttgtgga

SEQ ID NO: 4539 - DNA, 247 bp, Glycine max
  Clone ID: 700901259H1
gccatacccctgagggtgctaaacttgaagctgagtggaatgccaagtttgcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcaga

SEQ ID NO: 4540 - DNA, 264 bp, Glycine max
  unsure (1)...(264): unsure at all n locations
  Clone ID: 700996991H1
ggagtcgccatacacctgagggtgctaaacttgaagctgagtggtntgccaagtttgtggaatatgagaagcaatacagtgaggaagctgcagagctgaaggctattattactggcgaattaccagctggttgggagaaacacttccgacatacacaccagaaagccctgctgatgctacaagaaatctgtctcagcaaaatctaaatgcccttgttaaggttcttcctggtctacttggtggtagtgcagatcttgcctcttc

SEQ ID NO: 4541 - DNA, 245 bp, Glycine max
  Clone ID: 700876984H1
gtggaatgcgaagtttgcagaatatgagaagacatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcagatcttgcctcttccaacatgaccttgttgaaat

SEQ ID NO: 4542 - DNA, 242 bp, Glycine max
  Clone ID: 700871885H1
tggaatgccaagtttgcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcagatcttgcctcttccaacatgaccttgttgaa

SEQ ID NO: 4543 - DNA, 246 bp, Glycine max
  Clone ID: 700740158H1
gcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttgttaaggttcttcctggtctacttggtggcagtgcagatcttgcctcttccaacatgaccttgttgaaatcatacggagatttccaa

SEQ ID NO: 4544 - DNA, 236 bp, Glycine max
  Clone ID: 700787592H1
ggatgctacaaggaagaatcttggatggccatacgagcctttccatgtgccagaagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaaagcacttccgacatacacaccagaaa

SEQ ID NO: 4545 - DNA, 253 bp, Glycine max
  Clone ID: 700789355H2
attggagtcgccatacccctgagggtgctaaacttgaagctgagtggaatgccaagtttgcagaatatgagaagaaatacagtgaggaagctgcagagctgaaggctattattactggtgaattaccagctggttgggagaaagcacttccgacatacactccagaaagccctgctgatgctacaagaaatctgtctcagcaaaatctaaatgcccttttaaggttcttcctggtctacttggtggcagtgca

SEQ ID NO: 4546 - DNA, 250 bp, Glycine max
  Clone ID: 700786173H2
acagtgttcatgggagtgcgttaggtgctaaagaagtggatgctacaaggtagaatctgggatggccatacgagcctttccatgtgccagaacgtgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaaagc

SEQ ID NO: 4547 - DNA, 268 bp, Glycine max
  unsure (1)...(268): unsure at all n locations
  Clone ID: 700987027H1
aaacaaggctaattcctacagtgttcatnggagtncattaggtgctaaagaagncgatgctacaaggnagaatcttggatggccatacgagcctttccatgtgccagangatgtcaagaagcattggagtcgccatacacctgagggtgctaaacttgaagctgagtggaatgccaagtttgtggaatatgagaagcaatacagtgaggnagctgcagagtgaaggctattattactggcgaattaccagctggttggnananancct

SEQ ID NO: 4548 - DNA, 248 bp, Glycine max
  Clone ID: 700683335H1
tgctaaagaagtggatgctacaaggaagaatcttggatggccatacgagcctttccatgtgccaacagatgtcaagaagcattggagtcgccatacacctgagggtgctaaacttgaagctgagtggaatgccaagtttgtggaatatgagaagcaatacagtgaggaagctgcagagctgaaggctattattactggcgaattaccagctggttgggagaacgcacttccgacatacacaccagaaa

SEQ ID NO: 4549 - DNA, 167 bp, Glycine max
  Clone ID: 700742402H1
tgcacttccgatctacacaccagatagccctgctgatgctacaagaaatctgtctcagcaaaatctaaatgcccttgttaaggttcttcctggtctacttggtggtagtgcagatcttgcctcttccaacatgaccttattggaatcgtatggggatttccaaaaga

SEQ ID NO: 4550 - DNA, 173 bp, Glycine max
  Clone ID: 700682934H1
atgggagtgcattaggtgctaaagaagtggatgctacaaggaagaatcttggatggccatacgagcctttccatgtgccagaagatgtacaagagcattggagtcgccatacacctgagggtgctaaacttgaagctagtggaatgccaagtttgtggaatatgagaagcaat

SEQ ID NO: 4551 - DNA, 298 bp, Glycine max
  unsure (1)...(298): unsure at all n locations
  Clone ID: 701001535H1
ttggatttggttctccaaacaagggctaattcctacagtgttcatgggagtgcattaggtgctaaaagaagtngatgctacaaggaagaatcttggatggccatacgagcctttccatgtgccagaagatgtcaagaagcattggagtcgccatacactgagggtgctaaacttgaagctgagtggaatgccaagtttgtggaatatgagaagcaatacagtgaggaagctgcagagctgaaggctattatactggcgattaccagctggttgggagaaagcattccgacatacacac

SEQ ID NO: 4552 - DNA, 273 bp, Glycine max
  unsure (1)...(273): unsure at all n locations
  Clone ID: 701002017H1
gttagatttggtgttagtgaacatggaatgggagcaatctgtaatggtattgctcttcatagccccggattcattccatactgtgcaactttctttgtcttcactgactacatgagagctgccataaggatttctgcactgtgtgaagctggagttatncnagtgatgactcatgattcgattggacttggagaggatggaccaactcatcagccaatagagcacttggcaagcttcagggcaatgccaaacatttgatgcttcgtccagctg

SEQ ID NO: 4553 - DNA, 295 bp, Glycine max
  Clone ID: 700680946H1
gttaggtttggtgttagagaacatggattgggagcaatctgtaacggtattgctcttcatagttccggattcattccatactgtgcaactttctttgtcttcactgactatatgagagctgccataaggatttctgcactgtgtcgggctggagttatttatgtgatgactcatcattcgattggacttggagaggatggaccaactcatcagccaatagagtatttggcaagcttcagggcaatgcctcacactttgatgcttcgtccagctgatgtatatgaactgctggatc

SEQ ID NO: 4554 - DNA, 260 bp, Glycine max
  Clone ID: 700785920H2
gcaaaatctaaatgcccttgttaaggttcttcctggtctacttggtggtagtgcagatcttgcctcttccaacatgaccttattgaaatcgtatggggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagcttccataagga

SEQ ID NO: 4555 - DNA, 249 bp, Glycine max
  Clone ID: 700741325H1
gcctcttccaacatgaccttgttgaaatcatacggagatttccaaaagaatactcccgaagagcgcaatgttagatttggtgttagagaacatggaatgggagcaatctgtaatggtattgctcttcatagccccggattcattccatactgtgcaactttctttgtcttcactgactacatgagagctgccataaggatttctgcactgtgtgaagctggagttatttatgtgatgactcatgattcg

SEQ ID NO: 4556 - DNA, 252 bp, Glycine max
  Clone ID: 700737257H1
gggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagctgccataaggatttctgcactgtgtgaagctggagttatttatgtgatgactcatgattcgattggacttggagaggatggaccaactcatcagccaa

SEQ ID NO: 4557 - DNA, 255 bp, Glycine max
  Clone ID: 700743637H1
agcagatcttgcctcttccaacatgaccttattgaaatcgtatggggatttccaaaagaatactcccgaagagcgcaatgttaggtttggtgttagagaacatggaatgggagcaatctgtaacggtattgctcttcatagccccggattcattccatactgtgcaactttctttgtcttcactgactatatgagagctgccataaggatttctgcactgtgtgaagctggagttatttatgtgatgactcatga

SEQ ID NO: 4558 - DNA, 260 bp, Glycine max
  Clone ID: 700683536H1
gggagcaatctgtaatggtattgctcttcatagccccggattcattccatactgtgcaactttttttgtcttcactgactacatgagagctgccataaggatttctgcactgtgtgaagctggagttatttatgtgatgactcatgattcgattggacttggagaggatggaccaactcatcagccaatagagcacttggcaagcttcagggcaatgccaaacactttgatgcttcgtccagctgatggtaatgaaactg

SEQ ID NO: 4559 - DNA, 238 bp, Glycine max
  Clone ID: 700899577H1
ccggattcattccatactgtgcaactttctttgtcttcactgactatatgagagctgccataaggatttctgcactgtgtgaagctggagttatttatgtgatgactcatgattcgattggacttggagaggatggaccaactcatcagccaatagagcatttggcaagcttcagggcaatgccaaacactttgatgcttcgtccagctgatggtaatgaaactgctggatcatacaa

SEQ ID NO: 4560 - DNA, 248 bp, Glycine max
  unsure (1)...(248): unsure at all n locations
  Clone ID: 700655539H1
gcaaaatctaaatgcccttgttaaggttcttcctggtctacttggtgnncgtgcagatcttgcctcttccaacanngaccttgttgaaatcatacggagatttccaaaagaatactcccgaagagcgcaatgttagatttggtgttagagaacatggaatgggagcaatctgtaatggtattgcncttcatagccccggattcatccatactgtgcaacttttnttgtcttcatggactacatgagag

SEQ ID NO: 4561 - DNA, 167 bp, Glycine max
  Clone ID: 700743117H1
catgaccttattgaaatcgtattgggatttccaaaagactactcccgaagagcgcaatgttaggtttggtgttagagaacatggaatgggagcaatctgtaacggtattgctcttcatagacccggattcattccatactgtgcaactttctttgtcttcactgact

SEQ ID NO: 4562 - DNA, 90 bp, Glycine max
  Clone ID: 701047167H1
tgactacatgagagctgccataaggatttctgcactgtgtgaagctggagttatttatgtgatgactcatgattcgattggacttggaga

SEQ ID NO: 4563 - DNA, 288 bp, Glycine max
  unsure (1)...(288): unsure at all n locations
  Clone ID: 700557862H1
tgaattccgacaatgggggagcaggactcctggacatcctgagaactttgagacagttggaattgaagtgactacaggtcctcttggtcagggcattgccaatgctgttgggttagcactagctgagaaacacttggctgcacgatttaacaagcctgacaatgagattgttgaccattacacatatgttatattgggtgatggttgtcaaatggagggaatttcaaatgaagcatgctcacttgccggtcactggggtctagggaagcttatngctttaatgatgac

SEQ ID NO: 4564 - DNA, 260 bp, Glycine max
  Clone ID: 701124388H1
caagaccttaaggaattccgacaatggggaagcagaactcctggacatcctgagaactttgagacccttggagttgaagtgaccacaggtcctcttggtcagggcattgccaatgctgttggattagcactagctgagaagcacttggctgcacgatttaacaagcctgacaatgagattgttgaccattacacatatgttatattgggtgatggttgtcaaatggagggaatttcaaatgaagcatgctcacttgccgg

SEQ ID NO: 4565 - DNA, 279 bp, Glycine max
  unsure (1)...(279): unsure at all n locations
  Clone ID: 700977906H1
cgcttggntcaaccntgaccgtttcgttctctctgctggatctggctgcatgctccaatatgctctccttcancttgctggctatnacactgttcaggaacaagaccttaaggaattccgacaatggggaagcagaactcctggacatcctgagaactttgagacccttggagttgaagtgaccacaggtcctcttggtcagggcattgccaatgctgttggattagcatagctgagaagcacttggctgcacgattaacaagcctgacaatgagatgt

SEQ ID NO: 4566 - DNA, 254 bp, Glycine max
  Clone ID: 700741633H1
tgacactgttcaggaacaagaccttaaggaattccgacaatggggaagcagaactcctggacatcctgagaactttgagacccttggagttgaagtgaccacaggtcctcttggtcagggcattgccaatgctgttggattagcactagctgagaagcacttggctgcacgatttaacaagcctgacaatgagattgttgaccattacacatatgttaattgggtgatggttgtcaaatggagggaatttcaaa

SEQ ID NO: 4567 - DNA, 265 bp, Glycine max
  Clone ID: 701214424H1
gttgaaaagggtggttacaccatttcggacaactccactggcaacaagcctgatgtcattttgatcggaactggttcggaattggaaatcgctgccaaagctgctgatgacctaaggaaggaagggaaggctgttagagttgtttcccttgtttcttgggaactttttgatgagcaatcagaagcctacaaggagagtgttttccctgctgctgtttcagccagagttagcattgaggcaggatcaacatttgggtgggagaaaa

SEQ ID NO: 4568 - DNA, 258 bp, Glycine max
  Clone ID: 701214345H1
gttgaaaagggtggttacaccatttcggacaactccactggcaacaagcctgatgtcattttgatcggaactggttcggaattggaaatcgctgccaaagctgctgatgacctaaggaaggaagggaaggctgttagagttgtttcccttgtttcttgggaactttttgatgagcaatcaggagcctacaaggagagtgttttccctgctgctgtttcagccagagttagcattgaggcaggatcaacatttgggtgg

SEQ ID NO: 4569 - DNA, 249 bp, Glycine max
  Clone ID: 700737144H1
gagttgaaaagggtggttacaccatttcggacaactccactggcaacaagcctgatgtcattttgatcggaactggttcggaattggaaatcgctgccaaagctgctgatgacctaaggaaggaagggaaggctgttagagttgtttcccttgtttcttgggaactttttgatgagcaatcagaagcctacaaggagagtgttttccctgctgctgtttcagccagagttagcattgaggcaggatcaa

SEQ ID NO: 4570 - DNA, 273 bp, Glycine max
  Clone ID: 700737045H1
gagttgaaaagggtggttacaccatttcggacaactccactggcaacaagcctgatgtcattttgatcggaactggttcggaattggaaatcgctgccaaagctgctgatgacctaaggaaggaagggaaggctgttagagttgtttcccttgtttcttgggaactttttgatgagcaatcagaagcctacaaggagagtgttttccctgctgctgtttcagccagagttagcattgaggcaggatcaacatttgggtgggagaaaattgttg

SEQ ID NO: 4571 - DNA, 256 bp, Glycine max
  Clone ID: 700684191H1
cactcttcttcttcttcttcttcttcactctacaaccactaaactaagtggttggttttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctgcatgctccaatatgctctcct

SEQ ID NO: 4572 - DNA, 233 bp, Glycine max
  Clone ID: 700871634H1
ctaaactaagtggttggttttggtttagtttcatttttttgaagcgcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagtagccacgtcctcgcgtagaa

SEQ ID NO: 4573 - DNA, 247 bp, Glycine max
  Clone ID: 700896859H1
aactaagtggttggttttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagcagccacgtcctcgcgtagaaggggtgcttgtccatcc

SEQ ID NO: 4574 - DNA, 243 bp, Glycine max
  Clone ID: 700741968H1
aaacactcttcttcttcttcttcttcttcactctacaaccactaaactaagtggttggttttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctacatgc

SEQ ID NO: 4575 - DNA, 215 bp, Glycine max
  Clone ID: 700743285H1
ttttggtttagtttcattgttctgaagctcttaaacttaaggcttaagccatggcatcctcatcctctctgcatctatctcaggcccttctggcacgtgctgtgtaccttcatggctcttcttctctgaccgtgtctcactctccttcccatcattctctggcctcaagtcacattctacatgcaaagcagcagcagccacgtcctcgcgtagaa

SEQ ID NO: 4576 - DNA, 277 bp, Glycine max
  Clone ID: 701105794H1
ttcttcttcttcactctacaaccactaaactaagtggttggttttggtttagtttcatttttttgaagctcttaaacttaaggcttaagccatggcatcctcatcctctctgcatctacctcaggcccttctggcacgtgctgtgtaccttcatggctcttcttcttctgaccgtgtctcactctccttcccatcattctctggcctcaagtcacattctacatgcaaagcagcagcagccacgtcctcgcgtagaaggggtgcttgtccatccacc

SEQ ID NO: 4577 - DNA, 289 bp, Glycine max
  Clone ID: 700646243H1
tcttcttcttcttcttcttcactctacaaccactaaactaagtggttggttttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagcagccacgtcctcgcgtagaaggggtgcttgtccatccaccaacg

SEQ ID NO: 4578 - DNA, 220 bp, Glycine max
  Clone ID: 701104160H1
tcttcttcttcactctacaaccactaaactaagtggttggctttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattcta

SEQ ID NO: 4579 - DNA, 255 bp, Glycine max
  Clone ID: 700741863H1
cttcttcttcttcttcttcttcactctacaaccactaaactaagtggttggttttggtttagtttcatttttttgaagctcttaaacttaaggcttaagccatggcatcctcatcctctctgcatctatctcaggcccttctggcacgtgctgtgtaccttcatggctcttcttcttctgaccgtgtctcactctccttcccatcattctctggcctcaagtcacattctacatgcaaagcagcagcagccacgt

SEQ ID NO: 4580 - DNA, 333 bp, Glycine max
  unsure (1)...(333): unsure at all n locations
  Clone ID: 700651076H1
anattgtagaccantanacatatgtnatattnggtgatggntgtcaaatggagggantntcaaatgaagcatgctcacttgccggtcactggggtctagggaagcttatngcttnatatgatgacaaccacatttccattgatggggacactgagattgcattcactgagaatgttgatcaacgttttgaggcacttgggtggcatgtaatttgggtgaagaatggaaatactggatatgatgaaattcgtgcagccattaaggaagcaaaggctgtcaaagacgaacccactatgatccaggtaaccactaccattggattggttctccaaa

SEQ ID NO: 4581 - DNA, 260 bp, Glycine max
  Clone ID: 700874803H1
aacaagcctgacaatgagattgttgaccattacacatatgttatattgggtgatggttgtcaaatggagggaatttcaaatgaagcttgctcacttgccggtcactggggtctaggaaagctcattgctttatatgatgacaatcacatttccattgatggtgacactgagattgcattcactgagaatgttgatcagcgttttgaagcacttggatggcatgtaatttgggtgaagaatggaaatactggatatgatga

SEQ ID NO: 4582 - DNA, 288 bp, Glycine max
  unsure (1)...(288): unsure at all n locations
  Clone ID: 700988611H1
cacttggctgcacgatttaacaatcctgncantgagattgttgaccattanacatatgttatattgggtgatggttgtcaaatggagggaatttcaaatgaagcatgctcacttgccgnctcactggggtctagggaagcttattgctttntatgatgacaaccacatttccattnctggggacactgagattgcattcactgagantgttgatcaacgtttgaggcacttgggtggcatgtaatttgggtgaagaatgganatactggatatgatgaaattcgtgcg

SEQ ID NO: 4583 - DNA, 242 bp, Glycine max
  Clone ID: 700657810H1
gaatttcaaatgaagcatgctcacttgccggtcactggggtctagggaagcttattgctttatatgatgacaaccacatttccattgatggggacactgagattgcattcactgagaatgttgatcaacgttttgaggcacttgggtggcatgtaatttgggtgaagaatggaaatactggatatgatgaaattcgtgcagccattaaggaagcaaaggctgtcaaagacaaacccactatg

SEQ ID NO: 4584 - DNA, 251 bp, Glycine max
  Clone ID: 700739094H1
caaatggagggaatttcaaatgaagcatgctcacttgccggtcactggggtctagggaagcttattgctttatatgatgacaaccacatttccattgatggggacactgagattgcattcactgagaatgtgatcaacgttttgaggcacttgagtggcatgtaatttgggtgaagaatggaaatactggatatgatgaaattcgtgcagccattaaggaagcaaaggctgtcaaagacacccactatgat

SEQ ID NO: 4585 - DNA, 245 bp, Glycine max
  Clone ID: 700962626H1
gcacgatttaacaagcctgacaatgagattgttgaccattacacatatgttatattgggtgatggttgtcaaatggagggaatttcaaatgaagcatgctcacttgccggtcactggggtctagggaagcttattgctttatatgatgacaaccacatttccattgatggggacactgagattgcattcactgagaatgttgatcaacgttttgaggcacttgggtggcatgtaatttgggtgaa

SEQ ID NO: 4586 - DNA, 249 bp, Glycine max
  unsure (1)...(249): unsure at all n locations
  Clone ID: 700990046H1
gttgatcangcgttttgnaagcacttggatggcatgtaatttgggtgaagnatggaaatactggatatgatgaaattgcgtgcagccattaaagaagnaaaggctgtcaaagacaaacccactttgatcaaggtanccactagnattggattaggttctccaaacaaggctaattcncacagtgttcatgggncgtgcattaggtgctaaagaagtggatgctacnangnanaatnttggatggcnata

SEQ ID NO: 4587 - DNA, 240 bp, Glycine max
  Clone ID: 700870543H1
cattgatgcagttgagaaggccaactctggtcaccctggtctccccatggggtgtgctctaatgggctcacattctctacgatgagataatgaggtacaattctaagaaccccgcttggttcaaccgtgacgtttcgttctctctgctggacatggctgcatgctccaatatgctctccttcaccttgctggctatgacactgttcaggaacaagaccttaaggaattccgacaatgggg

SEQ ID NO: 4588 - DNA, 283 bp, Glycine max
  Clone ID: 700556949H1
caagattgttggaagcaaaggaaaggccataggcattgatcgatttggagcaagtgctccagctggaaaaatatacaaggagtttggtatcaccaaggaagctgttattgctgctgccaaagaactttcgtagatatatttgttgagtttcttttatctcatctagaacttgtggttttcacttgtggctttgggttactgttacatgacttgttttttgagatatcactttagccacaataaggaagattagatgttctgcatatgattgtcagaggaacca

SEQ ID NO: 4589 - DNA, 259 bp, Glycine max
  Clone ID: 700877014H1
caagattgttggaagcaaaggaaaggccataggcattgatcgatttggagcaagtgctccagctggaaaaatatacaaggagtttggtatcaccaaggaagctgttattgctgctgccaaagaactttcgtagatatatttgttgagtttcttttatctcatctagaacttgtggttttcacttgtggctttgggttactgttacatgacttgttttttgagatatcactttagccacaataaggaagattagattgtt

SEQ ID NO: 4590 - DNA, 256 bp, Glycine max
  Clone ID: 700877022H1
caagattgttggaagcaaaggaaaggccataggcattgatcgatttggagcaagtgctccagctggaaaaatatacaaggagtttggtatcaccaaggaagctgttattgctgctgccaaagaactttcgtagatatatttgttgagtttcttttatctcatctagaacttgtggttttcacttgtggctttgggttactgttacatgacttgttttttgagatatcactttagccacaataaggaagattagatt

SEQ ID NO: 4591 - DNA, 271 bp, Glycine max
  unsure (1)...(271): unsure at all n locations
  Clone ID: 700999039H1
aaaggaaaggccataggcattgatcgatttggagcaagtgctccagctggaaaaatatacaaggagtttggtatcaccaaggaagctgttattgctgctgccaaagaactttcgtaatatatttgttgagtntcttttatctcatctagaacttgtggttttcacttgtggctttgggttactgttacatgacttgttttttgagatatcactttagccacaatanggaagatagattgttcttgcatatgattgtcagaggaaccactta

SEQ ID NO: 4592 - DNA, 258 bp, Glycine max
  unsure (1)...(258): unsure at all n locations
  Clone ID: 700998419H1
tctgcactgtgtgaagctggagttatttatgtgatgactcatgattcgattggacttggagaggatggaccaactcatcagccaatagagcatttggcaagcttcagggcaatgccaaacactttgatgcttgtccagctgatggnaatgaaactgctggatcatacaaagttgctgtggttaacaggaagagaccctcaattcttgcactttctaggcaaaagttgacccaacttccagganttctattgagggagt

SEQ ID NO: 4593 - DNA, 209 bp, Glycine max
  Clone ID: 700557019H1
gctgatggtaatgaaactgctggatcatacaaagttgctgtggttaacaggaagagaccctcaattcttgcactttctaggcaaaagttgacccaacttccaggaacttctattgagggagttgaaaagggtggctacaccatttcagacaactcatcaggtaacaagcctgatgttattttgattggaactggttctgagttggaaat

SEQ ID NO: 4594 - DNA, 257 bp, Glycine max
  Clone ID: 700786020H2
cgaccaactcatcagccaatagagcatttggcaagcttcagggcaatgccaaacacttagatgcttcgtccagctgatggtaatgaaactgctggatcatacaaagttgctgtggttaacaggtagagaccctcaattcttgcactttctaggcaaaagttgacccaacttccaggaacttctattgagggatttgaaaagggtggctacaccattctcgaacagctcatcaggtaacaagccggatgttattttga

SEQ ID NO: 4595 - DNA, 246 bp, Glycine max
  Clone ID: 700740475H1
gctgtggttaacaggaagagaccctcaattcttgcactttctaggcaaaagttgacccaacttccaggaacttctattgagggagttgaaaagggtggctacaccatttcagacaactcatcaggtaacaagcctgatgttattttgattggaactggttctgagttggaaattgctgctgctgctgctgaggatctaggaaaggaaggaaaagctgttagagttgtttcttttgttagctgggaa

SEQ ID NO: 4596 - DNA, 168 bp, Glycine max
  Clone ID: 700875020H1
gaccaactcatcagccaatagagcacttggcaagcttcagggcaatgccaaacactttgatgcttcgtccagctgatggtaatgaaactgctggatcatacaaagttgctgtggttaacaggaagagaccctcaattcttgcactttctaggcaaaagttgacccaac

SEQ ID NO: 4597 - DNA, 168 bp, Glycine max
  Clone ID: 700674249H1
aattcttgcactttctaggcaaaagttgacccaacttccaggaacttctattgagggagttgaaaagggtggctacaccatttcagacaactcatcaggtaacaagcctgatgttattttgattggaactggttctgagttggaaattgctgctgctgctgctgagga

SEQ ID NO: 4598 - DNA, 254 bp, Glycine max
  unsure (1)...(254): unsure at all n locations
  Clone ID: 700658256H1
ctcatgattcgattggacttgggagaggatggaccaactacatcagccaatagagcatttngcaagcttcagggcaatgccaaacacttncntgcttcgtccagctatggtaatgaaactgctggatcatacaaagttgctgtggttaacaggaagagaccctcaattcttgcactttctagncaaaagttgacccaacttccaggaacttctattggaggtgaaaagggtggctacaccatttcaganaactc

SEQ ID NO: 4599 - DNA, 117 bp, Glycine max
  Clone ID: 700677401H1
aattcttgcacttgctaggcaaaagttgacccagcttccaggaacttctattgagggagttgaaaagggtggctacaccatttcagacaactcatcaggtaacaagcctgatgttat

SEQ ID NO: 4600 - DNA, 263 bp, Glycine max
  Clone ID: 700874020H1
atgagaggtgccataaagctttctgcgctgtctgaggctggggttatttaatgtcatgacccatgattcaataggacttggagaagatgggccaacccaccagcctattgagcacctagcaagcttccgggcaatgccaaacattttgatgcttcgtcccgccgacggtaacgaaacagccggagcatacaaagtggccgtgctcaacaggaagagaccctccattcttgccctatccaggcaaaaactgccccagcttcccg

SEQ ID NO: 4601 - DNA, 257 bp, Glycine max
  Clone ID: 700726463H1
cattttgatgcttcgtcctgccgacggtaacgaaacagccggagcatacaaagtggccgtgctcaacaggaagagaccctccattcttgccctatccaggcaaaaactgccccagcttcccggaacttccattgaaggagttgaaaagggtggttacaccatttcggacaactccactggcaacaagcctaatgacatttggaccggaactggttcggaattggaaatcgctgccaaagctgctgatgacctaagga

SEQ ID NO: 4602 - DNA, 259 bp, Glycine max
  Clone ID: 700869017H1
ctcgagtcatgacccatgattcaataggacttggagaagatgggccaacccaccagcctattgagcacctagcaagcttccgggcaatgccaaacattttgatgcttcgtcccgccgacggtaacgaaacagccggagcatacaaagtggccgtgctcaacaggaagagaccctccattcttgccctatccaggcaaaaactgccccagcttcccggaacttccattgaaggagttgaaaagggtggttacaccatttc

SEQ ID NO: 4603 - DNA, 134 bp, Glycine max
  unsure (1)...(134): unsure at all n locations
  Clone ID: 700566216H1
ttggagaagatgggccaacccaccagcctattgagcacctagnnagcttccgggcaatgccaaacattttgatgcttcgtcccgccgacggtaacgaaacagccgnagcataccaagtggccgtgtcaacaggg

SEQ ID NO: 4604 - DNA, 387 bp, Glycine max
  Clone ID: LIB3051-053-Q1-K2-F1
cccacgcgtccgcccacgcgtccgggtcacaacaaccattggttatggttctcctaacaaggctaactcctacagtgtgcatggaagtgcactgggtgccaaagaagttgatgccacaaggcagaaccttggatggtcacatgagccattccacgtgcctgaggatgtcaaaaagcattggagtcgccacacccctgagggtgctgcacttgaagctgaatggaatgctaagtttgctgagtatgaaaagaaatacaaggaggaagctgcagaattgaaatctattatcaatggtgaattccctgctggttgggagaaagcactttcgacatacactccagagagcccagcggatgccaccagaaacctgtctcaaacaaaccttaa

SEQ ID NO: 4605 - DNA, 356 bp, Glycine max
  Clone ID: LIB3039-045-Q1-E1-D1
gacccacgcgtcagacagctgcgagaagacgacagaagggggggttatttatgtcatgacccatgattcaataggacttggagaagatgggccaacccaccaccctattgagcacctagcaagcttccgggcaatgccaaacattttgatgcttcgtcccgccgacggtaacgaaacagccggagcatacaaagtggccgtgctcaacaggaagagaccctccattcttgccctgtccaggcaaaaactgccccagcttcccggaacttccattgaaggagttgaaaagggtggttacaccatttcggacaactccactggcaacaagcctgatgtcattttgatcggaactggtt

SEQ ID NO: 4606 - DNA, 240 bp, Glycine max
  Clone ID: 700907766H1
caacaagcaggtttctttaccaactgctactcttgatggacccataccacctgtaggagccttgagtagcgctctcagtagattacaatcaaataggcctcttagagaattgagagaggttgccaagggagttcctaaacgaattggaggtcctatgcatgaattggctgcaaaagttgacgagtatgctcgtggcatgatcagtggttctggatcatcactttttgaagagcttggact

SEQ ID NO: 4607 - DNA, 309 bp, Glycine max
  Clone ID: 700764341H1
aatgcagggtaccttgactctaacatgataattatacttaatgacaacaagcaagtttctttgcctactgctactattgatggtcctgcaactccaattggagcccgcaatagtgccttaagcaaaattcaagcaagcaccaaataccgcaaactgagagaagctgcgaaaggcatcacaaagcagataggaggaacaacacacaacttgcagcaaaggtagatgagtatgcaagaggtatgatcagtggttctagtactacacttgttgaggagctcggcttatactacatatgccctgtggatggtc

SEQ ID NO: 4608 - DNA, 233 bp, Glycine max
  Clone ID: 700888745H1
aaaacaactggtcctgtgctgctccatgttgtcactgaaaaaggccatggatatccatatgcagaaagagcagcagattagtaccatggagttactaagtttgatccattaactggaaaacaattcaaattcaatgctgccacccagttatacacaacatactttgcagaggctttaatttctgaagcggaagcttacaaagacattgtcggaatccatgctgcaatgggagg

SEQ ID NO: 4609 - DNA, 268 bp, Glycine max
  Clone ID: 700909473H1
tgtgattctgtatgatagccgtcactctttacttccaaaaattgaggagggcccaaagacatttgtcaatgccctatctagtaccctgagcaagctccagtccagtaaatctttccggagatttagagaagctgctaggggtgttacgaaacgaattggtaggtctgcatgaattggcagctaaagtggatgaatatgctcgtggtatgatgggtcctctaggtgctactctttttgaagagcttgggttgtactacataggcccagt

SEQ ID NO: 4610 - DNA, 162 bp, Glycine max
  Clone ID: 700681472H2
cttccttgttggaacatcatggcttgcgcgcaacagtggctgatgcacgtttctgcaagccattggaccgttctcttattcttagccttgcccaatcgcacgaggttttgatcactgtggaagaagggcaataggaggattcggatctcatgttgttcagtt

SEQ ID NO: 4611 - DNA, 232 bp, Glycine max
  Clone ID: 700751059H1
gatctctccgctctctcatcataccgcactctcgggtagttacttcctcttccctctcactctcaatggggtctccatttcctcgcccacgctcaccgcctccaccagatgaagaaaaggccatgtggggtatatgcatccctctccgagagtggagagtattattcccaccgaccgccaactcccctactagacaccgtcaactatcctattcatatgaagaatctctctg

SEQ ID NO: 4612 - DNA, 415 bp, Glycine max
  unsure (1)...(415): unsure at all n locations
  Clone ID: LIB3051-093-Q1-K1-D2
cgcggatgaactgcgttctgatgttattttcagtgtttctagaactgggggccatttgggctcaagccttggtgtggtggaactcactgttgcacttcactatgtcttcaatgcccctcaggacaagatactgtgggacgttggtcaccaggttggttttcaacttccttgctgctttttgctttacttgttctaaactaaattggacaaccttgtatgaatttgcagtcttacccgcataagatactcaccggtagaagggaccagatgcataccatgaggcagacaaatggcttatctggcttcaccaaacgttctgagagtgaatntgattgttttggcactgggcacagctccaccaccatttcggcaggacttggaatggctgttgggagggatctgaaagggaagaaag

SEQ ID NO: 4613 - DNA, 242 bp, Zea mays
  Clone ID: 700423931H1
gctagttgcaagcaccagccgaccaccaaacgatagcgcacgcggacaatttaacagcatcaggtttaggccctgctgccgtcgtcgagcgcccgggccaccgcacacctgaaagcaatggagatcgtcgccacgcgctccccggcctgctgcgccgccgtgtccttctcccagtcgtacaggcccaaggcgtccaggccgccgaccacgttctacggcgagtcggtgcgggtgaatacggc

SEQ ID NO: 4614 - DNA, 470 bp, Zea mays
  unsure (1)...(470): unsure at all n locations
  Clone ID: LIB36-010-Q1-E1-H12
ttcgctttgcctaggcgtacngtatcggagttcgcgcgtggacgcacgcgtacgccaacttcggagtctggcccggcgacaagctgaccggagtgaccggcggcgaccaggtcgctgccgcgatgggcatctacggtcctcgcacgacctacattgtcgccctcaaggattgccctgggacgcacgagttcctcctcctcgacgaaggtaaatggcagcatgtgaaggacaccacgaccattggggaagggaagatgttctctcctgggaatctgacggcgacattcgataaccctgagtacgacaagctcatcaactactacgtcaaggagaagtacacattgcgctacactggtggaatggttcccgatgtcaaccagatcatactgaatgataatggcatcttcaccaacgtgacgtccccgacggccaaggctaagctgcggctcctcttcgaggtggcgcccctg

SEQ ID NO: 4615 - DNA, 264 bp, Glycine max
  Clone ID: 700895707H1
cttcaccaacgtgtcatcaccatcagccaaagccaaactgagactgttgtttgaggtagctcctttggggttcttgattgaaaaagctggaggttacagcagtgatggtcatcagtctgtgctagacaaagtcatcagtaacattgatgacagaactcaagttgcttatgggtccaagaatgagataatccggtttgaagaaaccctgtatggtaaatccaggctcaagggtggtgtagctgttggagcagctgcttaatctgt

SEQ ID NO: 4616 - DNA, 274 bp, Glycine max
  Clone ID: 701154827H1
gctgcgagaagacgacagaagggggggttttgggtcctagaacaacatatgtgcttgctctaaaagacttccctggcacccatgaatttcttctgcttgatgaaggaaaatggcagcatgtcaaagagaccacagaaattggtgaaggaaaactgttctccccaggaaatttgagagccacatctgacaaccccgattatgctaagttgatcgattactatgtcaatgaaaagtacacattgagatacactggaggaatggtgccagacgtcaa

SEQ ID NO: 4617 - DNA, 244 bp, Glycine max
  Clone ID: 701157439H1
ggggttttgggtcctagaacaacatatgtgcttgctctaaaagacttccctggcacccatgaatttcttctgcttgatgaaggaaaatggcagcatgtcaaagagaccacagaaattggtgaaggaaaactgttctccccaggaaatttgagagccacatctgacaaccccgattatgctaagttgatcgattactatgtcaatgaaaagtacacattgagatacactggaggaatggtgccag

SEQ ID NO: 4618 - DNA, 299 bp, Glycine max
  unsure (1)...(299): unsure at all n locations
  Clone ID: 700988602H1
aagaatacttcactcgtgaccagatgtgaaattggtgacagtctcgaaganttcctcacaaaancaacaccagatnaggggttgatcaggttgttggtgtccatgggagaagcattgagaacaatttccttcaaagtgaagacggcttcatgtggtggaacacaatgtgttaatacttttggggatgagcagcttgcagtggatttgctagctaatcagcttctttttgaggccttaaattactctcatttctgcnagtatgcttgctctgaagaaaatcctgagctcttggncatggg

SEQ ID NO: 4619 - DNA, 292 bp, Glycine max
  Clone ID: 701001010H1
attggtgacagtctcgaagaattcctcacaaaagcaacaccagataaggggttgatcaggttgttggtgtccatgggagaagcattgagaacaatttccttcaaagtgaagacggcttcatgtggtggaacacaatgtgttaatacttttggggatgagcagcttgcagtggatttgctagctaatcagcttctttttgaggccttaaattactctcatttctgcaagtatgcttgctctgaagaaaatcctgagctcttggacatgggaggtccagttgaaggtggattta

SEQ ID NO: 4620 - DNA, 270 bp, Glycine max
  Clone ID: 700997516H1
tgatcaggttgttggtgtccatgggagaagcattgagaacaatttccttcaaagtgaagacggcttcatgtggtggaacacaatgtgttaatacttttggggatgagcagcttgcagtggatttgctagctaatcagcttctttttgaggcctaaattactctcatttctgcaagtatgcttgctctgaagaaaatcctgagctcttggacatgggaggtccagttgaaggtggatttagtgttgcatttgatccccttgatggctccag

SEQ ID NO: 4621 - DNA, 267 bp, Glycine max
  Clone ID: 700788686H1
gcagcttgcagtggatttgctagctaatcagcttctttttgaggccttaaattactctcatttctgcaagtatgcttgctctgaagaaaatcctgagctcctggacatgggaggtccagttgaaggtggatttagtgtcgcatttgatccccttgatggctccagcattgtggacacaaatttcacagtaggcaccatctttggtgtgtggcctggagataagttgactgggatcaccggaagagatcaagttgctgcagccatggg

SEQ ID NO: 4622 - DNA, 286 bp, Glycine max
  Clone ID: 700556469H1
gaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataaggggttgatcaggttgttggtgtccatgggagaagcattgagaacaatttccttcaaagtgaagacggcttcatgtggtggaacacaatgtgttaatacttttggggatgagcagcttgcagtggatttgctagctatc

SEQ ID NO: 4623 - DNA, 280 bp, Glycine max
  unsure (1)...(280): unsure at all n locations
  Clone ID: 700999494H1
ttggcttgaggagtctgaaatcgagctctttatttggagaatctctaagagtggcatccaaatcaacactaaaggtttcaaanacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtggtggaacacaatgtgttaatacttttggggacgagcagct

SEQ ID NO: 4624 - DNA, 270 bp, Glycine max
  Clone ID: 701106923H1
gcagcttgcagtggatttgctagctaatcagcttctttttgaggccttaaattactctcatttctgcaagtatgcttgctctgaagcaaatcctgagctcttggacatgggaggtccagttgaaggtggatttagtgttgcatttgatccccttgatggctccagcattgtggacacaaatttcacagtaggcaccatctttggtgtgtggcctggagataagttgaccggcatcaccggaagagatcaagttgctgcagccatgggggt

SEQ ID NO: 4625 - DNA, 281 bp, Glycine max
  Clone ID: 700557386H1
agaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgttgtgtccatgggagaagcattaagaacaatttccttcaaagtgaagacggcttcttgtggtggaacacaatgtgttaatacttttggggacgagcagcttgcagtggatttgctagctaatcagcttctttttgaggc

SEQ ID NO: 4626 - DNA, 247 bp, Glycine max
  unsure (1)...(247): unsure at all n locations
  Clone ID: 700996203H1
gaacacaatgtgttaatacttttggggatgagcagcttgcagtggatttgctagctaatcagcttctttttgaggccttaaattactctcatttctgcaagtatgcttgctctgaagaaaatcctgagctcttggacatgggaggtccagttgaaggtggatttagtgttgcatttgatccccttgatggctccagcattgtggacacaaatttcncagtaggcaccatctttggtgtgtggcctgg

SEQ ID NO: 4627 - DNA, 262 bp, Glycine max
  Clone ID: 700951860H1
ctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtggtggaacacaatgtgttaatactttggggacgagca

SEQ ID NO: 4628 - DNA, 274 bp, Glycine max
  Clone ID: 700683415H1
atcagcttctttttgaggccttaaattactctcatttctgcaagtatgcttgctctgaagaaaatcctgagctcctggacgtgggaggtccagttgaaggtggatttagtgtcgcatttgatccccttgatggctccagcattgtggacacaaatttcacagtaggcaccatctttggtgtgtggcctggagataagttgactgggatcaccggaagagatcaagttgctgcagccatgggggttttggggtctagaacaacatatgtgcttgc

SEQ ID NO: 4629 - DNA, 239 bp, Glycine max
  Clone ID: 700872306H1
atccaaatcaacactaaaggtttcaaagacaaagaatacttcactcgtgaccagatgtgaaattggtgacagtctggaagaattcctcacaaaagcaacaccagataaggggttgatcaggttgttggtgtccatgggagaagcattaagaacaatttcctccaaagtgaagacggcttcttgtggtggaacacaatgtgttaatacttttggggacgagcagcttgcagtggatttgc

SEQ ID NO: 4630 - DNA, 237 bp, Glycine max
  Clone ID: 700876576H1
aaattactctcatttctgcaagtatgcttgctctgaagaaaatcctgagctcctggacatgggaggtccagttgaaggtggatttagtgtcgcatttgatccccttgatggctccagcattgtggacacaaatttcacagtaggcaccatctttggtgtgtggcctggagataagttgactgggatcaccggaagagatcaagttgctgcagccatgggggttttgggtcctagaac

SEQ ID NO: 4631 - DNA, 241 bp, Glycine max
  Clone ID: 700876860H1
atccaaatcaacactaaaggtttcaaagacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtggtggaacacaatgtgttaatacttttggggacgagcagcttgcagtggatttgcta

SEQ ID NO: 4632 - DNA, 256 bp, Glycine max
  Clone ID: 700874809H1
gtctgaaatcaagctctttatttggagaatcgctaagagtggcctccaaatcaacaataaaggtttcaaagacaaagaatacttcactcgtgaccagatgtgaaattggtgacagtctcgaagaattcctcaaaaagcaacaccagataaggggttgatcaggttgttggtgtccatgggagaagcattgagaacaatttccttcaaagtgaagacggcttcatgtggtggaacacaatgtgttaatacttttggg

SEQ ID NO: 4633 - DNA, 269 bp, Glycine max
  unsure (1)...(269): unsure at all n locations
  Clone ID: 700992772H1
cttaaattactctcatttctgcaagtatgcttgctctgaagaaaatcctgagctcctggacatgggaggtccagttgaaggtggatttagtgtcgcatttgatccccttgatggctccagcattgtggacacaaatttcacagtaggcaccatctttggtgtgtggcctggagataagttgactgggatcaccggaagagatcaagttgctgcagccatgggggtttgggtcctagaacaacntctgtgcttgctctaaaagacttccc

SEQ ID NO: 4634 - DNA, 237 bp, Glycine max
  Clone ID: 700740276H1
gaaatcgagctctttatttggagaatctctaagagtggcatccaaatcaacactaaaggtttcaacgacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtggtggaacacaatg

SEQ ID NO: 4635 - DNA, 241 bp, Glycine max
  Clone ID: 700876171H1
ctccagcattgtggacacaaatttcacagtaggcaccatctttggtgtgtggcctggagataagttgactgggatcaccggaagagatcaagttgctgcagccatgggggttttgggtcctagaacaacatatgtgcttctctaaaagacttccctggcacccatgaatttcttctgcttgatgaaggaaaatggcagcatgtcaaagagaccacagaaattggtgaaggaaaactgttct

SEQ ID NO: 4636 - DNA, 293 bp, Glycine max
  unsure (1)...(293): unsure at all n locations
  Clone ID: 700557859H1
anaatctctaagagtggcatccaaatcaacactaaaggtttcaaagacaaagaatacttcactcgtgaccagatgtganattngtgacagtctggaagaattcctcacnaaagcancaccagataaggggttgatcaggttgttggtgtccatgggagaagcattaagaacaatttccttcaaagtgaagacngnttcttgnggtggancacaatgngtnaatacttttggggncgngcaagcttgcagtggatttgctagctaatcagcttctttttgangccttaattatc

SEQ ID NO: 4637 - DNA, 290 bp, Glycine max
  Clone ID: 700556904H1
gcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgttggtgtccagggagaagcattaagaacaatttccttcaaagtgaagacgg

SEQ ID NO: 4638 - DNA, 276 bp, Glycine max
  Clone ID: 701124349H1
cataacctcgaactcgagccgaatcggctcgagctcgagccagatttcacttcaaagtggcagacggcttgcatgtgagtggaacacaatgtgtctatacctttatggggatgagcagcttgcagtggatttgctagctaatcagcttctttttgaggcctaaattactctcatttctgcaagtatgcttgctctgaagaaaatcctgagctcttggacatggggacctcagttgaaggtggatttagtgttgcatttgatccccttgatggctcc

SEQ ID NO: 4639 - DNA, 281 bp, Glycine max
  unsure (1)...(281): unsure at all n locations
  Clone ID: 700554878H1
ggcatagcatgctacactcgcgggcctttcttgcctagtgtntcttccaagcactctccaccttccatttctccatcttttggcttgaggagtctgaaatcaagctctttatttggagaatcgctaagagtggcctccaaatcacaataaaggtttcaaagacaaagaatacttcactcgtgaccagatgtgaaattggtgacagtctcgaagaattcctcacaaaagcaacaccagatnaggggntgatcaggttgttggtgtccatgggagaagcattg

SEQ ID NO: 4640 - DNA, 281 bp, Glycine max
  Clone ID: 700556561H1
cgttttgcagccatggaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgtt

SEQ ID NO: 4641 - DNA, 266 bp, Glycine max
  unsure (1)...(266): unsure at all n locations
  Clone ID: 701001629H1
ggaaacaggcatagcatgctacactcgcgggcctttcctgcctagtgtttcttccaagcactctccaccctccatctctccatcntttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgt

SEQ ID NO: 4642 - DNA, 258 bp, Glycine max
  Clone ID: 700789624H2
ggaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgat

SEQ ID NO: 4643 - DNA, 262 bp, Glycine max
  unsure (1)...(262): unsure at all n locations
  Clone ID: 700993071H1
ganacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggt

SEQ ID NO: 4644 - DNA, 282 bp, Glycine max
  Clone ID: 700556185H1
tttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataaggggttgatc

SEQ ID NO: 4645 - DNA, 285 bp, Glycine max
  unsure (1)...(285): unsure at all n locations
  Clone ID: 700554166H1
gncatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataaggggttgatcagttgttggtgtccagggaga

SEQ ID NO: 4646 - DNA, 261 bp, Glycine max
  Clone ID: 700680116H2
cgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagat

SEQ ID NO: 4647 - DNA, 286 bp, Glycine max
  Clone ID: 700557591H1
ccttaaccctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataaggggt

SEQ ID NO: 4648 - DNA, 274 bp, Glycine max
  Clone ID: 701108330H1
ctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataag

SEQ ID NO: 4649 - DNA, 241 bp, Glycine max
  Clone ID: 700875128H1
tggaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaac

SEQ ID NO: 4650 - DNA, 255 bp, Glycine max
  unsure (1)...(255): unsure at all n locations
  Clone ID: 700991275H1
cncaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagatngggggttgnt

SEQ ID NO: 4651 - DNA, 269 bp, Glycine max
  Clone ID: 700556249H1
ctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccag

SEQ ID NO: 4652 - DNA, 278 bp, Glycine max
  Clone ID: 700559069H1
tggaaacaggcatagcatgctacactcgcgggcctttcctgcctagtgtttcttccaagcactctgccaccctgccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttttggtgtccat

SEQ ID NO: 4653 - DNA, 259 bp, Glycine max
  unsure (1)...(259): unsure at all n locations
  Clone ID: 700990985H1
anaggcatagcatgctanactcgcgggcctttcttgcctagtgtttcttccaagcactctccancttccatttctcnatcttntngcttgaggagtctgaaatcaagctctttatttggagaatcgctaagagtggcctccaaatcaanaataaaggtttcaaaganaaagaatanttcactcgtgacnagatgtgaaattggtgacagtctcgaagaattcctcanaaaagcaanancagataaggggttgatcaggt

SEQ ID NO: 4654 - DNA, 282 bp, Glycine max
  Clone ID: 701062648H1
aaaacaacataacatcctcaagcctttgaacatcgttttgcagccatggaaacaggcatatcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatcattcactcgtgaccagatgtgaaattggtgacagtctggaagaattcctcacaaaa

SEQ ID NO: 4655 - DNA, 304 bp, Glycine max
  unsure (1)...(304): unsure at all n locations
  Clone ID: 700560603H1
acataacatcctcaagcctttgaacatcgttttgcagccatggaaacaggcatagcatgctacactcgcgggcctttcctgcctagtgtttcttccaagcactctccaccctccatctctccatcttttgngcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcagg

SEQ ID NO: 4656 - DNA, 212 bp, Glycine max
  Clone ID: 701109375H1
atggaaacaggcatagcatgctacactcgcgggcctttcttgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccaatgtgaaattggtgac

SEQ ID NO: 4657 - DNA, 277 bp, Glycine max
  Clone ID: 700787023H2
atcgttttgcagccatggaaacaggcatagcatgctacactcgcgggcctttcctgcctagtgtttcttccaagcactctccaccctccatctctccatcttttggcttgaggagtctgaaatcgagctctttatttggagaatcgctaagagtggcatccaaatcaacactaaaggtttcaaagacaaagaatacttcactcgtgaccagatgtgaaattggtgacagtctggaagaattcctcacaaaagcaacaccagataaggggtgatcagg

SEQ ID NO: 4658 - DNA, 289 bp, Glycine max
  Clone ID: 701053814H1
ttcaacataacatcctcaagcctttgaacatcgttttgcagccatggaaacaggcatagcatgctacactcgcgggcctttcttgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacacca

SEQ ID NO: 4659 - DNA, 247 bp, Glycine max
  Clone ID: 701103839H1
caagcctttgaacatcgttttgcagccatggaaacaggcatagcatgtcacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctgg

SEQ ID NO: 4660 - DNA, 264 bp, Glycine max
  Clone ID: 700874009H1
acataacataacatccttaaccctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcg

SEQ ID NO: 4661 - DNA, 292 bp, Glycine max
  Clone ID: 700557201H1
tggaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacacaaaggtttcaaagacaaagaatacttcactcgtgaccagatgtgaaattggtgacagtctggaagaattcctcacaaaagcaacaccagataaggggttgatcaggttgttggtgtccatgggagaagcattaaga

SEQ ID NO: 4662 - DNA, 300 bp, Glycine max
  unsure (1)...(300): unsure at all n locations
  Clone ID: 701001319H1
anacancataacatcctcaagnctttgancatcggtttgcagccatggaaacaggcatagnatgctnacantcngcgggcctttctggcctagtgtgtcttccaagcactctccaccctccatcnntccatcntttggcttgaggagtctgaaatcgagctntttatttggagaatctctaagagtggcatccaaatcancactanaggntncnaagacnnagantanttcactcgtgaccngangtnnaattggtgacagtctggnagaatcctcanaaacagcaacaccagataaggg

SEQ ID NO: 4663 - DNA, 268 bp, Glycine max
  Clone ID: 701105211H1
gcctttgaacatcgttttgcagccatggacacaggcatagcatgctacactcgcgggcctttcctgcctagtgtgtcttccaagcactctgccaccctccatctctccatcttttggcttgaggagtctgaaatcgagctctttatttggagaatctctaagagtggcatccaaatcaacactaaaggtttcaaagacgaagaatacttcactcgtgaccagatgtgaaattggtgacagtctggaagaattcctcacaaaagcaaca

SEQ ID NO: 4664 - DNA, 281 bp, Glycine max
  unsure (1)...(281): unsure at all n locations
  Clone ID: 700558314H1
ctgcaataacataagtacaaaacaacataacatcctcaagcctttgaacatcgttttgcagccatggaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagangtgaattggtgacagtctg

SEQ ID NO: 4665 - DNA, 234 bp, Glycine max
  Clone ID: 700786134H2
gccatggaaacaggcatagcatgctacactcgcgggcctttcttgcctagtgtttcttccaagcactctccggcttccatttctccatgagttggcgtatggggtctgaaatcaagctctttatttggagaatcgctaagagtggcctccaaatcaacaataaaggtttcaaagacaaagaaggcttcactcgtgaccagatgtgaaattggtgagagtctcgaagaattcctc

SEQ ID NO: 4666 - DNA, 243 bp, Glycine max
  Clone ID: 700875943H1
aacatccttaaccctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaagttttcaaagacaaagaatacttcactcgtgaccagatgtgaaattg

SEQ ID NO: 4667 - DNA, 245 bp, Glycine max
  Clone ID: 700741681H1
aacaacataacatcctcaagcctttgaacatcgttttgcagccatggaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaagacaaaggatacttcactcgtgaccagatgtga

SEQ ID NO: 4668 - DNA, 294 bp, Glycine max
  unsure (1)...(294): unsure at all n locations
  Clone ID: 701001530H1
tggaaacaggcatagcatgctacactcgcgggcctttcctgcctagtgtttcttccaagcatctnccacccttccatctctccatcttttcgcctgaggagtctgaaatcgagctctttatttggagaatctctaagagtggcatccaaatcaaactaaaggtttcaaagacaaagaatacttcactcgtgaccagatgtgaaattggtgacagtctggaagaattcctcacaaaagcaacaccagataaggggttgatcaggttgttggtgtccagggagangcataagaaca

SEQ ID NO: 4669 - DNA, 244 bp, Glycine max
  Clone ID: 701109215H1
gcaatgcaataacatcagtacataacataacataacatccttaaccctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaa

SEQ ID NO: 4670 - DNA, 218 bp, Glycine max
  Clone ID: 700891544H1
gcctttgaacatcgttttgcagccatggaaacaggcatagcatgctacactcgcgggcctttcctgcctagtgtttcttccaagcactctccaccctccatctctccatcttttggcttgaggagtctgaaatcgagctcttgatttggagaatctctaagagtggcatccaaatcaacactaaaggtttcaaagacaaagaatacttcactcgtgac

SEQ ID NO: 4671 - DNA, 415 bp, Glycine max
  Clone ID: LIB3054-002-Q1-N1-B7
atagcatgctacactcgcgggcctttcctgcctagtgtttgttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtggtggaacacaatgtgttaatacttttggggacgagcagcttgcagtggatttgctagctaatcagcttctttttgaggccttaaattactctcatttct

SEQ ID NO: 4672 - DNA, 401 bp, Glycine max
  Clone ID: LIB3055-004-Q1-N1-B1
tcaaagtgaagacggtttttggtggtggaccacattgggttaatacttgttgggacgagcagttggcatgggatttgctagctaatcagcttctttttgaggccttaaattactctcatttctgcaagtatgcttgctctgaagaaaatcctgagctcctggacatgggaggtccagttgaaggtggatttagtgtcgcatttgatccccttgatggctccagcattgtggacacaaatttcacagtaggcaccatctttgtgtgtggcctggagataagttgactgggatcaccggaagagatcaagttgctgcagccatgggggttttgggtcctagaacaacatatgtgcttgctctaaaagacttccctggcacccatgaatttcttctgcttgatg

SEQ ID NO: 4673 - DNA, 397 bp, Glycine max
  unsure (1)...(397): unsure at all n locations
  Clone ID: LIB3053-006-Q1-N1-B2
gaaacaggcatagcatgctacactcgcgggcctttcctgcctagtgtttcttccaagcactctccaccctccatctctccatcttttggcttgaggagtctgaaatcgagctctttatttggagaatctctaagagtggcatccaaatcaacactaaaggtttcaaagacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtggtggaacacaatgtgttaatacttttggngacgagcagcttgcagtggatttgctagctaatcagcttcttt

SEQ ID NO: 4674 - DNA, 365 bp, Glycine max
  Clone ID: LIB3055-008-Q1-N1-H3
gccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaaggtttcaaagacaaagaatacttcactcgtgaccagatgtgaaattggtgacagtctcgaagaattcctcacaaaagcaacaccagataaggggttgatcaggttgttggtgtccatgggagaagcattgagaacaatttccttcaaagtgaagacggcttcatgtggtggaacacaatgtgttaatacttttggggatga

SEQ ID NO: 4675 - DNA, 406 bp, Glycine max
  unsure (1)...(406): unsure at all n locations
  Clone ID: LIB3055-011-Q1-N1-F4
agccttgaacattgtttgcaccctggaaccaggcttgatggtaaactgggggccttttctgcctaagggttctttcaaacacctttcaaccttcaactctccatcttttggcttgaggagtctgaaatcgagctctttatttggagaatctctaagagtggcatcccaatcaacactaaaggtttcaaagacaaagaatacttcactcgtgaccagatgtgaaattggtgacagtctggaagaattcctcacaaaagcaacaccagataaggggttgatcaggttgttggtgtccatgggagaagcattaagaacaatttccttcaaagtgaagacggcttcttgtgggtggaccacaatgtgttaatacttttggngacgagcagcttgcagtggatttgctagc

SEQ ID NO: 4676 - DNA, 395 bp, Glycine max
  unsure (1)...(395): unsure at all n locations
  Clone ID: LIB3030-005-Q1-B1-E5
cttagtctcactatcaagcaatgcaataacatcagtacataacataacataacatccttaaccctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctccaaatcaacaataaacgtttcaaagacaaagaatacttcactcgtgaccagatgtganattggtgacagtctcgaagaattcctcacanaagcaacaccagataaggggttgatcaggttgttggtgtccatgggagaagcattgagaacaatttccttcaaag

SEQ ID NO: 4677 - DNA, 396 bp, Glycine max
  unsure (1)...(396): unsure at all n locations
  Clone ID: LIB3054-003-Q1-N1-E12
aaatatttcatacccaaaaaatgcagtttcattagccgatctactcagcacctgccacgtggcactacacatatagttagccacatatctaaaattgctatcccctcctcctcctctcccttcttagtctcactatcaagcaatgcaataacatcagtacataacataacataacatccttaaccctttgaacatcgttttgcagccatggaaacaggcatagcatgctacactcgcgggcctttcttgcctagtgtttcttccaagcactctccaccttccatttctccatcttttggcttgaggagtctgaaatcaagctctttatttggagaatcgctaagagtggcctncaaatcaacaataaaggtttcaaagacaaagaatacttcactc

SEQ ID NO: 4678 - DNA, 196 bp, Zea mays
  Clone ID: 700222465H1
gccacgcgtccgcggacgcgtggattccatgtgagggcatcagctcgggttgacaaattctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaa

SEQ ID NO: 4679 - DNA, 353 bp, Zea mays
  unsure (1)...(353): unsure at all n locations
  Clone ID: 700618106H1
tgcgtcatctacgcgcaggaaggcgttccaagtgagggcatcagctcgggttgacaagttctcaaagagtgatatcagggtngtcccttcgcatctgtctggaaactgtcgcaaagctatgttgatcaggtagaagcgtgggaggtggcaagatgtgactggattctgtcgatgtcatggacgggcgctgtgtgcgaaatatcacaattggacctgtggttgttgatgctctgcgtcctgtgactgatcttccattggatgtacatctgatgattgtggaacctgagcagcgagtcactgattgtatcaaggcangtgctgatattgttagtgtccactgtgaacagacatcg

SEQ ID NO: 4680 - DNA, 312 bp, Zea mays
  Clone ID: 700101610H1
agcgactccactcactgcaattgattatgttcttgatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggtccgaaaaatgcctacaaggttattgaagctggcgcaaatgccattgtcgcaggttctgcagtttttggggctccagactacgctgaagctatcaaaggaataaagaccagccaaagacctctagc

SEQ ID NO: 4681 - DNA, 312 bp, Zea mays
  Clone ID: 700098237H1
gctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattatgttcttgatgttgttgacctggtgctgattatgtctgtgaatcctgggtttggtggccagagctttatcgagagtcaagtaaagaaa

SEQ ID NO: 4682 - DNA, 314 bp, Zea mays
  Clone ID: 700209605H1
cctgagcagcgagtccccgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattatgttcttgatgttgttgacctggtgctgattatgtctgtgaatcctgggtttggtggccagagctttatcgagagtcaagtaaagaaaattgcagaactgagagagttatgtgcagagaagggagtgaacccctggattgaggt

SEQ ID NO: 4683 - DNA, 305 bp, Zea mays
  Clone ID: 700101988H1
ggcaggtgctgatattgttagtgtccactgtgaacagacatcgaccatccatttgcaccgaacagtcaatcagattaaaagtctaggagcaaaggcaggagttgtttgaatccagcgactccactcactgcaattgattatgttcttgatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggtccgaa

SEQ ID NO: 4684 - DNA, 280 bp, Zea mays
  Clone ID: 700091966H1
atccatttgcaccgaacagtcaatcagattaaaagtctaggagcaaaggcaggagttgttttgaatccagcgactccactcactgcaattgattatgttcttgatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggtccgaaaaatgcctacaaggttattg

SEQ ID NO: 4685 - DNA, 284 bp, Zea mays
  Clone ID: 700101445H1
ctgtctgcaaactttgcgaacgttggtgatcaggtaaaagctgtggaggtggcaggatgcgactggattcatgtcgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaa

SEQ ID NO: 4686 - DNA, 218 bp, Zea mays
  Clone ID: 700159349H1
tgttagtgtccactgtgaacagacatcgaccatccatttgcaccgaacagtcaatcagattaaaagtctaggagcaaaggcaggagttgttttgaatccagcgactccactcactgcaattgattaggttcttgatgtggttgacctggtgctgattatgtctgtgaatcctgggtttggtggccagagctttatcgagagtcaggtaaagaaaattg

SEQ ID NO: 4687 - DNA, 249 bp, Zea mays
  Clone ID: 700380926H1
tatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattatgttcttgatgttgtcgccctggtgctgattatgtctgtaaatcctgggtttggtggccagagctttatcgagagtcaagtaaagaaaattgcagaactgag

SEQ ID NO: 4688 - DNA, 316 bp, Zea mays
  Clone ID: 700048475H1
gataaggtgcgcacactgagaaagaagtacccttcccttgacatagaggttgatggtggtctaggtccttcaaccatagacgtggccgcatctgctggggccaattgcatcgtcgctggaagctctatatttggcgctgcggacccaggagccatcatatctgtgctgaggaagagcgtcgagggctctcagaacaaaaactgattttggtgtttctgctgtaaagtactccctccgtttttttttattcgtcgcgttttagttcaaacatgaactagcggacgactgatattcgagaatggagggagtacttcga

SEQ ID NO: 4689 - DNA, 301 bp, Zea mays
  Clone ID: 700105805H1
ggttgatggtggtctaggtccttcaaccatagacgtggccgcatctgctggggccaattgcatcgtcgctggaagctctatatttggcgctgcggacccaggagccatcatatctgtgctgaggaagagcgtcgagggctctcagaacaaaaactgattttggtgtttctgctgtaaagtactccctccgtttttttattcgtcgcgttttagttcaaacatgaactagcggacgactgatattcgagaatggagggattacttcgaccctgcacgtcagatgagctgatcctcacattgc

SEQ ID NO: 4690 - DNA, 247 bp, Zea mays
  Clone ID: 700432796H1
cggttattgaagctggcgcaaatgccattgtcgcaggttctgcagtttttgcggtgtccagactaacactgcagctatcaaaggaatacagaccagccaaagacctctagctgtagccgcataaggcgctggacgtgtaatcatttactctgtgcaagtttaccagtgatgcgatctgtatagttgtgtgtcttgtccaaccatacgtataccgagatgaaaagagacggaggcagtgaagaactat

SEQ ID NO: 4691 - DNA, 319 bp, Zea mays
  Clone ID: 700104089H1
attgagagagccagagaggtgggcagatggcgacaccgtcgtcgtcgctttgctccagcttcgcctccctgcggaccgcctccatcggccacccccgcggcatcgcgtcatctacgcccaggaaggcgttccaagtgagggcatcagctcgggttgacaagttctcaaagagtgatatcattgtgtccccttcgattctgtctgcaaacttcgccaagcttggtgatcaggtaaaagccgtggaggtggcaggatgtgactggattcatgtcgatgtcatggacgggcgctttgtgccaaatatcacaattggaccttt

SEQ ID NO: 4692 - DNA, 301 bp, Zea mays
  Clone ID: 700099362H1
gagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaacttggtgatcaggtaaaagctgtggaggtggcaggatgcgactggattcatgtcgatgtcatggacgggcgctttgtgccaaacatcacaattgg

SEQ ID NO: 4693 - DNA, 268 bp, Zea mays
  Clone ID: 700042321H1
cgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaagttctcaaagagtgacatcatcgtgtccccttcgattctgtctgcaaactttgcgaacttcggtgatcaggtaaaagctgtggaggtggcaggatgcgactggattcatgtcgatgtcatggatgggcg

SEQ ID NO: 4694 - DNA, 256 bp, Zea mays
  Clone ID: 700457795H1
aagcgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaagcttggtgatcaggtaaaagctgtggaggtggcaggcggcgactggattcatgtcgatgtcatggacgggcg

SEQ ID NO: 4695 - DNA, 319 bp, Zea mays
  Clone ID: 700096215H1
gctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaactctggtgatcaggtaaaagctgtggaggtggcaggatgcgactggattcatgtc

SEQ ID NO: 4696 - DNA, 287 bp, Zea mays
  unsure (1)...(287): unsure at all n locations
  Clone ID: 700378379H1
ccagtggctgctagccgagacggggatagattgacagacaggcgcgcagatcgcgacgccgtcgtcgtcgctttgctccagcttcgcctccctgcggaccgcctccatcggccacccccgtggcatcgcctcctccacgcccagtcaaggcattccatgtgagggcatcagctcgggttcacaaattctcaaagagtgacatcatcgtgtccccttcgattctgtctgcaaactttgcgaacttggtgatcaggtanaagctgtggaggtggcaggatgcgactgga

SEQ ID NO: 4697 - DNA, 261 bp, Zea mays
  Clone ID: 700239692H1
agaggggatagattgagagagccagagaggtgggcagatggcgacaccgtcgtcgtcgctttgctccagcttcgcctccctgcggaccgcctccatcggccacccccgcggcatcgcgtcatctacacccaggaaggcgttccaagtgagggcatcagctcgggttgacaagttctcaaagagtgatatcattgtgtccccttcgattctgtctgcaaacttcgccaagcttggtgatcaggtaaaagccgtggaggtggc

SEQ ID NO: 4698 - DNA, 299 bp, Zea mays
  Clone ID: 700093535H1
gctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaacgttggtgatcaggtaaaagctgtggaggtggcag

SEQ ID NO: 4699 - DNA, 241 bp, Zea mays
  Clone ID: 700098183H1
attgacagacaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaagcttggtgatcaggtaaaagctgtggaggt

SEQ ID NO: 4700 - DNA, 293 bp, Zea mays
  Clone ID: 700093175H1
ctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaactgtggtgatcaggtaaaagctgtggaggt

SEQ ID NO: 4701 - DNA, 325 bp, Zea mays
  Clone ID: 700098056H1
accaaatcgcttaccgcccccgaagcgtctcggttcgcatagcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaacgttggtgatca

SEQ ID NO: 4702 - DNA, 301 bp, Zea mays
  Clone ID: 700101650H1
cgaagctctcggttcgcatagcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaagggattccatgtgagggcatcagctcgggttgacaaattctcaaagagtgacatcatcgtgtccccttcgattctgtctgcaaactttgcgaagcttggtga

SEQ ID NO: 4703 - DNA, 288 bp, Zea mays
  Clone ID: 700053356H1
agcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaactgtggtgatcaggt

SEQ ID NO: 4704 - DNA, 304 bp, Zea mays
  Clone ID: 700099441H1
aatcgcttaccgcccccgaagcgtctcggttcgcatagcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaacttt

SEQ ID NO: 4705 - DNA, 229 bp, Zea mays
  unsure (1)...(229): unsure at all n locations
  Clone ID: 700162921H1
cataactactctgccaccaatccggggaggaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagangcttgagaaata

SEQ ID NO: 4706 - DNA, 269 bp, Zea mays
  Clone ID: 700552657H1
gctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggtatgcggcctggtgtatcattgaggccaggtactc

SEQ ID NO: 4707 - DNA, 429 bp, Zea mays
  Clone ID: LIB189-001-Q1-E1-F4
gagggaaatggcaacgtcattcggcaggctacggtctaggtattccgggctcaaccaacgcgtcaggatgttttgaaccaaccaacccaatcaacggaaattgataacttcctggaggtggttgacctgtggcggataaggtcggtaaacccggggttggggggcaaaaccttaaccaaaagtcaattaaagaaaattgcaaaactgaaaaggtaatgtgcaaaaaagggagtgaaccccgggattgaggttgatggtggtgttggtccgaaaaatgcctacaaggttattgaagctggcgcaaatgccattgtcgcaagttctgcagtttttggggctccagactacgctgaagctatcaaaggaataaagaccagccaaagacctctagctgtagccgcataaagagctggacgtgtaatcatttac

SEQ ID NO: 4708 - DNA, 389 bp, Zea mays
  unsure (1)...(389): unsure at all n locations
  Clone ID: LIB3078-002-Q1-K1-A2
gaccaagccgtccaatcaaggtggaggccatggatgggccctttgtgccaaacatcacaattggaccctggggtgttgatgctctgcgtccagtgactgatcttccgttggatgtacatctgatgattgtggaacctgagcagcgagtccctgattttatcaaggcaggtgctgatattgctagtgtccactgtgaacagacatcgaccttcatttgcaccgaacagtcaatcagattaaaagtctaggagcanaggcagggattgttntgaatccagcgactccactcactgcaattgattacgttcttgatgttgttgacctggtgctgattatgtctgtgaatcctgggtttgttggcagagctttatcgagagtcaagtaaggaa

SEQ ID NO: 4709 - DNA, 412 bp, Zea mays
  Clone ID: LIB3078-034-Q1-K1-E8
gtgtccccttcgattctgtctgcaaactttgcgaagcttggtgatcaggtaaaagctgtggaggtggcaggatgcgactggattcatgtcgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattacgttcttgatgttgttgacctggtgctgattatgtctgtga

SEQ ID NO: 4710 - DNA, 397 bp, Zea mays
  Clone ID: LIB189-018-Q1-E1-G1
gatgctctgcgtccagtgactgatcttccgttggatgtacatctgatgattgtggaacctgagcagcgagtccctgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattacgttcttgatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggtccgaaaaatg

SEQ ID NO: 4711 - DNA, 403 bp, Zea mays
  Clone ID: LIB3060-022-Q1-K1-G2
ggaggtggcaggatgcgactggattcatgtcgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaagagcaaaggcagggaattgtttgaatccagcgacttcacttactggaattgattatggtcctgatggtggtgacctggtgctgattatgtctgtgaatcctgggtttggtggccaaagctttattgagagtcaagttaaggaaatt

SEQ ID NO: 4712 - DNA, 419 bp, Zea mays
  unsure (1)...(419): unsure at all n locations
  Clone ID: LIB3060-034-Q1-K1-D3
gtgaaagccgtggaggtggcaggatgttactggattcatgtcgatgtcatggacgggcgctttgtgccaaatatcacaattggacctttggttgttgatgctctgcgtcctgtgactgatcttccattggatgtacatctgatgattgtggaacctgagcagcgagtccctgattttatcaaggcaggtgctgatattgttagtgtccactgtgaacaaacatcgaccatccatttgcacagaacagtcaatcagattaaaagtctaggagcaaaagcaggagttgttttgaatccagcgactccactcaatgcaattgattacattcttgatgttgttgacctggtgttgattatgtctgtgaatcctgggtttggtggccagagctttatcgagagtcaagtnaggaaaattgcaga

SEQ ID NO: 4713 - DNA, 451 bp, Zea mays
  Clone ID: LIB36-007-Q1-E1-D10
cgatgtcatggacgggcgctttgtgccaaacatcacaattggacccttggttgttgatgctctgcgtccagtgactgatcttccgttggatgtacatctgatgattgtggaacctgagcagcgagtccccgattttatcaaggcaggtgctgatattgttagtgtccactgtgaacagacatcgaccatccatttgcaccgaacagtcaatcagattaaaagtctaggagcaaaggcaggagttgttttgaatccagcgactccactcactgcaattgattatgttcttgatgttgttgacctggtgctgattatgtctgtgaatcctgggtttggtggccagagctttatcgagagtcaagtaaagaagattgcagaactgagaaggttatgtgcagagaagggagtgaacccctggattgaggttgatggtggtgttggtcccaaaaat

SEQ ID NO: 4714 - DNA, 389 bp, Zea mays
  Clone ID: LIB3078-053-Q1-K1-F4
cttggtgatcaggtaaaagctgtggaggtggcatgatgcgactggattcatgttgatgtcatggatgggcgctttgtggcaaacatcacaattggacccttggttgttgatgctctgcgtccagtgactgatcttccgttggatgtacatctgatgattgtggaacctgagcagcgagtccctgattttatcaaggcaggtgctgatattgatagtgtccactgtgaacagacatcgaccattcatttgcaccgaacagtcaatcagattaaaagtctatgagcaaaggcaggagttgttgtgaatccagcgactgcactcactgcaattgattacgttcttgatgatgatgacctggtgctgattatgtctgtgaatcctgggtttgg

SEQ ID NO: 4715 - DNA, 426 bp, Zea mays
  Clone ID: LIB189-034-Q1-E1-B12
ctatgaacagacatcgaccatccatttgcaccgaacaatcaatcagattaaaagtctaggagcaaaggcaggagttgttttgaatccagcgactccactcactgcaattgattaggggcttgatgttgttgacctggtgctgattaggggggtgaatcctgcgtttggtggccagagctttatcgagagtcaagtaaagaaaattgcagaactgagaaggttatgtgcagagaagggagtgaacccctggattgaggttgatggtggtgttggtccgaaaaatgcctacaaggttattgaagctggcgcaaattctattttctcaggttctgcagtttttggggctccagactacgctgaagctatcaaatggaataagaccatccaaagacctctagctgtagccgcataaacaacttgacgtgt

SEQ ID NO: 4716 - DNA, 380 bp, Zea mays
  Clone ID: LIB3067-056-Q1-K1-A4
cggacgcgtgggcggacgcgtgggctgagaaggttatgtgcagagaagggagtgaacccctggattgaggttgatggtggtgttggtccgaaaaatgcctacaaggttattgaagctggcgcaaatgccattgtcgcaggttctgcagtttttggggctccagactacgctgaagctatcaaaggaataaagaccagccaaagacctctagctgtagccgcataaggagctggacgtgtaatcatttactctgtgcaagtttaccagtgatgcgatctgtatagatgtgtgtcttgtccagccatacgtataccggagatgaaaagagacggaagcagtgaagaaatatcctttttttttcttctcatttttcacgaaga

SEQ ID NO: 4717 - DNA, 375 bp, Zea mays
  Clone ID: LIB189-017-Q1-E1-F12
agagagccagagaggtgggcagatggcgacaccgtcgtcgtcgctttgctccagcttcgcctccctgcggaccgcctccatcggccacccccgcggcatcgcgtcatctacgcccaggaaggcgttccaagtgagggcatcagctcgggttgacaagttctcaaagagtgatatcattgtgtccccttcgattctgtctgcaaacttcgccaagcttggtgatcaggtaaaagccgtggaggtggcaggatgtgactggattcatgtcgatgtcatggacgggcgctttgtgccaaatatcacaattggacctttggttgttgatgctctgcgtcctgtgactgatcttccattggatgtacatctgatgattgt

SEQ ID NO: 4718 - DNA, 429 bp, Zea mays
  Clone ID: LIB36-012-Q1-E1-H11
cacacgcgtccgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaaacatcacaattggacccttggttgttgatgctctgcgtccagtgactgatcttccgttggatgtacatctgatgatg

SEQ ID NO: 4719 - DNA, 424 bp, Zea mays
  Clone ID: LIB3060-018-Q1-K1-B5
atcgcttaccgcccccgaagcgtctcggttcgcatagcagagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaaacatcacaattggacccttggttgttgatgctc

SEQ ID NO: 4720 - DNA, 419 bp, Zea mays
  unsure (1)...(419): unsure at all n locations
  Clone ID: LIB3062-015-Q1-K1-A11
cgcccccgaagcgtctcggttcgcatagcaaagctgctcttgcaacaagccaaacaaggcantggctgctagccgagacaggggatagattgagagagaggcgcgcagatggcgacgccgtcgtcgtcgctttgctccagcttcgcctccctgcggaccgcctccatcggccacccccgtggcatcgcctcctccacgctcaggaaggcattccatgtgagggcatcagctcgggttgacaagttctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaaacatcacaattggacccttggtttgtgatgctctgcg

SEQ ID NO: 4721 - DNA, 416 bp, Zea mays
  Clone ID: LIB189-031-Q1-E1-D1
agaaccaaatcgcttaccgcccccgaagcgtctcggttcgcatagcaaagctgctcttgcaacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgctcaggaaggcattccatgtgagggcatcagctcgggttgacaagttctcaaagagtgacatcatcgtgtccccttcgattctgtctgcaaactttgcgaagcttggtgatcaggtaaaagctgtggaggtggcaggatgcgactggattcatgtcgatgtcatggacgggcgctttgtgccaaacatcacaattggaccc

SEQ ID NO: 4722 - DNA, 390 bp, Zea mays
  unsure (1)...(390): unsure at all n locations
  Clone ID: LIB3060-013-Q1-K1-A2
caacaagccaaacaacccagtggctgctagccgagacaggggatagattgagagagaggcgcgcagatggcgacgccgtcgtcgtcgctttgctccagcttcgcctccctgcggaccgcctccatcggccacccccgtggcatcgcctcctccacgcccaggaaggcattccatgtgagggcatcagctcgggttgacaaattctcaaagagtgacatcatcgtgtccccttcgattctgtctgcaaactttgcgaagcttggtgatcaggtaaaagctgtggaagtggcaggatgcgactggattcatgtcgatgtcatggacgggcgctttgtgccaaacatcacaattggacccttgngttgtgatgctctgcgtccagtgactgat

SEQ ID NO: 4723 - DNA, 415 bp, Zea mays
  Clone ID: LIB148-032-Q1-E1-A4
gttttgtttgttgtccgcctggcgcctggccccataactactctgccacaatccggggaagaatcaacctagcggtaagcggacatggcggcggcgaagatagcgccgtcgatgctctcgtcggactttgccaacctcgcttcggaggctgagcgcatggtccgcctaggcgccgactggctacatatggacatcatggatgggcacttcgttcctaacctgactattggggctccggtgatccagagcttgaggaaacataccaaagcatatttggactgccatcttatggtcacaaagccttcagattacgtagaaccatttggaaaggctggcgcttctggattcacattccatatagaagttgctagagacaactggcaagatctcatccaaagcattaaatcaaagggta

SEQ ID NO: 4724 - DNA, 257 bp, Glycine max
  Clone ID: 700677209H1
aaaatttcaaccacagtgaaggctacatctcgtgttgacaagttttcaaaaagcgatatcattgtctctccatccattctttctgcaaactttgcaagattgggacaacaggtgaaagcactgcagttggctggttgtgattggcttcacgttgatgtaatggatggccgttttgttccaaatattacaattggacctcttgtcggctgatgcattgcgccctgtgacagatcttcctttggatgtacacctgatga

SEQ ID NO: 4725 - DNA, 272 bp, Glycine max
  unsure (1)...(272): unsure at all n locations
  Clone ID: 700971857H1
gggagttgaaaganagaaaggaaggatgggagtgacaccgaaaattgctccttcgatgctctcttccgacttcgccaatttggcttccgaggctcagcgcatgctccacttcggcgccgattggctccacatggacatcatggatgggcattttgtccccaatttaactattggcgctccagttattgaaagtttgagaaagcacacaaagggatatttggattgtcaccttatggttacaaatcctcttgattatgttgagnccttggcaa

SEQ ID NO: 4726 - DNA, 260 bp, Glycine max
  Clone ID: 701064495H1
agttgaaagacagaaaggaaggatgggagtgacaccgaaaattgctccttcgatgctctcttccgacttcgccaatttggcttccgaggctcagcgcatgctccacttcggcgccgattggctccacatggacatcatggatgggcattttgtccccaatttaactattggcgctccagttattgaaagtttgagaaagcacacaaagggatatttggattgtcaccttatggttacaaatcctcttgattatgttgagc

SEQ ID NO: 4727 - DNA, 266 bp, Glycine max
  Clone ID: 701007767H1
caaggaaggatgggagtgacaccgaaaattgctccttcgatgctctcttccgacttcgccaatttggcttccgaggctcagcgcatgctccacttcggcgccgattggctccacatggacatcatggatgggtcttttgtccccaatttaactattggcgctccagttattgaaagtttgagaaagcacacaaagggatatttggattgtcaccttatggttacaaatcctcttgattatgttgagcccttggcaaaagctggtgc

SEQ ID NO: 4728 - DNA, 228 bp, Glycine max
  unsure (1)...(228): unsure at all n locations
  Clone ID: 700656367H1
tgacaccgaaaattgctccttcgatgctcncttccganttcgcnaatttggcttccgaggctcagcgcatgctccacttcggcgccgattggctccacatggacatcatggntgggnattttgtccccaatttaactattggcgctccagttattganagtttgagaaagcacacaaagggatatttnngattgtcaccttatggttacaaatcctcttgattatgtt

SEQ ID NO: 4729 - DNA, 243 bp, Glycine max
  Clone ID: 700791582H1
caaccatagatgtggccgcatcagcaggggcaaactgcattgttgctggaagttcagtgtttggtgcccctgagccagttcaagtaatatccttactaaggaattctgttgagaaagcccagcaaaccttgatacagtaaaaaaaaaatgtcgttttaagttgcagtacacttcacaactttgcataaacaatatgcttaatgtttaacattttccataagttgaataaaagatcatgtgact

SEQ ID NO: 4730 - DNA, 266 bp, Glycine max
  Clone ID: 701001180H1
agaggttgatggtggtttagggccttcaaccatagacgtggccgcatcagcaggggcaaattgcattgttgctggaagttctgtttttggtgcacctgagccagctcaagtaatatcctactgaggagttctgttgagaaagcccagcaaacctcgatacagtaaaacaatgtcgttttaagttgcagtatacttcacaactttacataaacaatatgctaatgttaacatttcataagttgaataaaagatcaagtgcttgaaaa

SEQ ID NO: 4731 - DNA, 229 bp, Glycine max
  Clone ID: 700739263H1
gaaaatttctgacttgagaagagtgtgcgcggaaaagggagtgaatccatggattgaagtagatggtggagttggtccagcaaatgcttacaaggtgattgaggctggagccaatgctctggttgcaggctctgcttgtttggagctaaagattatgccgaagctataagaggaatcaaaaccagcaaaagacctgaagcagttgctgtgtgaaatgcccatgtggttc

SEQ ID NO: 4732 - DNA, 266 bp, Glycine max
  Clone ID: 700681545H1
cccccatccccaccccaacttgtatattgtgcataatatctatctgcattctctctcttcagggagtgaatccatggattgaagtagatggtggagttggtccagcaaatgcttacaaggtgattgaggctggagccaatgctctggttgcaggctctgctgtgtttggagctaaagattatgccgaagctataagaggaatcaaaaccagcaaaagacctgaagcagttgctgtgtgaaatgcccatgtggttcaatattcaccg

SEQ ID NO: 4733 - DNA, 257 bp, Glycine max
  Clone ID: 700866167H1
agcgatatcattgtctctccgtccattctttctgcaaacttttcaaaattgggagagcaggtgaaagcagtggaattggctggttgtgattggattcacgttgatgtaatggatggtcgctttgttccaaatattacaattggacctcttgtggttgatgcattgcgccctgtgacagatcttcctttggatgtacacctgatgattgtagacctgaacaaagggtaccagattttattaaggcaggagctgatata

SEQ ID NO: 4734 - DNA, 274 bp, Glycine max
  unsure (1)...(274): unsure at all n locations
  Clone ID: 700983968H1
caagttttcaaaaagcgatatcattgtttctccatccattctttctgcaaactttgcaaaattggganagcangtgaaagcagtggagtngnnggntggtaatnggntcaangtngatgtaatggatggccngtttngtnccaaatattacaattggacctcttgtggttgatgcattgccgcccctgtgacagatcttccttnggatgtacacctgatgattgtagaccctgaacaaagggtaccagattttattaaggcaggagcccgatac

SEQ ID NO: 4735 - DNA, 281 bp, Glycine max
  unsure (1)...(281): unsure at all n locations
  Clone ID: 700999796H1
cttcttccttgtgttcatcgaccctccaatcccaaatcaatggattctgccttcacaaaacctctctttcccatcctcgttccctcactttctccaggaagaaaatttcaaccacagtgaaggctacatctcgtgttgacaagttttcaaaaagcgatatcattgtttctccatccattctttctgcaaactttgcaaaattgggagagcaggtgaaagcagtggagttggctggttntgatggattcacgttgatgtaatggatgggcgtttgttccaaa

SEQ ID NO: 4736 - DNA, 256 bp, Glycine max
  Clone ID: 700788240H1
gatggctgcaacctcttccttgtgctcatcgaccctccaatcccagatcaatggattcttccttcacaaaacctctctttcccatactccttccctcactttctccaggaggaaaatttcaaccacagtgaaggctacatctcgagtcgacaagttttcaaaaagcgatatcattgtctctccgtccattctttctgcaaacttttcaaaattggagagcaagtgaaagcagtagaattggctggttgtgattgga

SEQ ID NO: 4737 - DNA, 273 bp, Glycine max
  unsure (1)...(273): unsure at all n locations
  Clone ID: 701000905H1
gattgctgagtcaaacttgaattgaaggtgaagaaggagatggcagnaacttcttccttgtgttnatcgancctncaatcccaaatcaatggattctgcnttcacaaaacctctntttcccatcctcgttccctnactttctcnaggaagaaaatttcaaccacagtgaaggctacatctcgtgttnacaagttttcaaaaagcgatatcattgtttctccatccattctttntgcaaactttgcaaaattgggagagcaggtgaaagcagtg

SEQ ID NO: 4738 - DNA, 259 bp, Glycine max
  Clone ID: 701040171H1
ggttatgtaaacttgaattgaagtgaagaaggagatggctgcaacctcttccttgtgctcatcgaccctccaatcccagatcaatggattcttccttcacaaaacctctctttcccatactccttccctcactttctccaggaggaaaatttcaaccacagtgaaggctacatctcgagtcgacaagttttcaaaaagcgatatcattgtctctccgtccattctttctgcaaacttttcaaaattgggagagcaggtg

SEQ ID NO: 4739 - DNA, 247 bp, Glycine max
  Clone ID: 700754807H1
gtcaaacttgaattgaaggtgaagaaggagatggcagcaacttcttccttgtgttcatcgaccctccaatcccaaatcaatggattctgccttcacaaaacctctctttcccatcctcgttccctcactttctccaggaagaaaatttcaaccacagtgaaggctacatctcgtgttgacaagttttcaaaaagcgatatcattgtttctccatccattctttctgcaaactttgcaaaattgggag

SEQ ID NO: 4740 - DNA, 255 bp, Glycine max
  Clone ID: 700904930H1
ggattggtgaggtaaacttgaattgaagtgaagaaggagatggctgcaacctcttccttgtgctcatcgaccctccaatcccagatcaatggattcttccttcacaaaacctctctttcccatactccttccctcactttctccaggaggaaaatttcaaccacagtgaaggctacatctcgagtcgacaagttttcaaaaagcgatatcattgtctctccgtccattctttctgcaaacttttcaaaattggga

SEQ ID NO: 4741 - DNA, 254 bp, Glycine max
  Clone ID: 700739828H1
cgattggtgaggtaaacttgaattgaagtgaagaaggagatggctgcaacctcttccttgtgctcatcgaccctccaatcccagatcaatggattcttccttcacaaaacctctctttcccatacttcttccctcactttctccaggaggaaaatttcaaccacagtgaaggctacatctcgagtcgacaagttttcaaaaagcgatatcattgtctctccgtccattctttctgcaaacttttcaaaattggg

SEQ ID NO: 4742 - DNA, 276 bp, Glycine max
  Clone ID: 700741008H1
gcataggattggtgaggtaaacttgaattgaagtgaagaaggagatggctgcaacctcttccttgtgctcatcgaccctccaatcccagatcaatggattcttccttcacaaaacctctctttcccatactccttccctcactttctccaggaggaatttcaaccacagtgaaggctacatctcgagtcgacaagttttcaaaaagcgatatcattgtctctccgtccattctttctgcaaacttttcaaaattgggagagcaggtgaaagcagtg

SEQ ID NO: 4743 - DNA, 244 bp, Glycine max
  Clone ID: 700738184H1
taggattggtgaggtaaacttgaattgaagtgaagaaggagatggctgcaacctcttccttgtgctcatcgaccctccaatcccagatcaatggattcttccttcacaaaacctctctttcccatactccttccctcactttctccaggaggaaaatttcaaccacagtgaaggctacatctcgagtcgacaagttttcaaaaagcgatatcattgtctctccgtccattctttctgcaaactt

SEQ ID NO: 4744 - DNA, 249 bp, Glycine max
  Clone ID: 700790753H1
cttttgtgaaggcctaggattgctgagtcaaacttgaattgaaggtgaagaaggagatggcagcaacttcttccttgtgttcatcgaccctccaatcccaaatcaatggattctgccttcacaaaacctctctttcccatcctcgttccctcactttctccaggaagaaaatttcaaccacagtgaaggctacatctcgtgttgacaagttttcaaaaagcgatatcattgtttctccatccattcttt

SEQ ID NO: 4745 - DNA, 260 bp, Glycine max
  Clone ID: 701110183H1
cacacacttttttcaaggcataggattggtgaggcaaacttgaattgaagtgaagaaggagatggctgcaacctcttccttgtgctcatcgaccctccaatcccagatcaatggattcttccttcacaaaacctctctttcccatactccttccctcactttctccaggaggaaaatttcaaccacagtgaaggctacatctcgagtcgacaagttttcaaaaagcgatatcattgtctctccgtccattctttctgcaa

SEQ ID NO: 4746 - DNA, 249 bp, Glycine max
  Clone ID: 700876264H1
ttttgtcaaggcataggattggtgaggtaaacttgaattgaagtgaagaaggagatggctgcaacctcttccttgtgctcatcgaccctccaatcccagatcaatggattcttccttcacaaaaccttctttcccatactccttccctcactttctccaggaggaaaatttcaaccacagtgaaggctacatctcgagtcgacaagttttcaaaaagcgatatcattgtctctccgtccattctttctg

SEQ ID NO: 4747 - DNA, 265 bp, Glycine max
  Clone ID: 700787492H2
cacacagtcacacttttgtgaaggcctaggattgctgagtcaaacttgaattgaaggtgacgaaggagatggcagcaacttcttccttgtgttcatcgaccctccaatcccaaatcaatggattctgccttcacaaaacctctctttcccatcctcgttccctcactttctccaggaagaaaatttcaaccacagtgaaggctacatctcgtgttgacaagttttcaaaaagcgatatcattgtttctccatccattctttctgc

SEQ ID NO: 4748 - DNA, 250 bp, Glycine max
  Clone ID: 700788242H1
caaggcataggatcggtgaggcaaacttgaattgaagtgaagaaggagatggctgcaacctcttccttgtgctcatcgaccctccaatcccagatcaatggattcttccttcacatcacctctcttccccatactccttccctcactttctccaggaggaaaatttcaaccacagtgaaggctacatctcgagtcgacaagttttcaaaagcgatatcattgtctctccgtccattctttctgcaaattt

SEQ ID NO: 4749 - DNA, 251 bp, Glycine max
  Clone ID: 700741612H1
cacacttttgtcaaggcataggattggtgaggtaaacttgaattgaagtgaagaaggagatggctgcaacctcttccttgtgctcatcgaccctccaatcccagatcaatggattcttccttcacaaaacctctctttcccatactccttccctcactttctccaggaggaaaatttcaaccacagtgaaggctacatctcgagtcgacaagttttcaaaagcgatatcattgtctctccgtccattcttt

SEQ ID NO: 4750 - DNA, 273 bp, Glycine max
  Clone ID: 700789926H2
cttttgtgaaggcctaggattgctgagtcaaacttgaattgaagagtgaagaaggagatggcagcaacttcttccttgtgttcatcgaccctccaatcccaaatcaatggattctgccttcacaaaacctctctttcccatcctcgttccctcactttctccaggaagaaaatttcaaccacagtgaaggctacatctcgtgttgacaagttttcaaaaagcgatatcattgtttctccatccattctttctgcaaactttgcaaaattgggg

SEQ ID NO: 4751 - DNA, 272 bp, Glycine max
  Clone ID: 701105542H1
cacacacagtcacacttttgtgaaggcctaggattggtgagtcaaacttgaattgaaggtgaagaaggagatggcagcaacttcttccttgtgttcatcgaccctccaatcccaaatcaatggattctgccttcacaaaacctctctttcccatcctcgttccctcactttctccaggaagaaaatttcaaccacagtgaaggctacatctcgtgttgacacagttttcaaaaagcgatatcattgtttctccatccattctttctgcaaac

SEQ ID NO: 4752 - DNA, 259 bp, Glycine max
  Clone ID: 700741161H1
cacagtcacacttttgtgaaggcctaggattgctgagtcaaacttgaattgaaggtgaagaaggagatggcagcaacttcttccttgtgttcatcgaccctccaatcccaaatcaatggattctgccttcacaaaacctctctttcccatcctcgttccctcactttctccaggaagaaaatttcaaccacagtgaaggctacatctcgtgttgacaagttttcaaaaagcgatatcattgtttctccatccattcttt

SEQ ID NO: 4753 - DNA, 246 bp, Glycine max
  Clone ID: 700877044H1
tttcctcaaggcataggattggtgaggtaaacttgaattgaagtgaagaaggagatggctgcaacctcttccttgtgctcatcgaccctccaatcccagatcaatggattcttgcttcacaaaacctctcttgctcatactccttccctcactttctccaggcggaaaatttcaaccacagtgaaggctacatctcgagtcgacaagttttcaaaaagcgatatcatgtggtcgctccgtccattc

SEQ ID NO: 4754 - DNA, 262 bp, Glycine max
  Clone ID: 700659817H1
gctggagttgtcttaaaccccggtacccccttaagtgcaatagaatatatccttgatgtggttgatttggtcttaattatgtccgtaaaccctggctttggtggccagagttttattgagagtcaagtaaagaaaatttctgatttgagaagattgtgtgcggagaagggagtgaatccatggattgaagtagatggtggagttggtccagcaaatgcatacaaggtgattgaggctggagccaatgcactggttgctggct

SEQ ID NO: 4755 - DNA, 282 bp, Glycine max
  Clone ID: 700558457H1
agggtaccagattttattaaggcaggagctgatatagtcagtgttcattgtgaacaatcttccaccatccatttgcatcgtactgttaatcaagtgaaaagtctgggagctaaagctggagttgtcttaaaccctgctacccccttaagtgcaatagaatatgtcctgatgtggtggatttggtcttaattatgtccgtaaaccctggctttggtggccagagttttattgagagtcaagtaaagaaaatttctgacttgagaagagtgtgcgcggaaaagg

SEQ ID NO: 4756 - DNA, 249 bp, Glycine max
  Clone ID: 700898624H1
gtcgctttgttccaaatattacaattggacctcttgtggttgatgcattgcgccctgtgacagatcttcctttggatgtacacctgatgattgtagagcctgaacaaagggtaccagattttattaaggcaggagctgatatagtcagtgttcattgtgaacaatcttccaccatccatttgcatcgtacagttaatcaagtgaaaagtctgggagctaaagctggagttgtcttaaaccccggtaccc

SEQ ID NO: 4757 - DNA, 264 bp, Glycine max
  Clone ID: 700848716H1
ggtgaaagcagtagaattggctggttgtgattggattcacgttgatgtaatggatggtcgctttgttccaaatattacaattggacctcttgtggttgatgcattgcgccctgtgacagatcttcctttggatgtacacctgatgattgtagagcctgaacaaagggtaccagattttattaaggcaggagctgatatagtcagtgttcattgtgaacaatcttccaccatccatttgcatcgtacagttaatcaagtgaaaag

SEQ ID NO: 4758 - DNA, 267 bp, Glycine max
  unsure (1)...(267): unsure at all n locations
  Clone ID: 700990488H1
gtcagtgttcattgtgaacaatcttccnccatccatttgcatcctacagttaacncaagtgaaaagtctgggagctaaagctggagttgtcttaaaccccggtacccccttaagtgcaatagaatatatccttgatgtggttgatttggtcttaattatgtccgtaaaccctggctttggtggccagagttttattgagagtcaagtaaagaaaatttctgatttgagaagattgtgtgcggagaagggagtgaatccatggattga

SEQ ID NO: 4759 - DNA, 277 bp, Glycine max
  unsure (1)...(277): unsure at all n locations
  Clone ID: 700980873H1
gtccaattgtaatatttggaacaaaacggccatccattacaattngacctcttgtggttgatgcattgcgccctgtgacanctcttcctttggatgtacacctgatgattgtacagcctgaacaaagggtaccagattttattaaggcaggagctgatatagtcagtgttcattgtgaacaatcttccaccatccatttgcatcgtactgttaatcaagtgaaaagtctgggagctaaagctggagttgtctaaaccctgctacccccttaagtgca

SEQ ID NO: 4760 - DNA, 263 bp, Glycine max
  unsure (1)...(263): unsure at all n locations
  Clone ID: 700654880H1
ggctggagttgtcttaaaccccggtacccccttaagtgcaatagaatatatccttgatgtggttnatttggtcttaattntgtaccgtaaaccctggctttggtggccagagttttattgagagtcaagtaaagaaatttctgatttgagaagattgtgtgcggagaagggagtgaatccatggattgaagtagatggtgggngttggtccagcaaatgcatacaggtgatnggaggctggnagccaaaccntggtgcaggcc

SEQ ID NO: 4761 - DNA, 417 bp, Glycine max
  Clone ID: LIB3040-057-Q1-E1-C5
aagacggctgcgagaagacgacagaagggggagaaagaaagaaaagatgggaatgacaccgaaaatagctccttcgatgctctcttccgacttcgccaatttggcttccgaggctcagcgcatgctccacttcggcgccgattggctccacatggacatcatggatgggcattttgtccccaatttaactattggcgctccagttattgaaagtttgagaaagcacacaaaggcatatttggattgtcaccttatggttacaaatcctcttgattatgttgaacccttggcaaaagctggtgcttctggttttacatttcacgtagagacatcaaaagataactggaaagaacttatccaaagaatcaagtcacatggcatgattcctggtgtagcattaaagcctgggacccccgt

SEQ ID NO: 4762 - DNA, 368 bp, Glycine max
  Clone ID: LIB3030-001-Q1-B1-F10
gatggccgttttgttccaaatattacaattggacctcttgtggttgatgcattgcgccctgtgacagatcttcctttggatgtacacctgatgattgtacagcctgaacaaagggtaccagattttagtaaggcacgagctgatatagtcagtgttcattgtgaacaatcttccaccatccatttgcatcgtactgttaatcaagtgaaaagtctgggagctaaagctggagttgtcttaaaccctgctacccccttaagtgcaatagaatatgtccttgatgtggtggatttggtcctaattaagtccgtaaaccctggctttggtggccacagttttaatgagagtcaagtaaagaaaatttctga

SEQ ID NO: 4763 - DNA, 350 bp, Zea mays
  unsure (1)...(350): unsure at all n locations
  Clone ID: 700206243H1
cgccatcgacggtgccgacgaggttgaccctgaccttaaccttgtgaaagggaggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactncaactacatcgtcgatttatacttcaagacgccaatcaaggatgcgttggcagcaggac

SEQ ID NO: 4764 - DNA, 264 bp, Zea mays
  Clone ID: 700157368H1
ccgctctccacgctcgacgacaacccgctcatcgacctcgccatcgacggtgccgacgaggttgaccctgacctcaaccttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgttt

SEQ ID NO: 4765 - DNA, 267 bp, Zea mays
  Clone ID: LIB3067-007-Q1-K1-C3
caaactgcggctgctgtagatacgcgcgccgtcactccaaggtccaagcctcccttgctcccgccaccgcccctcaccatgggcagcgccgccgcctctccgcagccgtctgggaatctgacgcaggacgagctcaagcgcgtggcggcgcaccgcgcggtggagttcgtggagcccggcatgacgctgggcctgggcacgggttccacggccgcgcacgcgctggaccgtctgggctacctactccgcgtgggctcgctgtccggg

SEQ ID NO: 4766 - DNA, 333 bp, Zea mays
  Clone ID: LIB84-028-Q1-E1-A11
acgcccacgcgtccgtcccgttcccgatcctcatcacctcaaccccgcgccgccccctccccaccaccctcgccatggtcagcgccgccgcctcgccgccgccgtccgggaagccgacgcaggacgagctgaagcgcttggcggcgcaccgcgcggtggagctcgtggagcccggcatgacgctgggcctgggcacgggctccacggcggcgcacgcgctggaccgcctgggcgacctcctccgcgcgggcgcgctgccgggggtggccggcgtgccgacctcgctcaagacggatgcgcaagcggcgcgcgtcggcatcccgctgctcccgc

SEQ ID NO: 4767 - DNA, 420 bp, Zea mays
  Clone ID: LIB3078-033-Q1-K1-A2
ggcgtgcccacatccaagcgcaccttcgagcaggcgcagtcgctcggcatcccgctctggacgctcgacgacaacccgctcatcgacctcgccatcgacggtgccgacgaggttgaccctgacctcaaccttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaag

SEQ ID NO: 4768 - DNA, 432 bp, Zea mays
  Clone ID: LIB3060-054-Q1-K1-G1
accttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaaggatgcgttggcagcaggacaggaaattgcagctctggaaggagttgttgaccatgggttgttcttgaacatggcgagttcagtgatcattgctggaacggacggtgtcagtgtcaaaacgaagtgagtttttgagttgc

SEQ ID NO: 4769 - DNA, 461 bp, Zea mays
  unsure (1)...(461): unsure at all n locations
  Clone ID: LIB3078-054-Q1-K1-B9
caccaagcatgccgcnnatggggtgntgttnttcgtgagaagatgggtgaggcagcatnggacaagtttantgttattgttgacgagacaaaactagttgatgggttaggaggtagtggtctagccatgccagtggaagttgtgcagttctgctggaagtacaaccttgtaagattgcaggaactgtttaaggaggaaggagtcgaggcaaagctaaggtttgaaggcgacaagccctatgttactgacaactcaaactacatcgtcgatttatacttcaagacgccaatcaaggatgccgttggcagcaggacaggaaattgcagctctggaaggagttgttgaccatgggttgttcttgaacatggcgagttcagtgatcattgctggaacggacggtgtcagtgtcaaaacgaaatgagtttttgagttgctttgttggttgngttgaaatttttttt

SEQ ID NO: 4770 - DNA, 333 bp, Zea mays
  Clone ID: 700622640H1
ctcacctcccctccactccctttctcccctgactcctgctctataggatcctccgcctccatcgcctctcgcgcctccaatcgccttcggcgcttcgtccgtcctgctccacctcttcttacgccggttgaccctgacctcaaccttgtgaaagggcggggtggtgctcttcttcgtgagaagatggttgaggcagcatcggacaagtttattgttattgttgacgagacaaaactagttgatgggttaggaggtagtggtctagccatgccagtggaagttgtgcagttctgctggaagtacaaccttgtaagattgcaggactgttaagga

SEQ ID NO: 4771 - DNA, 302 bp, Zea mays
  Clone ID: 700213140H1
ggatggtgctcgggctcgggacgggctccacggccgccttcgccgtcgccgagatcggcgcgctcctggccgcgggcaagctcgagaagatcgtcggcgtgcccacatccaagcgcaccttcgagcaggcgcagtcgctcggcatcccgctctccacgctcgacgacaacccgctcatcgacctcgccatcgacggtgccgacgaggttgaccctgacctcaaccttgtgaaagggcggggtggtgctcttcttcgtgagaagatggttgaggcagcatcggacaagtttattgttattgtt

SEQ ID NO: 4772 - DNA, 249 bp, Glycine max
  Clone ID: 700737894H1
ctcgatctcgccatcgacggcgccgacgaggtcgaccccgacctcaacctcgtcaaaggccgcggcggcgccctcctccgcgagaagatggtcgaggccgcctccgacaagttcgtcgtggtcgtcgacgacaccaagctcgtggacggcctcggcggaagcgggctggccatgccggtggaggtggtccagttctgctggaagtacaatctggatcggcttcaggagcttttcaaggaagaaggtgtg

SEQ ID NO: 4773 - DNA, 240 bp, Glycine max
  Clone ID: 700790677H2
gtcgaccccgacctcaacctcgtcaaaggccgcggcggcgccctcctccgcgagaagatggtcgaggccgcctccgacaagttcgtcgtggtcgtcgacgacaccaagctcgtggacggcctcgcggaagcgggctggccatgccggtggaggtggtccagttctgctggaagtacaatctggatcggcttcaggagcttttcaaggaagaaggtgtggaagcaaaattgagattggagg

SEQ ID NO: 4774 - DNA, 262 bp, Glycine max
  Clone ID: 700891079H1
ggtcgaccccgacctcaacctcgtcaaaggccgcggcggcgccctcctccgcgagaagatggtcgaggccgcctccgacaagttcgtcgtggtcgtcgacgacaccaagctcgtggacggcctcggcggaagcgggctggccatgccggtggaggtggtccagatctgctggaagtacaatctggatcggcttcaggagcttttcaaggaagaaggtgtggaagcaaaattgagattggaggagagtgggaaccctacgtca

SEQ ID NO: 4775 - DNA, 263 bp, Glycine max
  Clone ID: 701120985H1
accacacattcaattttaaacctctgggcgtggctagcttcaacctttaacattaacatggccattccctacccccatttcatcgccaccgagaaagccgccatggacgccggcctcctccacccctcctccccctccgtcatcctcacccaagacgatttgaagaaaatcgccgcctacaaggccgtcgagtacgtggagtccggcatgatcctcggcctcggcaccggctccaccgccaagcatgccgtcgaccgcatcgg

SEQ ID NO: 4776 - DNA, 274 bp, Glycine max
  Clone ID: 700745725H1
cttacattcctttctccaccacacattcaattttgaacctctgggactggctagcttcaacctttaacattaacatggccattccctacccccatttcatcgccaccgagaaagccgccatggacgccggcctcctccacccctcctccccctccgtcatcctcacccaagacgatttgaagaaaatcgccgcctacaaggccgtcgagtacgtggagtccggcatggtcctcggcctaggcaccggctccaccgccaagcatgccgtcgaccg

SEQ ID NO: 4777 - DNA, 244 bp, Glycine max
  Clone ID: 700840778H1
ctcaaggacatcgtcggaatccccacctccacaaaaacccacgaacaagccctctccctcgggatccccctctccgatctcgacgcccaccccgccatcgatctcgccatcgacggcgccgacgaggtcgatcccttcctcaacctcgtcaagggccgtggcggctccctcctccgagaaaaaatggtcgaaggcgcatgcaagaagttcatcgtcatcgttgatgagtccaagctcgtaaact

SEQ ID NO: 4778 - DNA, 267 bp, Glycine max
  Clone ID: 700898355H1
ccgccatcgatctcgccatcgacggcgccgacgaggtcgaccccttcctcaacctcgtcaagggccgtggcggctccctcctccgagaaaaaatggtcgaaggcgcatgcaagaagttcatcgtcatcgttgatgagtccaagctcgtaaactatttggggggtagtgggttggccatgcccgttgaggttattaagttctgttggaggttcaccgcggcgaggttgcagaagcttcttgaggaggctgggtgcgttgccaggctca

SEQ ID NO: 4779 - DNA, 291 bp, Glycine max
  unsure (1)...(291): unsure at all n locations
  Clone ID: 700562390H1
gatttgaagaaaatcgcngcctacaaggccgtcgagtacgtggagtccggcatggtcctcggcctaggcaccggctccancgccaagcatgccgtcgancgcatcggcgagctcctccgccagggcaagctcaaggacatcgtcggaatccccacctccacaaaaacccacgaacaagccctctccctcgggatccccctctccgatctcgacgcccaccccgccatcgatctcgccatcgacggcgccgacgaggtcgaccccttcctcaacctcgtcaagggccgtggg

SEQ ID NO: 4780 - DNA, 265 bp, Glycine max
  Clone ID: 700961206H1
agacgacctcaagaaaatcgccgcctacaaggccgtcgagtacgtcgagtccggcatggtcctcggcctcggcaccggctccactgccaagcacgccgtcgaccgcatcggcgagctcctccgccaaggaaaactcaaagacatcgtcggcatccccacctccaccaaaacccacgaccaggccctctccctcggcatccccctctccgatctcgactcccaccccaccgtcgatctcgccatcgacggcgccgacgaggtcgat

SEQ ID NO: 4781 - DNA, 260 bp, Glycine max
  Clone ID: 701120413H1
cacaccacaacgcctccacgcgccttattctatgcacccctaactcttttaaactgcgcactccactccactccctccccgccatccgcgccatcaccctcacccaggacgacctcaagagactcgccgccgacaaggccgtggagtccgtcaacagcggcatggtcctcggcctaggcaccggctccactgctgccttcgtcgtcgccaagcttggcgcccttctcgcctccggccaactctccgacatcgtcggtgtc

SEQ ID NO: 4782 - DNA, 242 bp, Zea mays
  Clone ID: 700427028H1
tgaaagcatcaaggccagtatcgaggccaggaaaccagattttgatgcctttattgatccgcagaagcagtatgctgatgctgtgattgctgttctgcagacccagttgattcccgacgacaacgaaggaaaagtgctgcgtgttaagctcatcatgacagcaggggtgaagaacttcaaaccggtttatctctttgaagaaggatcgaccgtcagctgggtgccttgtggaagacagctca

SEQ ID NO: 4783 - DNA, 275 bp, Zea mays
  Clone ID: 700441954H1
ctctcttctcctctccaaggtccctgccacccacacaaggcttggactcttgggccggccgggggggaagaagacaagacaaacgcagccgccggcatgatggcgatctgcagcgcgcacaccaccaccatctccctgcgctccccatgcacgacgaccgtctcgaacgcggcagctggcttggtgcagaagcaagtcatcttcttgaccagcatcaacaggaggagcggcagcagaaggcgtggaggaggggtgagcaggaccttactccaggt

SEQ ID NO: 4784 - DNA, 293 bp, Zea mays
  Clone ID: 700448070H1
taccgctacagcgagaaccggaatcgtcgagacatctcccatcacccgctgcaccaacgttcgatgagcgtgtgcgggatctgctagatttcagcatctacctggatatcagcaacgaggtgaagcttgcatggaaaattcagagagacatgggagagcgtggtgggcacagccttgagagcacaaggcctccatcgaggcgaggaagcccgacttcgaagcttacattgagcagcagaagcagtacgcggacgccgtgatagaggtcctgccgacgcagctgatcccgggcg

SEQ ID NO: 4785 - DNA, 273 bp, Zea mays
  Clone ID: 700581778H1
ctcgacccgccggagcttatcacgccgcccaagatctttgtcatcgcaggtctgcacccaatcttcgacgagcgtgtgaacgacctcttagacttcagcatctacttggacatcagtgatgaggttaagtttgcatggaaaatccaggtcagcgagacattgtatgttccttagcttgctccacatgagccagtaaagggtgtctttctgctgtttaatttctagaaaaaatatcaccgctactaatttggcagcgggacatggcagagcgtg

SEQ ID NO: 4786 - DNA, 280 bp, Zea mays
  Clone ID: 700044442H1
cgccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatg

SEQ ID NO: 4787 - DNA, 279 bp, Zea mays
  Clone ID: 700044434H1
caccttgaaagcatcaaggccagtatcgaggccaggcgaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcagattttcctat

SEQ ID NO: 4788 - DNA, 286 bp, Zea mays
  Clone ID: 700430775H1
aggacctcttagatttcagtatctacttggacatcagtgatgaagttaagtttcatggaaaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttat

SEQ ID NO: 4789 - DNA, 263 bp, Zea mays
  Clone ID: 700043261H1
cgaccatcagctgggtgccttgtggaagacagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagacc

SEQ ID NO: 4790 - DNA, 290 bp, Zea mays
  Clone ID: 700101266H1
cccacgcgtccggagcgagtgagggacctcttagatttcagtatctacttggacatcagtgatgaagttaagtttgcatggaaaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaa

SEQ ID NO: 4791 - DNA, 258 bp, Zea mays
  Clone ID: 700440552H1
gacctcttagatttcagtatctacttggacatcagtgatgaagttaagtttgcatggaaaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaa

SEQ ID NO: 4792 - DNA, 243 bp, Zea mays
  Clone ID: 700430385H1
ggtatctgctctggagatggatgggcaattcgacagactagatgagctcatctacgtggagagccatctaagcaacctttcaaccaagttctacggagaggtgacacaacaaatgctaaagcatgcagacttcccaggtagcaacaacaggacaggtctcttccagaccatcattggactgaagattagagacctctatgaacagattgttgctgagagggctagtgtaccagcggaagcagc

SEQ ID NO: 4793 - DNA, 247 bp, Zea mays
  Clone ID: 700441643H1
ctttgacgaaggatcgaccatcagctgggtgccttgtggaagacagctcacatgctcttaccctggcatcaaattctcctatggcccggacacttacttcggaaacgaggtatctgttctggagatggatgggcaattcgacagactagatgagctcatctacgtggagagccatctaagcaccctttcacccaagttctccggagaggtgacacaacaaatgctaaagcatgcagacttcccaggt

SEQ ID NO: 4794 - DNA, 275 bp, Zea mays
  Clone ID: 700042294H1
ctcatctacgtggagagccatctaagcaacctttcaaccaagttctacggagaggtgacacaacaaatgctaaagcatgcagacttcccaggtagcaacaacgggacacgtctcttccagaccatcattggactgaagattagagacctctatgaacagattgttgctgagagggctggtgtaccagcggaagcagcaaaagtttaacgatctatgcattcagatgtcctaaaactacagctctccgaactcaatgggagtcacaccttcgatct

SEQ ID NO: 4795 - DNA, 314 bp, Zea mays
  Clone ID: 700099212H1
caacacgctcatcagtgacaccacgacagtcatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttagatttcagtatctacttggacatca

SEQ ID NO: 4796 - DNA, 315 bp, Zea mays
  Clone ID: 700099715H1
cccacgcgtccgcggacgcgtggtccgtcgacaagccggtggtgattggcctggcggcagactcagggtgcggcaagagcaccttcatgcgccggctcaccagcgtcttacgtggcgccgcggatccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcag

SEQ ID NO: 4797 - DNA, 305 bp, Zea mays
  Clone ID: 700100470H1
gaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccg

SEQ ID NO: 4798 - DNA, 257 bp, Zea mays
  Clone ID: 700438420H1
cgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgagtgagggacctcttagattgcagtatctacttggacatcagtgatgaagttaagtttgcatggacaatccagcgggaca

SEQ ID NO: 4799 - DNA, 304 bp, Zea mays
  Clone ID: 700353611H1
ctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggc

SEQ ID NO: 4800 - DNA, 236 bp, Zea mays
  Clone ID: 700100342H1
agtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacag

SEQ ID NO: 4801 - DNA, 273 bp, Zea mays
  Clone ID: 700043758H1
agaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcatactcagggtgcggcaagagcaccttcatgcgccggctcac

SEQ ID NO: 4802 - DNA, 310 bp, Zea mays
  Clone ID: 700100269H1
gacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcggga

SEQ ID NO: 4803 - DNA, 301 bp, Zea mays
  Clone ID: 700099313H1
gacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggaccgcccaa

SEQ ID NO: 4804 - DNA, 329 bp, Zea mays
  Clone ID: 700097674H1
cttcaagtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcg

SEQ ID NO: 4805 - DNA, 317 bp, Zea mays
  Clone ID: 700097907H1
ggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggaccg

SEQ ID NO: 4806 - DNA, 311 bp, Zea mays
  Clone ID: 700098314H1
cggacggtgggtcaaacgccggcacgcgcacgcagacacgatggcgatctgcagcgcgcacactaccacctccctgcgctccccatgcacgaccgtctcgaacacaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgccca

SEQ ID NO: 4807 - DNA, 309 bp, Zea mays
  Clone ID: 700098714H1
aagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcg

SEQ ID NO: 4808 - DNA, 289 bp, Zea mays
  Clone ID: 700101077H1
cccatccaccacaaggcttggcttcgtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcacctt

SEQ ID NO: 4809 - DNA, 259 bp, Zea mays
  Clone ID: 700439560H1
cgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcgattgagggacctcttagatttcagtatcgacttggacatcagtgatgaagtaaggtttgcatggatattccagcggtacatg

SEQ ID NO: 4810 - DNA, 307 bp, Zea mays
  Clone ID: 700094395H1
gtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccgg

SEQ ID NO: 4811 - DNA, 304 bp, Zea mays
  Clone ID: 700208768H1
cccacgcgtccgctcttcaagtgccactcccatccaccacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcg

SEQ ID NO: 4812 - DNA, 271 bp, Zea mays
  Clone ID: 700100913H1
accacaaggcttggcttggtgggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggc

SEQ ID NO: 4813 - DNA, 228 bp, Zea mays
  Clone ID: 700042685H1
gaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctg

SEQ ID NO: 4814 - DNA, 267 bp, Zea mays
  Clone ID: 700097183H1
gaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcatccaggtctcgtgctccgtcgacaagccggtggtgattggcctggcggcagactcagggtgcggcaagagcaccttcatgcgc

SEQ ID NO: 4815 - DNA, 329 bp, Zea mays
  Clone ID: 700101216H1
acccacgcgtccggacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaagagcggcggcggcaggaggcacggaagggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacacgg

SEQ ID NO: 4816 - DNA, 239 bp, Zea mays
  Clone ID: LIB36-008-Q1-E1-F4
cggaagcgtgggcggacccgtgggagctcacgtgctcttaccccggcatcaaattcgcctacggcccagacatttacttcggaaacgaggtatctgttttggagatggatgggcagttcgacagactagacgagctcatctacgtggagagccatctgagcaacctctcgaccaagttctacggggaggtgacacagcagatgctgaagcacgcggacttcctggaagcaacaacggac

SEQ ID NO: 4817 - DNA, 421 bp, Zea mays
  Clone ID: LIB189-012-Q1-E1-H11
aaccagattttgatgcctttattgatccgcacaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggac

SEQ ID NO: 4818 - DNA, 426 bp, Zea mays
  Clone ID: LIB3078-011-Q1-K1-B10
cgcagaagcagtatgctgatgctgtgattgaagttctgccgacccagttgattcccgaggagcgacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagactttccaggtagcaacaacgggacaggtctctttcagaccatcattggactgaag

SEQ ID NO: 4819 - DNA, 424 bp, Zea mays
  Clone ID: LIB3066-004-Q1-K1-D6
tgcgtgttaagctcatcatgaaagaaggggtgaagaacttcaacccggtttatctctgggacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctat

SEQ ID NO: 4820 - DNA, 399 bp, Zea mays
  Clone ID: LIB3060-025-Q1-K1-F6
cgcttagatttcagtatctacttggacatcagtgatgaagttaagtttgcatggagaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatct

SEQ ID NO: 4821 - DNA, 396 bp, Zea mays
  Clone ID: LIB189-006-Q1-E1-A5
cccacgcgtccgcccacgcgtccgcggacgcgtgggcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgt

SEQ ID NO: 4822 - DNA, 376 bp, Zea mays
  unsure (1)...(376): unsure at all n locations
  Clone ID: LIB36-001-Q1-E1-G1
agatatcagtatctacttggacatcagtgatgaagttaagtttgcatggaaaatccagcgggacatggcagagcgtgggcacagccttgaaagcatcaaggccagtatcgaggccaggaaaccagattttgatgcctttattgatccgcagaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcncggacacttac

SEQ ID NO: 4823 - DNA, 384 bp, Zea mays
  Clone ID: LIB84-013-Q1-E1-B8
aaaaaatccagcgggacatggcagagcgtgggcacagccttgaaagcatcaaggccagtatcgaggccaggaaaccagattttgatgcctttattgatccgcaaaagcagtatgctgatgctgtgattgaagttctgccgacccagttgattcccgacgacaacgaaggaaaggtgctgcgtgttaagctcatcatgaaagaaggggtgaagaacttcaacccggtttatctctttgacgaaggatcgaccatcagctgggtgccttgtggaagaaagctcacatgctcttaccctggcatcaaattttcctatggcccggacacttacttcggaaacgaggtatctgttctggagatggatgggcaattcgacagactagatg

SEQ ID NO: 4824 - DNA, 458 bp, Zea mays
  unsure (1)...(458): unsure at all n locations
  Clone ID: LIB36-014-Q1-E1-D8
gatgagctcatctacgtggagagccatctaagcaacctttcaaccaagttctacggagaggtgacacaacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatcnctcttgaagagagtgagaactcgatagatcaagaatcaccacacgttgtattaatcgtatggtataatatttatacatgtacaggatgagcta

SEQ ID NO: 4825 - DNA, 401 bp, Zea mays
  unsure (1)...(401): unsure at all n locations
  Clone ID: LIB36-017-Q1-E1-H3
aacaaatgctaaagcatgcagacttcccaggtagcaacaacgggacaggtctcttccagaccatcattggactgaagattagagacctctatgaacagattgttgctgagagggctggtgtaccagcggaagcagcaaaagtttaacgatctatgcattcagatgtcctaaaactacagctctccgaactcaatgggagtaacaaccttcgcatctgttgggatatatggcgagctaggaggtatagaaatgtcattgcagaactcaggaaaacgtgcaatggaatttcttgaaatcnctcttgaagagagtgagaactcgatagatcaagaatcaccacacgttgtattaatcgtatggtataatatttatacatgtacaggaaaaaaaaaaaaacaaaa

SEQ ID NO: 4826 - DNA, 412 bp, Zea mays
  Clone ID: LIB189-029-Q1-E1-D12
agtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggcaggaaggagaaaggtgtgaccgccctcgaccctagggccaacaactttgatctcatgtatgagcaggtgaaggcgatcaaggaaggccaggcagtcgagaagcccatctacaaccatgtcactggcctcctcgaccctccggagcttatcgcgccaccaaagattttcgtcattgaaggtctgcacccaatgttcgatgagcga

SEQ ID NO: 4827 - DNA, 349 bp, Zea mays
  Clone ID: LIB3078-055-Q1-K1-D12
gccccggcagctacgggttcagcaccaacctcagggcctgctgcggcgccggcggcggcgagtacaactaccagaacggcgcgcggtgcggcatgcccggcgcgtacgcgtgctctgacccggggttcgtcgctcaactgtgacggcatccacctgacggaggcggcgtataggaagatcgccgactggtgggtcaacgggggctacttgcaaccggtcattttgggctaaaagcttgttcgggaaccggggttcggggcttggttgggggtccgttggcccttaaggttagggaaggggatcggattaattgtaatttttttagctggaatctaagcaggcgagaaga

SEQ ID NO: 4828 - DNA, 428 bp, Zea mays
  Clone ID: LIB36-020-Q1-E1-D1
cccacacgtccgataagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattcgctggacaggaactgcaggaaggagaaaggtgtgaccg

SEQ ID NO: 4829 - DNA, 381 bp, Zea mays
  Clone ID: LIB36-013-Q1-E1-B5
agaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccct

SEQ ID NO: 4830 - DNA, 396 bp, Zea mays
  Clone ID: LIB3060-028-Q1-K1-B7
gcggaagacaaacgccggcacgcgcacgcagacacgatggcgatctgcagcgcgcacacgaccacgggcctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatgcctcgacgactaccattccctggacaggaacggc

SEQ ID NO: 4831 - DNA, 390 bp, Zea mays
  Clone ID: LIB189-020-Q1-E1-B11
agcggacgcgtgggcggacgcgtggggggaagaagacaaacgccggcacgcgcacgcagacacgatggcgatctgcagcgcgcacactaccacctccctgcgctccccatgcacgaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaccagcgtcttcggtggcgccgcggagccgcccaagggcgggaacccggactccaacacgctcatcagtgacaccacgacagtgatatg

SEQ ID NO: 4832 - DNA, 392 bp, Zea mays
  Clone ID: LIB3062-047-Q1-K1-H1
gtgccactcccatccaccacaaggcttggcttggtgggaagaagacaaacgccggcacgcgcgacgcggacacgatggcgatctgcagcgcgcacactaccacctccctgcgctccccatgcacaaccgtctcgaacgcaggtctgaggcagaagcaagtcatcttcgtcaccagcaacaggaggagcggcggcggcaggaggcacggaggggcaaggagcttccaggtctcgtgctccgtcgacaagccggtggtgattggcctggcggcagactcagggtgcggcaagagcaccttcatgcgccggctcaacaacggttttcggggcgccgcggagcccgccaaaggcgggaacccggacttcaacacgctcatcagtgacaccacgaca

SEQ ID NO: 4833 - DNA, 193 bp, Glycine max
  unsure (1)...(193): unsure at all n locations
  Clone ID: 700657358H1
gggtgtcactgcccttgaccctagagccaatgattttnatctncatgtatgaacaagttaaagctcttaaggatggaattgctgttgaaaaaccaatctacaaccatgtcactggtctnttggatcccccngngcctnatnaaacccccccnaaantnngggnncttgaagggtntaccccncntttttttcc

SEQ ID NO: 4834 - DNA, 237 bp, Glycine max
  Clone ID: 700790008H2
ctactcattccagatgacaacgagggtaagattttgagagtgaggttgatacagaaagaaggggttaagtactttagcccagtttacttatttgatgatggctctaccatttcatggataccatgtcgaaggaagtttacatgctcataccctggcatcaatttcttctatggaccagacacttactagggaaatgaggtgtcacttgtagaaatggctggacaatttgacagacta

SEQ ID NO: 4835 - DNA, 263 bp, Glycine max
  Clone ID: 700872439H1
ggaggcgcagcagagccaccaaagggtggcaaccctgactccaacactctcatcagtgacaccaccactgtcatatgcttggatgattaccactctgtggacagaactggaagaaaggagaagggtgtcactgcccttgaccctagagccaatgattgcgatctcatgtatgcacaagttaaagctcttaaggatggaattgctggtgaaagaccaatctacaaccatgtcactggtctcttggatacccctgagctcattaa

SEQ ID NO: 4836 - DNA, 280 bp, Glycine max
  Clone ID: 701055931H1
cggctcgagctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacgcaactcattccagatgacaacgagggtaagattttgagagtgagattgatacagaaagagggggttaagtactttagcccggtttacttgttt

SEQ ID NO: 4837 - DNA, 358 bp, Glycine max
  Clone ID: 700680979H1
ccaccactgtcatatgcttggatgattaccactctttggacagaactggaagaaaggagaagggtgtcactgcccttgaccctagagccaatgattttgatctcatgtatgaacaagttaaagctcttaaggatggaattgctgttgaaaaaccaatctacaaccatgtcactggtctcttggatccccctgagctcattaaactccccaaaatcttagtcattgaaggtttgcacccaatgtttgattcccgtgtcagagatctcttggactttagcatctacctagacattagcaatgaggtcaaattcgcttggagaattcagagagacatggcagagcgtggacacagtcttga

SEQ ID NO: 4838 - DNA, 285 bp, Glycine max
  Clone ID: 700990472H1
caacaagttaaagctcttaaggatggaattgctgttgaaaaaccaatctacaaccatgtcactggtctcttggatccccctgagctcattaaaccccccaaaatcttagtcattgaaggtttgcacccaatgtttgattcccgtgtcagagatctcttggactttagcatctacctagacattagcaatgaggtcaaattcgcttggaaaattcagagagacatggcagagcgtggacacagtcttgaaagcatcaaggctagcattgaagcaaggaagcctgat

SEQ ID NO: 4839 - DNA, 277 bp, Glycine max
  Clone ID: 700556547H1
ttttgatctcatgtatgaacaagttaaagctcttaaggatggaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggct

SEQ ID NO: 4840 - DNA, 278 bp, Glycine max
  Clone ID: 700684029H1
ggaagcctgattttgaagcatatattgatccacaaaagcaatacgcagatgcagtgatagaagtgttgccaacccaactcattccagatgacaacgagggtaagattttgagagtgaggttgatacagaaagaaggggttaagtactttagcccagtttacttatttgatgatggctctaccatttcatggataccatgtggaaggaagcttacatgctcctaccctggcatcaaattcttctatggaccagagacttactacggaaatgaggtgtca

SEQ ID NO: 4841 - DNA, 265 bp, Glycine max
  Clone ID: 700684302H1
ggcagagcgtggagacagtcttgaaggcatcaaggctagcattgaagcaaggaagcctgattttgaagcatatattgatccacaaaagcaatacgcagatgcagtgatagaagtgttgccaacccaactcattccagatgacaacgaggagaagattttgagagtgaggttgatacagaaagaaggggttaagtactttagcccagtttacttatttgatgatggctctaccatttcatggataccatgtggaaggaagcttaca

SEQ ID NO: 4842 - DNA, 267 bp, Glycine max
  Clone ID: 700877162H1
gaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaag

SEQ ID NO: 4843 - DNA, 255 bp, Glycine max
  Clone ID: 700875857H1
cagagcgtggacacagtcttgaaagcatcaaggctagcattgaagcaaggaagcctgattttgaagcatatattgatccacaaaagcaatacgcagatgcagtgatagaagtgttgccaacccaactcattccagatgacaacgaggggaagattttgagagtgaggttgatacagaaagaaggggttaagtactttagcccagtttacttatttgatgatggctctaccatttcatggataccatgtggaagga

SEQ ID NO: 4844 - DNA, 257 bp, Glycine max
  Clone ID: 700875895H1
cctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatg

SEQ ID NO: 4845 - DNA, 249 bp, Glycine max
  Clone ID: 700791057H1
ttcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacgcaactcattccagatgacaacgagggtaagattttgagagtgagattgatacagaaagagggggttaagtactttagcccggtttacttgtttgatgat

SEQ ID NO: 4846 - DNA, 266 bp, Glycine max
  unsure (1)...(266): unsure at all n locations
  Clone ID: 700990257H1
agccaatgattttnatctcatgtatgaacaagttaaagctcttaaggatggaattgctgttgaaaaaccaatctacaaccatgtcactggtctcttggatccccctgagctcattaaaccccccaaaatnttagtcattgaangtttgcacccaatgtttgattcccgtgtcagagatctcttggactttagcatctacctagacattagcaatgaggtcaaattcgcttggaaaattcagagagacatggcagagcgtggacaca

SEQ ID NO: 4847 - DNA, 274 bp, Glycine max
  unsure (1)...(274): unsure at all n locations
  Clone ID: 700991766H1
agccaatgattttgatctcatgtatgaacaagttaaagctcttaaggatggaattgctgttgaaaaaccaatctacaaccatgtcactggtctcttggatccccctgagctctaaacccccnaaatcttagtcattgaaggtttgcacccaatgtttgattcccgtgtcagagatctcttggactttagcatctacctagacattagcaatgaggtcaaattcgcttggaaaattcagagagacatggcagagcgtggacacagtcttgaaaga

SEQ ID NO: 4848 - DNA, 243 bp, Glycine max
  Clone ID: 700875789H1
cctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggctagcatgaagcaaggaagcctgattttgaagcatatattgatccacaaaag

SEQ ID NO: 4849 - DNA, 242 bp, Glycine max
  Clone ID: 700791651H1
ggaagcctgattttgaagcatatattgatccacaaaagcaatacgcagatgcagtgatagaagtgttgccaacccaactcattccagatgacaacgagggtaagattttgagagtgaggttgatacagaaagaaggggttaagtactttagcccagtttacttatttgatgatggctctaccatttcatggataccatgtggaaggaagcttacatgctcctaccctggcatcaaattcttc

SEQ ID NO: 4850 - DNA, 273 bp, Glycine max
  Clone ID: 701106902H1
ggagaagggtgtcactgcccttgaccctagagccaatgattttgatctcatgtatgaacaagttaatgctcttaaggatggaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagag

SEQ ID NO: 4851 - DNA, 220 bp, Glycine max
  Clone ID: 700739192H1
cctggatccccctgagctcattaaaccccccaaaatcttagtcattgaaggcttgcacccaatgtatgattctcgggtcagagatctcttggactttagcatctacctagacattagcaatgaggtcaaattcgcttggaaaattcagagagacatggcagagcgtggacacagtcttgaaagcatcaaggctagcattgaagcaaggaagcctgatttt

SEQ ID NO: 4852 - DNA, 240 bp, Glycine max
  Clone ID: 700681723H1
ggcagagcgtggacacagtcttgaaagcatcaaggctagcattgtagcaaggaagcctgattttgaagcatatattgatccacaaaagcaatacgctcatgcagtgatagaagtgttgccaacccaactcattccagatgacaaaaaaattaaaatattgagagtgaggttgatacagaaagaaggggttaagtactttagcccagtttacttatttgatgatggctctaccatttcatg

SEQ ID NO: 4853 - DNA, 243 bp, Glycine max
  Clone ID: 700755385H1
ggcattgctgttgacaaaccaatctgcaaccatgtcactggtctcttggatccccctgagctcattaaaccccccaaaatcttagtcattgaaggtttgcacccaatgtttgattcccgtgtcagagatctcttggactttagcatctacctagacattagcaatgaggtcaaattcgcttggaaaattcagagagacatggcagagcgtggacacagtcttgagagcatcaaggctagcatt

SEQ ID NO: 4854 - DNA, 267 bp, Glycine max
  Clone ID: 700870864H1
gagccaatgattttgatctcatgtatgaacaagttaaagctcttaaggatggaattgctgttgaaaaaccaatctacaaccatgtcaatgggctcctggatcccgctgagctcatttcaccgcccaaaatcttagtcattgaaggcttgcacccaatgtatgattctcgggtcagagatctcttggactttagcatctacctagacattagcaatgaggtcaaattcgcttggaaaattcagagagacatggcagagcgtggacaca

SEQ ID NO: 4855 - DNA, 242 bp, Glycine max
  Clone ID: 701107593H1
ggagaagggtgtcactgcccttgaccctagagccaatgattttgatctcatgtatgaacaagttaaagctcttaaggatggaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattagca

SEQ ID NO: 4856 - DNA, 254 bp, Glycine max
  unsure (1)...(254): unsure at all n locations
  Clone ID: 701002558H1
tcctggatccccctgagctcattaaaccccccaaaatcttagtcattgaaggcttgcacccaatgtatgattctccgggtcagagatctcttggactttagcatctacctagacattagcaatgaggtcaaattcgcttggaaaattcagagagacatggcagagcgtggacacagtcttgaaagcatcaagggctagcattgaagcaaggaagctgattttgaagcntatattgatccacaaaagcaatnngc

SEQ ID NO: 4857 - DNA, 243 bp, Glycine max
  Clone ID: 700875430H1
cagaaaggagaagggtgtcactgcccttgaccctagagccaatgattttgatctcatgtatgaacaagttaaagctcttaaggatggaattgctgttgaaaaaccaatctacaaccatgtcactggtctcctggatccccctgagctgcattaaaccccccaaaatcttagtcattgaaggcttgcacccaatgtatgattctcgggtcagagatctcttggactttagcatctacctagaca

SEQ ID NO: 4858 - DNA, 252 bp, Glycine max
  unsure (1)...(252): unsure at all n locations
  Clone ID: 700654704H1
cacagtcttgaaagcatcaaggctagcattgnngcaaggnagcctgatnttgaagcntatattgatccacaanagcaatacgcagatgcagtgatagaagtgttgccaacgcaactcattccagatgaccaacgagggtaagattttgagagtgagattgatacagaaagagggggttaagtactttagcccggtttacttgtntgatgatggcnctacnattcatggtaccatgtggnagaagttacatgc

SEQ ID NO: 4859 - DNA, 98 bp, Glycine max
  Clone ID: 701070469H1
gtggacacagtcttgaaagcatcaaggctagcattgaagcaaggaagcctgattttgaagcatatattgatccacaaaagcaatacgccgatgcagtg

SEQ ID NO: 4860 - DNA, 110 bp, Glycine max
  Clone ID: 700739393H1
aaagctcttaaggatggaattgctgttgaaaaaccaatctacaaccatgtcactggtctcctggatccccctgagctcattaaaccccccaaaatcttagtcattgaagg

SEQ ID NO: 4861 - DNA, 86 bp, Glycine max
  unsure (1)...(86): unsure at all n locations
  Clone ID: 700657046H1
ggaagcctgattttgaanncatanattgatccacaaaagcaatacgcngatggcagtgatagangtgttgccaaacccaactcatt

SEQ ID NO: 4862 - DNA, 290 bp, Glycine max
  Clone ID: 700984236H1
agcttacatgctcctaccctgggcatcaaattcttctatggaccagagacttactacggaaatgaggtgtcagttgtagaaatggatggacaatttgacagactagatgaactaatatacgttgagagccacctaagcaacctctctacaaagttctatggagaggttactcaacagatgttgaagcatgctgatttccccggcagcaacaatggaacaggtctcttccaaaccatagttggtttgaagataagagatttatatgagcagctaatagccaccaaggctga

SEQ ID NO: 4863 - DNA, 259 bp, Glycine max
  Clone ID: 701109839H1
agcttacatgctcctaccctggcatcaaattcttctatggaccagagacttactacggaaatgaggtgtcagttgtagaaatggatggacaatttgacagactagatgaactaatatacgttgagagccacctaagcaacctctctacaaagttctatggagaggttactcaacagatgttgaagcatgctgatttccccggcagcaacaatggaacaggtctcttccaaaccatagttggtttgaagataagagattt

SEQ ID NO: 4864 - DNA, 268 bp, Glycine max
  Clone ID: 700731201H1
gagaaaaaaaagtgaggctgagattcagttatgttgatgatggctctaccatttcatggataccatgtggaaggaagcttacatgctcctaccctggcatcaaattcttctatggaccagagacttactacggaaatgaggtgtcagttgtagaaatggatggacaatttgacagactagatgaactaatatacgttgagagccacctaagcaacctctctacaaagttctatggagaggttactcaacagatgttgaagcatgctga

SEQ ID NO: 4865 - DNA, 265 bp, Glycine max
  Clone ID: 700959747H1
gagcaccttcatgaggaggctgacaagtgtgtttggaggagcagcagagccaccgaagggtggcaaccctgactcaaacacactcatcagtgacaccaccactgtcatatgcttggatgattaccactctttggatagaactggcagaaaggagaagggtgtcactgcccttgaccctagagccaatgattttgatctcatgtatgaacaagttaaagctcttaaggatggaattgctgttgaaaaaccaatctacaaccatgtc

SEQ ID NO: 4866 - DNA, 249 bp, Glycine max
  unsure (1)...(249): unsure at all n locations
  Clone ID: 700994042H1
gtgggaagagcaccttcatgaggaggctgaccagtgtgtttggnggagcagcaganccaccaaagggtggcaaccctgactccaacactctcatcagtgacaccaccactgtcatatgcttggatgattaccactctttggacacaactggaagaaagganaaggntgtcactgcccttgaccctagagccaatgattttgatctcatgtatgaacaagttaaagctcttaaggatgganttgctgttg

SEQ ID NO: 4867 - DNA, 258 bp, Glycine max
  Clone ID: 700899089H1
gaagctatgtgataacatgtgcagcaggtgactcacagacagtggtgattggtcttgctgcagactcagggtgtgggaagagcaccttcatgaggaggctgacaagtgtgtttggaggagcagcagagccaccgaagggtggcaaccctgactcaaacacactcatcagtgacaccaccactgtcatatgcttggatgattaccactctttggatagaactggcagaaaggagaagggtgtcactgcccttgacccta

SEQ ID NO: 4868 - DNA, 246 bp, Glycine max
  Clone ID: 700787854H2
ggaggaacagcaacaggggcaacagcagcagcagaagaagctatgtgataacatgtgcagcaggtgactcacagacagtggtgattggtcttgctgcagactcagggtgtgggaagagcaccttctgaggaggctgacaagtgtgtttggaggagcagcagagccaccgaagggtggcaaccctgactcaaacacactcatcagtgacaccaccactgtcatatgcttggatgattaccactcttt

SEQ ID NO: 4869 - DNA, 238 bp, Glycine max
  Clone ID: 700873392H1
caggtagttttctggaggaacagcaacaggggcaacagcagcagcagaagaagctatgtgataacatgtgcagcaggtgactcacagacagtggtgattggtcttgctgcagactcagggtgtgggaagagcaccttcatgaggaggctgacaagtgtgtttggaggagcagcagagccaccgaaggtggcaaccctgactcagacacactcatcagtgacaccaccactgtcatatg

SEQ ID NO: 4870 - DNA, 284 bp, Glycine max
  unsure (1)...(284): unsure at all n locations
  Clone ID: 700553732H1
aaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagagaagaagctatgtgataacatgtgcagcaggtgactcncagacagtggtgattggcctggctgcagactcagggtgtgggaagagcaccttcatgaggaggctgaccagtgtgtttggaggagcagcagagcccacca

SEQ ID NO: 4871 - DNA, 334 bp, Glycine max
  Clone ID: 700560501H1
caaagaaaagccaccttaacatctcttctctgaaaattctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagcaccttcatgaggaggctgaccagtgtgtttggaggag

SEQ ID NO: 4872 - DNA, 265 bp, Glycine max
  Clone ID: 701105881H1
gaaagaatggcagcttgcactgtctactcaacacaatctctgagctcaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagcaccttcatgaggaggctgaccagtgtgtttg

SEQ ID NO: 4873 - DNA, 279 bp, Glycine max
  Clone ID: 700681112H2
ctcgagccgctttagagagatagagagaggaagaaagaatggcagcttgcaatgtctacttaacacaatctctgagcacaaattgctccatctcaaccccatcagagacgcaactcagttttttccaccaaaagcaggtagttttctggaggaacagctagaagggcagctgcagcagcagaagaagctatgtgataacatgtgcagcaggtgactcacagacagtggtgattggcctggctgcagactcagggtgtcggaagagcaccttcatgagga

SEQ ID NO: 4874 - DNA, 273 bp, Glycine max
  unsure (1)...(273): unsure at all n locations
  Clone ID: 700997513H1
ctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatntgcagcaggtgactcacagacagtggtgattggcctggctgcagactcagggtgtgggaagagcaccttcatgaggag

SEQ ID NO: 4875 - DNA, 349 bp, Glycine max
  Clone ID: 700763831H1
ctttagagagatagagagatagagagagagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcaacaggggcaacagcagcagcagaagaagctatgtgataacatgtgcagcaggtgactcacagacagtggtgattggtcttgctgcagactcagggtgtgggaagagcccttcatgaggaggctgacaagtgtgtttggaggagcagcagagccaccgaagggtggcaaccctgactcaa

SEQ ID NO: 4876 - DNA, 278 bp, Glycine max
  Clone ID: 701055857H1
gagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcacaggggcaacagcagcagcagaagaagctatgtgataacatgtgcagcaggtgactcacagacagtggtgattggtcttgctgcagactcagggtgtgggaagagcaccttcatgaggaggctgacaagtgtgtt

SEQ ID NO: 4877 - DNA, 303 bp, Glycine max
  unsure (1)...(303): unsure at all n locations
  Clone ID: 700559450H1
gaaaattctctttagagagatanagagaggaaganagaatggnagcttgcactgtctactgcaacacatctctgagcacaaattngctccatctcaaccccntcnaagacgcnactcagttttgtccaccaaaagcaggtagttttctggaggaacagcaagaagggcagctgcagcaagcagncagagtctatgtgataacntgngcagcaggtgactcacanacantggtgattggcctgggtgcagactccaggtgtgggaagagcacttcatgaggaggctgaccagtntgnttggngg

SEQ ID NO: 4878 - DNA, 278 bp, Glycine max
  unsure (1)...(278): unsure at all n locations
  Clone ID: 701000176H1
agagagagaganagaaattaagaaaaaatgggcagcctgcactgtctactcaacacaatctctgagcacaaattgctccatctccaaccccatcaaagacacagctgagtttcttccaccaaaagcaggtagttttctggaggaacagcnnnnnnnnnnnnnnnnnnnnnnnnnnnnnntatgtgataacatgtgcagcaggtgactcacagacagtggtgattggtcttgctgcagactcagggtgtgggaagagcaccttcatgaggaggctgaca

SEQ ID NO: 4879 - DNA, 282 bp, Glycine max
  unsure (1)...(282): unsure at all n locations
  Clone ID: 700996108H1
ctttagagagatagagagaggaagaaagaatggcagcttgcactgtctactcaacacaatctctgagcaaaaattgctccatctcaaccccatcaaagacgcaactcagttttttccaccaaaagcaggtanccntctggaggaacagcaagaagggcagctgcagcagcagaagaagctatgtgataacatgtgcagcaggtgactcacagacagtggtgattggctgggctgcagactcagggtgtgggaagagcaccttcatgaggaggctgaccagtg

SEQ ID NO: 4880 - DNA, 246 bp, Glycine max
  Clone ID: 700791528H1
ctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggt

SEQ ID NO: 4881 - DNA, 250 bp, Glycine max
  Clone ID: 700901050H1
attctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcaggg

SEQ ID NO: 4882 - DNA, 252 bp, Glycine max
  unsure (1)...(252): unsure at all n locations
  Clone ID: 700979790H2
gaaagaaattaagaaaaaaatggcagcntgcactgtntactcaacacaatntntgagcancaaattgctccatntcaaccccatcaaagacacagctgagtttcttccaccaaaagtaggtacgntntggaggnnnnnnnnnnnnnnnnnnnnnnnnnnnnnnnnnnnntatgtgataacatgtgcagcaggtgantcccagacagtggtgattggtcttgctgnagantcagggtgtgggaagagcacntt

SEQ ID NO: 4883 - DNA, 273 bp, Glycine max
  unsure (1)...(273): unsure at all n locations
  Clone ID: 700877128H1
aaattctctttagagagatagagagaggaagaaagaatggcagcttgcactgtctactcaacacaatatctgagtttaaattgctccatctcaaccccatcaaagacgcaactcagttttttccaccaaaagcaggtatttatctggaggaacagcaagaagggcatggnagtcagcagaagaagctatgtgatatcatgtgcagcaggtgactcacagacagtggtgatggccctggctgcagactcagggtgtgggaagagcacttcatga

SEQ ID NO: 4884 - DNA, 169 bp, Glycine max
  Clone ID: 700743001H1
agcaggtagttttctggaggaacagcaacaggggcaacagcagcagcagaagaagctatgtgataacatgtgcagcaggtgactcacagacagtggtgattggtcttgctgcagactcagggtgtgggaagagcacttcatgaggaggctgacaagtgtgtttggagga

SEQ ID NO: 4885 - DNA, 286 bp, Glycine max
  unsure (1)...(286): unsure at all n locations
  Clone ID: 700995911H1
cgagagagananaaagaaattaagaaaaaatggcagcctgcactgtctactcaacacaatcttctgagcacaaattgctccatctcaaccccatcaaagacacagctgagtttcttccaccaaaagcaggtagttttctggaggaacagcnnnnnnnnnnnnnnnnnnnnnnnnnnnnnntatgtgataacatgtgcagcaggtgactcacagacagtggtgattggtcttgtgcagactcagggtgtgggangagcacttcatgaggaggctgacangtgtgttt

SEQ ID NO: 4886 - DNA, 266 bp, Glycine max
  Clone ID: 701106835H1
gagagatagagagatagagagagagagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcaacaggggcaacagcagcagcagaagaagctatgtgataacatgtgcagcaggtgactcacagacagtggtgattggtcttgctgcagactcagggtgtg

SEQ ID NO: 4887 - DNA, 259 bp, Glycine max
  Clone ID: 700675621H1
ctttagagagatagagagatagagagagagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcaacaggggcaacagcatcagcagaagaagctatgtgataacatgtgcagcaggtgactcacagacagtggtgattggtcttgctgcagac

SEQ ID NO: 4888 - DNA, 257 bp, Glycine max
  Clone ID: 701002519H1
ctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagc

SEQ ID NO: 4889 - DNA, 269 bp, Glycine max
  Clone ID: 700686660H1
tgaaaattctctttagagagatagagagaggaagaaagaatggcagcttgcactgtctactcaacacaatctctgagcacaaattgctccatctcaaccccatcaaagacgcaactcagtttttttccaccaaaagcaggtaggtttctggaggaacagcaagaagggcagctgcagcagcagaagaagctatgtgataacatgtgcagcaggtgactcacagacagtggtgattggcctggctgcagactcagggtgtgggaagagca

SEQ ID NO: 4890 - DNA, 254 bp, Glycine max
  Clone ID: 700738677H1
gagatagagagagagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcaacaggggcaacagcagcagcagaagaagctatgtgataacatgtgcagcaggtgactcacagacagtggtgattggtcttgctgcagactcagggtgtg

SEQ ID NO: 4891 - DNA, 283 bp, Glycine max
  Clone ID: 700963637H1
ctttagagagatagagagatagagagagagagaaagaaattaagaaaaaatggcagcctgcactgtctactcaacacaatctctgagctcaaattgctccatctcaaccccatcaaagacacagctgagtttcttccaccaaaagcaggtacgttctggaggaacagcaacaggggcaacagcagcagcagaagaagctatgtgataacatgtgcagcaggtgactcacagacagtggtgattggtcttgctgcagactcagggtgtgggaagagcacttcat

SEQ ID NO: 4892 - DNA, 264 bp, Glycine max
  Clone ID: 700791287H1
ggaagaaagaatggcagcttgcactgtctactcaacacaatcttcggactaaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacaaacagtggtgattggcctggctgcagactcagggtgtgggaagagcaccttctatgaggagctgaccagtgt

SEQ ID NO: 4893 - DNA, 288 bp, Glycine max
  Clone ID: 700553943H1
tacccctcaaagaaaagccaccttaacatctcttctctgaaaattctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactc

SEQ ID NO: 4894 - DNA, 254 bp, Glycine max
  Clone ID: 700876063H1
tagagagagagagaaagaaattaagaaaaaatggcagcctgcactgtctactcaacacaatctctgtctgaaattgctccatctcaaccccatcaaagacacagctgagtttcttccaccaaaagcaggtactatctggaggaacagcaacaggggcaacagcagcagcagaagaagctatgtgataacatgtgcagcaggtgactcacagacagtggtgattggccttgctgcagactcagggtgtgggaaga

SEQ ID NO: 4895 - DNA, 293 bp, Glycine max
  unsure (1)...(293): unsure at all n locations
  Clone ID: 700555924H1
agaaaagccaccttaacatctcttctctgaaaattctctttagagagatagagagaggaagaaagaatggcagcttgcactgtctactgcaacacaatctcanagcacaaattgctccatctcaaccccatcaaagacgcaactcagttttttcaccaaaagcaggtagttttctggaggaacagcaagaagggcagctgcagcagcagaagaagctatgtgataacatgtgcagcaggtgactcacagacagtggtgattggcctggctgcagactcagggtgtgggagagc

SEQ ID NO: 4896 - DNA, 239 bp, Glycine max
  Clone ID: 700686037H1
aaattctctttagagagatagagagaggaagaaagaatggcagcttgcactgtctactcaacacaatctctgagcacaaattgctccatctcaaccccatcaaagacgcaactcagtttttttccaccaaaagcaggtagttttctggaggaacagcaagaagggcagctgcagcagcagaagaagctatgtgataacatgtgcagcaggtgactcacagacagtggtgattggcctgg

SEQ ID NO: 4897 - DNA, 256 bp, Glycine max
  Clone ID: 700791185H1
ttctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgatacatgtgcagcaggtgactcacagacagtggtgattggcctggctgcagactcagggtgtgggaa

SEQ ID NO: 4898 - DNA, 267 bp, Glycine max
  Clone ID: 700726396H1
gttgagagccaccttagcaacctctctacaaagttctatggagaggttactcaacagatgttgaagcatgctgattttcccggcagcaacaatggaacaggtctcttccaaaccatagttggtttgaagataagagatctatatgagcagctaatagccagcaaggctgagactccagtagctgcaaaagcttaggaattgaacctgccataatatatatacatatatcgatcgagcaacgcagccaaattgagttctctcatcatc

SEQ ID NO: 4899 - DNA, 274 bp, Glycine max
  Clone ID: 700683768H1
ctacaaagttctatggagaggttactcaacagatgttgaagcatgctgatttccccggcagcaacaatggaacaggtctcttccaaaccatagttggtttgaagataagagatttatatgagcagctaatagccaccaaggctgagactccagtggctgcaaaagcttaggaattgaattgaacctgccataataatatatatacatatcgaccgagcgacgcagtcaaattgcattagttctcatcaaaatcatcattttctttcttctttca

SEQ ID NO: 4900 - DNA, 248 bp, Glycine max
  Clone ID: 700741625H1
agcatgctgattttcccggcagcaacaatggaacaggtctcttccaaaccatagttggtttgaagataagagatctatatgagcagctaatagccagcaaggctgagactccagtagctgcaaaagcttaggaattgaacctgccataatatatatacatagatcgatcgagcaacgcagccaaattgagttctctcatcatcaaaatcatcatttctttcttctttcatgttttccacaattccact

SEQ ID NO: 4901 - DNA, 256 bp, Glycine max
  Clone ID: 700737803H1
tgctgatttccccggcagcaacaatggaacaggtctcttccaaaccatagttggtttgaagataagagatttatatgagcagctaatagccaccaaggctgagactccagtggctgcaaaagcttaggaattgaattgaacctgccataataatatatatacatatcgaccgagcgacgcagtcaaattgcattagttctcatcaaaatcatcattttctttcttctttcatgttttccacaatttcactgtgttt

SEQ ID NO: 4902 - DNA, 229 bp, Glycine max
  unsure (1)...(229): unsure at all n locations
  Clone ID: 700995703H1
ccaaaccatagttggtttgaagataagagatttatatgagcagctaatagccaccaaggctgagactccagtggctgcaaaagcttaggaattgaattgaacctgccataataatatatatacatatcgaccgagcgacggcgtcnaaattgcattagttctcatcaaaatcatcattttctttctctttcatgttttccacatttcangtgtttcagttattngnccc

SEQ ID NO: 4903 - DNA, 431 bp, Glycine max
  unsure (1)...(431): unsure at all n locations
  Clone ID: LIB3055-013-Q1-N1-F6
ccgtgtcagagatctcttggactttagcatctacctagacattagcaatgaggtcaaattcgcttggaaaattcagagagacatggcagagcgtggacacagtcttgaaagcatcaaggctagcattgaagcaaggaagcctgattttgaagcatatattgatccacaaaagcaatacgcagatgcagtgatagaagtgttgccaacgcaactcattccagatgacaacgagggtaagattttgagagtgagattgatacagaaagagggggttaagtactttagcccggtttacttgtttgatgatggctctaccatttcatggataccatgtggaagaaagcttacatgctcctaccctggcatcaaattcttctatggacctgagacttactacgngaaatgaggtgtcagttgtagaaatggatgga

SEQ ID NO: 4904 - DNA, 339 bp, Glycine max
  Clone ID: LIB3028-012-Q1-B1-F10
cggctcgattgtcatatgcttggatgattaccaccctttggataaaactggcagaaaggagaagggtgtcactgcccttgatcctagagccaatgattttgatctcatgtatgaacaagttaaagctcttaaggatggaattgctgttgaaaaaccaatctacaaccatgtcactggtctcctggatccccctgagctcattaaaccccccaaaatcttagtcattgaaggcttgcacccaatgtatgattctcgggtcagagatctcttggactttagcatctacctagacattatcactgaggtcaaattcgctttggaaattcagagagacatggc

SEQ ID NO: 4905 - DNA, 408 bp, Glycine max
  Clone ID: LIB3039-054-Q1-E1-C11
aacggctgcgagaagacgacagaaggggcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaggtgactcacagacagtggtgattggcctggctgcagactcagggtgtgggaagagcaccttcatgaggaggctgaccagtgtgtttggaggagcagcagagccaccaaagggtggcaaccctgactccaacactctcatcagtgacaccaccactgtcatatgcttggatgattaccactctttggacagaactggaagaaaggagaaaggtgtcactg

SEQ ID NO: 4906 - DNA, 400 bp, Glycine max
  Clone ID: LIB3055-013-Q1-N1-D11
gagagaaagaaattaagaaaaaatggcagcctgcactgtctactcaacacaatctctgagcacaaattgctccatctcaaccccatcaaagacacagctgagtttcttccaccaaaagcaggtagttttctggaggaacagcaacaggggcaacagcagcagcagaagaagctatgtgataacatgtgcagcaggtgactcacagacagtggtgattggtcttgctgcagactcagggtgtgggaagagcaccttcatgaggaggctgacaagtgtgtttggaggagcagcagagccaccgaagggtggcaaccctgactcaaacacactcatcagtgacaccaccactgtcatatgcttggatgattaccactctttggatagaactggcagaaaggag

SEQ ID NO: 4907 - DNA, 391 bp, Glycine max
  Clone ID: LIB3055-013-Q1-N1-H7
gaaaattctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaagtgactcacagacagtggtgattggcctggctgcagactcagggtgtgggaagagcaccttcatgaggaggctgaccagtgtgtttggaggagcatcagagccaccaaagggtggcaaccctgacttcaacactctcatcagtgacaccaccactgtcatatgcttggatgattaccactc

SEQ ID NO: 4908 - DNA, 388 bp, Glycine max
  Clone ID: LIB3055-004-Q1-N1-F5
tgaaaattctctttagagagatagagagaggaagaaagaatggcagcttgcactgtctactcaacacaatctctgagcacaaattgctccatctcaaccccatcaaagacgcaactcagttttttccaccaaaagcaggtagttttctggaggaacagcaagaagggcagctgcagcagcagaagaagctatgtgataacatgtgcagcaagtgactcacagacagtggtgattggcctggctgcagactcagggtgtgggaagagcaccttcatgaggaggctgaccagtgtgtttggaagaacagcagagccaccaaagggtggcaaccctgacttcaacactctcatcagtgacaccaccactggcatatgcttggatgattacc

SEQ ID NO: 4909 - DNA, 294 bp, Zea mays
  Clone ID: 700029657H1
actcattacaagacgttttggcttttttagatacatagtttttgttatgcacttagatatacattatgtctaggtactctgtaaaagcaatgtatctaaaaagacaacatcttaaaatttgtaaatgagggagtagtatattcaagttgatgggggctgacaacaaattactgttagtttactgtactatgccctggttgtaagagttgattaactgattatcctagaaatgattcagttcagcttaatgtttttttgttaaaataatcaagatatttgtaaaacatgtttgat

SEQ ID NO: 4910 - DNA, 264 bp, Zea mays
  Clone ID: 700043027H1
cagccggcagcacgagcagcacgccgtgccgctccaaccatctcgcttccgtgcttagcttcccgccgcgccatggcgtcgaccaaggctcccggccccggcgagaagcaggactccatggggggggagtggggggaggtggggcccaggcgagtctgcgggggggacaaggtggtcgagtaggggggggggggcgtggggcgcttcctcgagatccggcaggagctccacgggccggggcttcgcgaatttgtccaggagtgc

SEQ ID NO: 4911 - DNA, 295 bp, Zea mays
  Clone ID: 700073205H1
agcaagttccgccaaatgaaccatatcgtgtcatacttggtgatgtcagggataaattgtactacacacgtgaacgttctcgtcacctattgacatctggaatttctgagattctagaggaggcaacttttactaatgttgaacagtttctggaacctcttgagctctgttatagatcattatgtgcttgtggtgacaaacctatagctgatggaagtcttcttgatttcttgcgtcaagtatcaacttttgggcttgcccttgtgaagctcgacatcaggcaggaatctgatcg

SEQ ID NO: 4912 - DNA, 304 bp, Zea mays
  Clone ID: 700073954H1
accttttgaattttagaacactctgcttgcacttcatatgcattagtgcatatgcactacaaatttaaaatctctctctatatatttttgaattttataaaactctgcttgtatccattttaatttgagaagattgtgcatgctaattaccatttaaaatctctcactctctctctctatatatatatggtttggatacacaaccaagctttagttcatcagatgttttagaagctgcatatgttaggtcatatcagcaaaaaaatgagtttgcatagcagttgttgcccataacttttactat

SEQ ID NO: 4913 - DNA, 307 bp, Zea mays
  unsure (1)...(307): unsure at all n locations
  Clone ID: 700075634H1
gcaggcggcagagaattgtctgtgccgccgggtgggaatttgattcggtcggattcgctgcgccgcgatgccgnggcggcaccagtccatcgacgcgcagtgcggctgctggcccccgggaaggtctccgaggacgacaagctcgtcgagtacgacgccctcctcgtcgaccgcttcctcgacatcctccaggacctgcacggcgcccagctgcgcgaattcgtgcaggagtgctacgagctctcggcggagtacgagaacgaccgggatgaggctcggcttggcgagctcgggagcaactcaccac

SEQ ID NO: 4914 - DNA, 293 bp, Zea mays
  Clone ID: 700076492H1
cttgcttgccagaatgatggcatcaaacttgtactgctctcagattgaggatctcatgtttgagatgtctatgtggcgatgcagtgatgaactgcgcatgctagctgatgtgctgcatctctccactaagaaggatgccaaacattacatagagttttggaagaaggttcctccaaatgagccatatcgggtgatactgagtgatgtcagggataaactgtacaacactcgtgaacggtcacgagagcttttatccagtgggcattctgatattcctgaggaagctacattga

SEQ ID NO: 4915 - DNA, 112 bp, Zea mays
  Clone ID: 700097250H1
cggaacgctgggacgctgaaagcggataagggaccccaacttcaaggtgacgccccagccgcggctgtccaaggagttcgccgacgagaacaagcccgatggactggtcaag

SEQ ID NO: 4916 - DNA, 303 bp, Zea mays
  Clone ID: 700100473H1
ctttttcttccttaattgtaagaccacatgatctataaaggtcatatttacatgtgttgtttagataaatggatatgttctacttgtaaatatgacctttatagatcatgtggtcttaccgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaa

SEQ ID NO: 4917 - DNA, 301 bp, Zea mays
  Clone ID: 700101359H1
ccttcagaaccgatgaaatcaggagggcacaacccacccgcagacgaaatgcgctatgggatgagctacatccatgagactgtatggaagggcgtgcctaagttcttgcgccgtgtggatacagcctgaagaatatcggcatcaatgagcgccttccctacaatgtttctctcattcggttctcttcttggatgggtggtgaccgcgatggaaatccaagagttaccccggaggtgacaagagatgtatgcttgctggccagaatgatggctgcaaacttgtacatcgatcagattgaaga

SEQ ID NO: 4918 - DNA, 234 bp, Zea mays
  Clone ID: 700152625H1
aaggtgtaccaaaattcttgcgccgtattgacaccgctctgaaaaatattgggatcaatgaacgtctcccttacaatgctcctctcattcagttctcttcctggatgggtggtgatcgtgatggaaatccaagagtaacaccagaggttacacgggatgtatgcttgttggcgagaatgatggctgctaacttgtacttctctcagattgaagatttaatgtttgagctgtcta

SEQ ID NO: 4919 - DNA, 217 bp, Zea mays
  Clone ID: 700154435H1
cccacgcgtccgcccacgcgtccgcagccaatctcctcctcctcctccgctctcagacgagcagcggttgccatcactctccacttcccacgcccgctgcgggctcgcaggcggcagagaattgtctgtgccgccgggtgggaatttgattcggtcggattcgctgcgccgcgatgccggagcggcaccagtccatcgacgcgcactgcggctgctg

SEQ ID NO: 4920 - DNA, 92 bp, Zea mays
  Clone ID: 700162895H1
ctcacgcgtccgtcttgagtcagcaccagcagcgttactcggctgttctccgttgaatggtacagaaacatgatcagcggcaagcatgaagt

SEQ ID NO: 4921 - DNA, 127 bp, Zea mays
  Clone ID: 700201740H1
atgctcgagatcaggaacatccatatactgaaagatatgtacaatgagtggacattcttcagggtcaccttgatctgctcgagatggtttcgccaagggagaccgggaaccggctgtgtagacaatt

SEQ ID NO: 4922 - DNA, 264 bp, Zea mays
  Clone ID: 700224677H1
cggactcgtgggtgttcccagccaccatacacgatccacggatcactcatggtcactgtgcaatgtgaagtcaacttacagtcatttggtgaggagcacttgtgctttaggacactgcaacgtttcacggctgctaccctgtgagcatggcatgcacccaccaaatgcaccaaagccataatggcgagcccttcttgacgagatggcagttgtggcaactgaggaatatcggtccattgtcttcaaagagccacgctttgtcgt

SEQ ID NO: 4923 - DNA, 255 bp, Zea mays
  Clone ID: 700238706H1
ggggactctatcgtgattgctaagtctttctcgcacatgcttaacttggccaacttggctgaggaagtccagatagcctacaggaggagaatcaagctcaagaagggagactttgctgatgagaactcggcaatcacagaatctgacattgaggaaacacttaagaggcttgttgttgacctgaagaagtcacctgctgaggtatttgatgccctcaagagccagactgttgatctggttttgactgcacatcca

SEQ ID NO: 4924 - DNA, 167 bp, Zea mays
  Clone ID: 700257537H1
agcccaatcagccaatctcctcctcctcctccgctctcagacgagcagcggttgccatcacttttcacttcccacgcccgcagcgggctcgcaggcggcagagaattgtctgtaacgccgggtgggaatttgattcggtcggattcgctgcgccgcgatgacggagc

SEQ ID NO: 4925 - DNA, 301 bp, Zea mays
  Clone ID: 700331923H1
agtgtccacctttggactctcccttgtgaggcttgacattaggcaagagtcagataggcatactgatgtccttgatgccatcactacatacctggggataggatcttaccgtgaatggactgaagaacgccgccaagaatggtttctgtctgaagttaatggcaagcgccctctgtttggctcagaccttcccaagactgaggaaattgctgatgttctagacacattccatgttattgctgagcttccctctgacaattttggtgcatatatcatttccatggcgacactccgtcggacg

SEQ ID NO: 4926 - DNA, 247 bp, Zea mays
  Clone ID: 700356223H1
tcgaggagacgctcaagcgcctcgtctcgcagctcggcaagtcgcgggaggaggtcttcgacgcgctcaagagccagaccgtcgacctcgtcttcaccttccaccctacacagtccgtgaggaggtctcttctccagaagcacggcaggatccgtaactgcctgcgagactctatgccaaggacatcactgctgacgacaagcaggagcttgatgaggcacttcagagggagattcaagctgctttt

SEQ ID NO: 4927 - DNA, 98 bp, Zea mays
  Clone ID: 700356594H1
aacgacacatcttggaattggctcctatgctgaatagtctgaggagaaacgccaggattggctgttgtctgaactgaggggcaaacgtccattgtttg

SEQ ID NO: 4928 - DNA, 217 bp, Zea mays
  unsure (1)...(217): unsure at all n locations
  Clone ID: 700428887H1
gtgangcnggggctnatgctgcgcaagccctacatcaccaaccctnaacgtgttccaggcctaacncgctgaaancggatnagggacnncaacttcaaggtgacnccccagccgccgctgtccaaggagttngccgacgananacaagcccnccgaaactngtcaagnnnnagccngcganacgaatagncgnncagacctcagaagacacgtnatc

SEQ ID NO: 4929 - DNA, 167 bp, Zea mays
  Clone ID: 700429388H1
ctttatgtcagagcctttctcacgtgtgcttgatgtagatgccatggggagtttttactggctgttgaagcctgatgcaaaataaactatggaactaaggcattgtttgtttctctccatactccatgattatataatccagcttatagattatataagcacctaat

SEQ ID NO: 4930 - DNA, 174 bp, Zea mays
  unsure (1)...(174): unsure at all n locations
  Clone ID: 700441559H1
tgccggacaccgtcaacgggtccatccgtgtgacggtgcagggcgatgtcagcgagttctgtctgcgagangagcactgtgcttccagtgntcgcagcgcttcacggccgccacgctggagcacggcatgcacccgccggtctctcccaagcccgagtggcgcaagtcatggac

SEQ ID NO: 4931 - DNA, 282 bp, Zea mays
  Clone ID: 700552009H1
agctgtggagctcttgcagcgtgaatgccatgtgaaaaaaccactgagagtcgttcctttgttcgaaaaactggcagatcttgagtcagcaccagcagcgttactcggctgttctccgttgaatggtacagaaacaggatcagcggcaagcaggaagtgatgatcgggtattcagattctggcaaggatgccggtcgtttctctgctgcttggcaactgtacaaggctcaagaggagctcattaatgtcgctaagctgtatggggttaagctaaccatgttc

SEQ ID NO: 4932 - DNA, 285 bp, Zea mays
  Clone ID: 700578607H1
gttctgtccatgatcaagatctatagctggaggaagtgggaaaccttagcaggtccaattgctgctgaggaattgaaagctaggagaaccaaggtgatgagaaggcagtcaacctttgtttttaacaatgcttctcatccatggagcaaaaataaaatcttatttggatgctttgctttttgcgccaattcaagggctccataataaggtcagactatgtggcactgaggttgggctttgtcacatatcacaagctaccacattcatatgactaccataaataca

SEQ ID NO: 4933 - DNA, 157 bp, Zea mays
  Clone ID: 701169553H1
cacaaaagtaattaaacgaaagagaataaaattgaaaaacaaaaataaaaaagaacaaaaaaagggaaacaaaaaaaacaaaacataacgcaatcaaaaaataaaaataaacaaaaaaacaactaaaaagaaccaaaagcacacatcacaacaaaat

SEQ ID NO: 4934 - DNA, 293 bp, Zea mays
  Clone ID: 700074427H1
attgtcttccaagaaccacgcttcgttgaatacttcagatcggctacacctgagactgaatatggtaggatgaatattggcagccgtccatcaaagaggaagcctagtgggggaatagaatcactccgtgcaattccatggatctttgcttggacacaaacaaggttccatctgcctgtctggcttggatttggtgcagcgataaagcacatcatgcagaaggacatcaggaacatccatatactgagagacatgtacaatgagtggccattcttcagggtcacccttgattt

SEQ ID NO: 4935 - DNA, 218 bp, Zea mays
  Clone ID: 700154441H1
cttccaagaaccacgcttcgttgaatacttcagatcggctacacctgagactgaatatggtaggatgaatattggcagccgtccatcaaagaggaagcctagtgggggaatagaatcactccgtgcaattccatggatctttgcttggacacaaacaaggttccatctgcctgtctggcttggatttggtgcagcgataaagcacatcatgcagaagg

SEQ ID NO: 4936 - DNA, 324 bp, Zea mays
  Clone ID: 700097963H1
accggatcaagggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccg

SEQ ID NO: 4937 - DNA, 326 bp, Zea mays
  Clone ID: 700097754H1
tctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatc

SEQ ID NO: 4938 - DNA, 321 bp, Zea mays
  Clone ID: 700097792H1
gagaggctggccgacctgcagtcggcgcccgcgtccgtggagcgcctcttctcggtggactggtacatggaccggatcaagggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtg

SEQ ID NO: 4939 - DNA, 334 bp, Zea mays
  Clone ID: 700098551H1
gcttcctcaacatccttcaggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggactcccgcccgacagcttcggcccctacatcatctccatggcgacggccccctcggac

SEQ ID NO: 4940 - DNA, 318 bp, Zea mays
  Clone ID: 700098302H1
caagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccat

SEQ ID NO: 4941 - DNA, 320 bp, Zea mays
  Clone ID: 700098121H1
ccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggactcagaccaggttccaccttcccgtgtggctgggagtcggcgccgcctttaagttcgccatcgacaaggacgtcaggaacttccaggtcctcaaagagatgtacaacgagtggccattcttcagggtcaccctggacctgctggag

SEQ ID NO: 4942 - DNA, 315 bp, Zea mays
  Clone ID: 700101619H1
ccggatcaagggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgctt

SEQ ID NO: 4943 - DNA, 317 bp, Zea mays
  Clone ID: 700098581H1
gctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggc

SEQ ID NO: 4944 - DNA, 314 bp, Zea mays
  Clone ID: 700099632H1
gcggcgtgcgccagccgctgcccgtggtgccgctgttcgagaggctggccgacctgcagtcggcgcccgcgtccgtggagcgcctcttctcggtggactggtacatggaccggatcaagggcaagcagcaggtcatggtcggctactccgactccggcaaggacgccggccgcctgtacgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctg

SEQ ID NO: 4945 - DNA, 310 bp, Zea mays
  Clone ID: 700101969H1
cctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcacccgccggtctctcccaagcccgagtggcgcaagtcatggacgagatggcggtcgtggccacggaggagtaccgctccgtcgtcgtcaaggagccgcgcttcgtcgagtacttcagatcggctacaccggagaccgagtacgggaggatgaacatcggcagccggc

SEQ ID NO: 4946 - DNA, 316 bp, Zea mays
  Clone ID: 700083104H1
cttccaggtcctcaaagagatgtacaacgagtggccattcttcagggtcaccctggacctgctggagatggttttcgccaagggagaccccggcattgcggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataaggg

SEQ ID NO: 4947 - DNA, 311 bp, Zea mays
  Clone ID: 700100275H1
ggctggccgacctgcagtcggcgcccgcgtccgtggagcgcctcttctcggtggactggtacatggaccggatcaagggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtg

SEQ ID NO: 4948 - DNA, 304 bp, Zea mays
  Clone ID: 700098816H1
gacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcggggtctccctggtgaagctggacatccggcaggagtcggagcggcacaccgacgtgatcgacgccatcaccacgcacctcggcatcgggtcgtaccgcgagt

SEQ ID NO: 4949 - DNA, 306 bp, Zea mays
  Clone ID: 700101994H1
atccgtgtgacggtgcagggcgaggtcatcgagttctgcttcggggaggagcacctgtgcttccagactctgcagcgcttcacggccgccacgctggagcacggcatgcacccgccggtctctcccaagcccgagtggcgcaagctcatggacgagatggcggtcgtggccacggaggagtaccgctcggtcgtcgtcaaggagccgcgcttcgtcgagtacttcagatcggctacaccggagaccgagtacgggaggatgaacatcggcagccggccagccaagaggaggcccggcggcggcatc

SEQ ID NO: 4950 - DNA, 303 bp, Zea mays
  Clone ID: 700101641H1
caagcccgccggactggtcaagctgaacccggcgagcgagtacccgcccggcctggaagacacgctcatcctcaccatgaagggcatcgccgcaggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacat

SEQ ID NO: 4951 - DNA, 297 bp, Zea mays
  Clone ID: 700101001H1
tctggttccaaagttaccaagtattacatagaattctggaagcaaattcctccaaacgagccctaccgggtgatactaggccatgtaagggacaagctgtacaacacacgcgagcgtgctgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctct

SEQ ID NO: 4952 - DNA, 312 bp, Zea mays
  Clone ID: 700099730H1
cccacgcgtccgatggaccggatcaagggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgc

SEQ ID NO: 4953 - DNA, 303 bp, Zea mays
  Clone ID: 700097140H1
cccggcagtgacaagagatgtatgcttgctggccagaatgatggctgcaaacttgtacatcgatcagattgaagagctgatgtttgagctctctatgtggcgctgcaacgatgagcttcgtgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcttctggagtttctgaaatttc

SEQ ID NO: 4954 - DNA, 309 bp, Zea mays
  Clone ID: 700100324H1
cctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggactcccgcccgacagcttcggcccctacatcatctccatggcgacggccccctcggac

SEQ ID NO: 4955 - DNA, 301 bp, Zea mays
  Clone ID: 700098727H1
tgtgcttccagactctgcagcgcttcacggccgccacgctggagcacggcatgcacccgccggtctctcccaagcccgagtggcgcaagctcatggacgagatggcggtcgtggccacggaggagtaccgctcggtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggactcagaccaggtt

SEQ ID NO: 4956 - DNA, 301 bp, Zea mays
  Clone ID: 700097485H1
gtcggcgccgcctttaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgc

SEQ ID NO: 4957 - DNA, 324 bp, Zea mays
  Clone ID: 700097789H1
cccacgcgtccgcccacgcgtccgcggcaggagtcggagcggcacaccgacgtgatcgacgccatcaccacgcacctcggcatcgggtcgtaccgcgagtcgcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtg

SEQ ID NO: 4958 - DNA, 298 bp, Zea mays
  Clone ID: 700099540H1
cgaaatgcgctatgggatgagctacatccatgagactgtatggaagggcgtgcctaagttcttgcgccgtgtggatacagccctgaagaatatcggcatcaatgagcgccttccctacaatgtttctctcattcggttctcttcttggatgggtggtgaccgcgatggaaatccaagagttaccccggaggtgacaagagatgtatgcttgctggccagaatgatggctgcaaacttgtacatcgatcagattgaagagctgatgtttgagctctctatgtggcgctgcaacgatgag

SEQ ID NO: 4959 - DNA, 315 bp, Zea mays
  Clone ID: 700097905H1
ccaagcccgagtggcgcaactcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggactcagaccaggttccaccttcccgtgtggctgggagtcggcgccgcctttaagttcgccatcgacaaggacgtcaggaacttccaggtcctcaaaga

SEQ ID NO: 4960 - DNA, 307 bp, Zea mays
  Clone ID: 700099338H1
ctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggactcccgcccgacagcttcggcccctacatcatctccatggcgacggccccctcgga

SEQ ID NO: 4961 - DNA, 315 bp, Zea mays
  Clone ID: 700101618H1
cccacgcgtccgattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcatgagtcggagcggcacaccgacgtg

SEQ ID NO: 4962 - DNA, 290 bp, Zea mays
  Clone ID: 700100382H1
caaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcgga

SEQ ID NO: 4963 - DNA, 296 bp, Zea mays
  Clone ID: 700097861H1
aggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcatccgccggtctctcccaagcccgagtggcgcaacctcatggacgagatg

SEQ ID NO: 4964 - DNA, 291 bp, Zea mays
  Clone ID: 700099369H1
ttcaagttcgccatcgacaaggacgtcaggaacttccaggtcctcaaagagatgtacaacgagtggccattcttcagggtcaccctggacctgctggagatggttttcgccaagggagaccccggcattgccgggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcg

SEQ ID NO: 4965 - DNA, 307 bp, Zea mays
  Clone ID: 700097270H1
ggcgcgttccacgtcctcgcggactcccgcccgacagcttcggcccctacatcatctccatggcgacggccccctcggacgtgctcgccgtagagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaggtcatggtcggctactccgactccggcaaggacgccggccgcctgtccgcggcgtggcagctgta

SEQ ID NO: 4966 - DNA, 288 bp, Zea mays
  Clone ID: 700042158H1
cggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcg

SEQ ID NO: 4967 - DNA, 293 bp, Zea mays
  Clone ID: 700097169H1
aaccgcctttaagttcgccatcgacaaggacgtcaggaacttccaggtcctcaaagagatgtacaacgagtggccattcttcagggtcaccctggacctgctggagatggttttcgccaagggagaccccggcaatgccggctatgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtg

SEQ ID NO: 4968 - DNA, 302 bp, Zea mays
  Clone ID: 700099238H1
cccacgcgtccgcgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagg

SEQ ID NO: 4969 - DNA, 294 bp, Zea mays
  Clone ID: 700045908H1
gtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcagcacgcacctcggcatcgggtcgtaccgcgagtggtccgaggacaagatgcaggagtgggctgctgtcggagctgcgaggcaagcgtccgctgctgc

SEQ ID NO: 4970 - DNA, 295 bp, Zea mays
  Clone ID: 700101654H1
tgaagagctgatgtttgagctctctatgtggcgctgcaacgatgagcttcgcgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaa

SEQ ID NO: 4971 - DNA, 283 bp, Zea mays
  Clone ID: 700041622H1
cgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagct

SEQ ID NO: 4972 - DNA, 294 bp, Zea mays
  Clone ID: 700099014H1
ggacgcgtgggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataaggg

SEQ ID NO: 4973 - DNA, 281 bp, Zea mays
  Clone ID: 700045755H1
gaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgag

SEQ ID NO: 4974 - DNA, 249 bp, Zea mays
  Clone ID: 700097929H1
tggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgccgcgacaaggccatcgcggacgggagcctcctggacctcctgcgccaggtgttc

SEQ ID NO: 4975 - DNA, 306 bp, Zea mays
  Clone ID: 700101507H1
cacctgtgcttccagactctgcagcgcttcacggccgccacgctggagcacggcatgcacccgccggtctctcccaagcccgagtggcgcaagtcatggacgagatggcggtcgtggccacggaggagtaccgctcggtcgtcgtcaaggagccgcgcttcgtcgagtacttcagatcggctacaccggagaccgagtacgggaggatgaacatcggcagccggccagccaagaggaggcccggcggcggcatcacgaccctgcgcgcaatcccctggatcttctcgtggactcagaccaggttcc

SEQ ID NO: 4976 - DNA, 294 bp, Zea mays
  Clone ID: 700101139H1
catcaatgagcgccttccctacaatgtttctctcattcggttctcttcttggatgggtggtgaccgcgatggaaatccaagagttaccccggaggtgacaagagatgtatgcttgctggccagaatgatggctgcaaacttgtacatcgatcagattgaagagctgatgtttgagctctctatgtggcgctgcaacgatgagcttcgcgttcgtgccgaagagctccacagttcgtctggttccaaagttaccaagtattacatagaattctggaagcaaattcctccaaacga

SEQ ID NO: 4977 - DNA, 278 bp, Zea mays
  Clone ID: 700042011H1
gtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggca

SEQ ID NO: 4978 - DNA, 304 bp, Zea mays
  Clone ID: 700099449H1
cggacgcgtgggcggacgcgtgggcggccagccaagacgaggcccggcggcggcatcacgaccctgcgcgccatcccctggatcttctcgtggactcagaccaggctccaccttcccctgtggctgggagtcggcgccgccttcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaag

SEQ ID NO: 4979 - DNA, 304 bp, Zea mays
  Clone ID: 700097495H1
cggacgcgtggctggtacatggaccggatcaagggcaagcagcaggtcatggtcggctactccgactccggcaaggacgccggccgcctgtccgcagcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcgggg

SEQ ID NO: 4980 - DNA, 290 bp, Zea mays
  Clone ID: 700404862H1
ttcttcagggtcacctggacctgctggagatggttttcgccaagggagaccccggcattgcggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccagcctacacgctgaagcggataagggaccccaacttcaa

SEQ ID NO: 4981 - DNA, 277 bp, Zea mays
  Clone ID: 700041640H1
gcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcct

SEQ ID NO: 4982 - DNA, 277 bp, Zea mays
  Clone ID: 700042815H1
gaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtc

SEQ ID NO: 4983 - DNA, 314 bp, Zea mays
  Clone ID: 700099760H1
ctatgagcttcgcgttcgtgccgaagagccccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctcctggacctcctgc

SEQ ID NO: 4984 - DNA, 299 bp, Zea mays
  Clone ID: 700098974H1
ccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggactcccgcccgacagcttcggcccctacatcatctccatggcgacggccccctcggacgtgctcgccgtggagctcctgcagcgcgagtgcggcgtgcgccaccgctgcccgtggtgcc

SEQ ID NO: 4985 - DNA, 285 bp, Zea mays
  Clone ID: 700046051H1
cgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccggcacgctggagcacggcatgcatccgccggtctctcccaagcccgagtggcgcaagctcatggacgaga

SEQ ID NO: 4986 - DNA, 301 bp, Zea mays
  Clone ID: 700098022H1
cccacgcgtccgcccacgcgtccggtttgagctctctatgtggcgctgcaacgatgagcttcgcgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgc

SEQ ID NO: 4987 - DNA, 275 bp, Zea mays
  Clone ID: 700044753H1
ctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacc

SEQ ID NO: 4988 - DNA, 274 bp, Zea mays
  Clone ID: 700044255H1
ccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgct

SEQ ID NO: 4989 - DNA, 274 bp, Zea mays
  Clone ID: 700043411H1
agggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataaacatcgtacaatctgcatgctgttttgtaataattaat

SEQ ID NO: 4990 - DNA, 275 bp, Zea mays
  Clone ID: 700046087H1
cgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcga

SEQ ID NO: 4991 - DNA, 277 bp, Zea mays
  Clone ID: 700041663H1
aaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcc

SEQ ID NO: 4992 - DNA, 296 bp, Zea mays
  Clone ID: 700099451H1
cgaagagttccttgagccacttgagctgtgctacaaatcactgtgtgactgccgcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtgcgtcgaggacaagaggcaggagtggctgctgtcggagctgcgaggcaagcgtccggtgctgcccccggaccttccccaga

SEQ ID NO: 4993 - DNA, 270 bp, Zea mays
  Clone ID: 700043646H1
gggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcgg

SEQ ID NO: 4994 - DNA, 270 bp, Zea mays
  Clone ID: 700045303H1
gctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggag

SEQ ID NO: 4995 - DNA, 274 bp, Zea mays
  Clone ID: 700223981H1
cactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcctgctgctgcccccggaccttccccagaccgacgagatcgccga

SEQ ID NO: 4996 - DNA, 281 bp, Zea mays
  Clone ID: 700043601H1
gcgcgccatcccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtgg

SEQ ID NO: 4997 - DNA, 268 bp, Zea mays
  Clone ID: 700043020H1
gaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtca

SEQ ID NO: 4998 - DNA, 267 bp, Zea mays
  Clone ID: 700046435H1
gaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtc

SEQ ID NO: 4999 - DNA, 270 bp, Zea mays
  Clone ID: 700100821H1
ggtgagaccccggcaattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccg

SEQ ID NO: 5000 - DNA, 278 bp, Zea mays
  Clone ID: 700044311H1
gcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcacccgccggtctctcccaagcccgagtggcgcaactcatggacgagatggcggt

SEQ ID NO: 5001 - DNA, 265 bp, Zea mays
  Clone ID: 700042492H1
cacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgct

SEQ ID NO: 5002 - DNA, 267 bp, Zea mays
  Clone ID: 700045679H1
gtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcgga

SEQ ID NO: 5003 - DNA, 267 bp, Zea mays
  Clone ID: 700043854H1
gcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggacgccacgctggagcacggcatgcacccgccggtctctcc

SEQ ID NO: 5004 - DNA, 294 bp, Zea mays
  Clone ID: 700097174H1
cttccccagaccgacgagatcgccgacgtcatcggcgcgttccacgtcctcgcggactcccgcccgacagcttcggcccctacatcatctccatggcgacggccccctcggacgtgctcgccgtggagctcctgcagcgcgagtgcggcgtgcgccagccgctgcccgtagtgccgctgttcgagaggctggccgacctgcagtcggcgcccgcatccgtggagcgcctcttctcggtggactggtacatggaccggatcaagggcaagcagcaggtcatggtcggctactccg

SEQ ID NO: 5005 - DNA, 273 bp, Zea mays
  Clone ID: 700043617H1
gttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggactcccgcccgacagcttcggcccctacatcatctccatg

SEQ ID NO: 5006 - DNA, 265 bp, Zea mays
  Clone ID: 700043213H1
gccctgaagaatatcggcatcaatgagcgccttccctacaatgtttctctcattcggttctcttcttggatgggtggtgaccgcgatggaaatccaagagttaccccggaggtgacaagagatgtatgcttgctggccagaatgatggctgcaaacttgtacatcgatcagattgaagagctgatgtttgagctctctatgtggcgctgcaacgatgagcttcgcgttcgtgccgaagagctccacagttcgtctggttccaaag

SEQ ID NO: 5007 - DNA, 263 bp, Zea mays
  Clone ID: 700044283H1
gagatggcggtcgtggccacggaggagtaccgctccgtcgtcgtcaaggaggcgcgcttcgtcgagtacttcagatcggctacaccggagaccgagtacgggaggatgaacatcggcagccggccagccaagaggaggcccggcggcggcatcacgaccctgcgcgccatcccctggatcttctcgtggacccagaccaggttccacctccccgtgtggctgggagtcggcgccgcattcaagttcgccatcgacaaggacgt

SEQ ID NO: 5008 - DNA, 271 bp, Zea mays
  Clone ID: 700044758H1
ggcgcaactcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggacccagaccaggttccacctccccgtgtggctgggagtcggcgccgcattcaagttcgccatcgac

SEQ ID NO: 5009 - DNA, 265 bp, Zea mays
  Clone ID: 700045971H1
ggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactg

SEQ ID NO: 5010 - DNA, 280 bp, Zea mays
  Clone ID: 700045753H1
ccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaa

SEQ ID NO: 5011 - DNA, 260 bp, Zea mays
  Clone ID: 700044982H1
aagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccgga

SEQ ID NO: 5012 - DNA, 260 bp, Zea mays
  Clone ID: 700045990H1
ctcagggacaaatacgtggagacacagcagcttctcctccaggtcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcga

SEQ ID NO: 5013 - DNA, 266 bp, Zea mays
  Clone ID: 700222578H1
cgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgtcgtgatcgacgccatcaccacgcacctcggcatcgggtcgtaccgcgattggtccgaggacaagaggcaggagtggctgctgtcg

SEQ ID NO: 5014 - DNA, 272 bp, Zea mays
  Clone ID: 700101090H1
gctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcatccgccgtctcttccaagcccgagtggcgcaactcatggacgagatggc

SEQ ID NO: 5015 - DNA, 259 bp, Zea mays
  Clone ID: 700044587H1
ccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagct

SEQ ID NO: 5016 - DNA, 252 bp, Zea mays
  Clone ID: 700100745H1
gctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcacccgccggtctctcccaagcccgagtggc

SEQ ID NO: 5017 - DNA, 269 bp, Zea mays
  Clone ID: 700043547H1
gtcatttaccagtatcgaagagttccttgatccacttgagctgtgctacaaatcactgtgtgactgctgcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtacctctagtggcccgaggacaagaggcaggagtggctgctgtcggagc

SEQ ID NO: 5018 - DNA, 299 bp, Zea mays
  Clone ID: 700428356H1
cctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatca

SEQ ID NO: 5019 - DNA, 267 bp, Zea mays
  Clone ID: 700219747H1
cccacgcgtccgctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctgg

SEQ ID NO: 5020 - DNA, 254 bp, Zea mays
  Clone ID: 700045081H1
gccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataaacatcgtacaatctgcatgctgttttgta

SEQ ID NO: 5021 - DNA, 286 bp, Zea mays
  Clone ID: 700101816H1
cccacgcgtccgcccacgcgtccgcccacgcgtccgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgt

SEQ ID NO: 5022 - DNA, 266 bp, Zea mays
  Clone ID: 700042889H1
cgggtccatccgtgtgacggtgcagggcgaggtcatcgagttctgcttcggggaggagcacctgtgcttccagactctgcagcgcttcacggccgccacgctggagcacggcatgcacccgccggtctctcccgagcccgagtggcgcgactcatggacgagatggcggtcgtggccacggaggagtaccgctccgtcgtcgtcaaggaggcgcgcttcgtcgagtacttcagatcggctacaccggagaccgagtacgggaggat

SEQ ID NO: 5023 - DNA, 265 bp, Zea mays
  Clone ID: 700041694H1
ggagcacctgtgcttccagactctgcagcgcttcacggccgccacgctggagcacggcatgcacccgccggtctctcccaagcccgagtggcgcaactcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccc

SEQ ID NO: 5024 - DNA, 306 bp, Zea mays
  Clone ID: 700098977H1
cggacgcgtggcgtgacgcgtgggcggacgcgtgggctgtgcttccagactctgcagcgcttcacggccgccacgctggagcacggcaaccacccgccgagctctcccaagcagctgagtggcgcaagctcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgcca

SEQ ID NO: 5025 - DNA, 266 bp, Zea mays
  Clone ID: 700423950H1
caagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgtt

SEQ ID NO: 5026 - DNA, 272 bp, Zea mays
  Clone ID: 700053467H1
gatcgacgccatcaccacgcacctcggcatcgggtcgtaccgcgagtggtccgaggacaagatgcaggagtggctgctgtcggagctgctaggcaagctcccgctgctgcccccggaccttccccagaccgacgagatcgccgacgtcatcggcgcgttccacgtcctcgcggactcccgcccgacagcttcggcccctacatcatctccatggcgacggccccctcggacgtgctcgccgtagagctcctgcagcgcgagttcggcgtgcg

SEQ ID NO: 5027 - DNA, 255 bp, Zea mays
  Clone ID: 700042228H1
gtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgac

SEQ ID NO: 5028 - DNA, 241 bp, Zea mays
  Clone ID: 700044924H1
ccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcag

SEQ ID NO: 5029 - DNA, 252 bp, Zea mays
  Clone ID: 700438595H1
cgaggtcatcgagttctgcttcggggaggagcacctgtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcacatcggctacaccggagaccgagtacgggaggatgaacatcggcag

SEQ ID NO: 5030 - DNA, 260 bp, Zea mays
  Clone ID: 700422253H1
gcggataagggaccccaacttcaaggtgacgccccagacgccgctgtcgaaggagttcgccgacgagaacaagcccgccggactggtcaagctgaacccggcgagcgagtacccgcccggcctggaagacacgctcatcctcaccatgaagggcatcgcgaccggcatgcagaacactggctaggcggcttctcttcactcacctgcagagtgcaccgcaataatcagcttccggatggtggcgttttgtcagttttgga

SEQ ID NO: 5031 - DNA, 234 bp, Zea mays
  Clone ID: 700044946H1
gccaagaggaggcccggcggcggcatcacgaccctgcgcgccatcccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagacccc

SEQ ID NO: 5032 - DNA, 255 bp, Zea mays
  unsure (1)...(255): unsure at all n locations
  Clone ID: 700025647H1
ccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggantnccggccgacagttcgggccctacatcatc

SEQ ID NO: 5033 - DNA, 239 bp, Zea mays
  Clone ID: 700213665H1
cagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgag

SEQ ID NO: 5034 - DNA, 265 bp, Zea mays
  Clone ID: 700100741H1
cccacgcgtccgcccacgcggccgaccggatcaagggcaagcagcaggacaagggcggccactccgactccggcaatgacgccggccgcctggccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccg

SEQ ID NO: 5035 - DNA, 236 bp, Zea mays
  Clone ID: 700045039H1
cctgtgcttccagactctgcagcgcttcacggccgccacgctggagcacggcatgcacccgccggtctctcccaagcccgagtggcgcaagtcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagatgag

SEQ ID NO: 5036 - DNA, 227 bp, Zea mays
  Clone ID: 700042588H1
cgtggacccagaccaggttccacctccccgtgtggctgggagtcgacgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccc

SEQ ID NO: 5037 - DNA, 256 bp, Zea mays
  Clone ID: 700209485H1
cggacgcgtggcggacgcgtgggaagaactcaagccctttgggaagcagctcagggacaaatacgtggagacacagcagcttcacctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggag

SEQ ID NO: 5038 - DNA, 230 bp, Zea mays
  Clone ID: 700198048H1
ccggaccttccccagaccgacgagatcgccgacgtcatcggcgcgttccacgtcctcgcggagctcccgcccgacagcttcggcccctacatcatctccatggcgacggccccctcggacgtgctcgccgtagagctcctgcagcgcgagtgcggcgtgcgccagccgctgcccgtggtgccgctgttcgagaggctggccgacctgcagtcggcgctcgcgtccgtgga

SEQ ID NO: 5039 - DNA, 270 bp, Zea mays
  Clone ID: 700424537H1
tatcggcagccggccagccaagaggaggcccggcggcggcatcacgaccctgcgcgccatcccctggatcttctcgtggacccagaccaggttccacctgccccgtgtggctgggagtcggcgccgcattcaagttcgccatcgacaaggacgtcaggaacttccaggtcctcaaaggatttatacaacgagtggccattcttcagggtcaccctggactgctggaatggttttcgccaagggagacccggcattgcggcttgtatgacg

SEQ ID NO: 5040 - DNA, 270 bp, Zea mays
  Clone ID: 700439340H1
ctcgagcgaatcggctcgagggcgcaactcatggacgagctggcggtcgtggcgacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggactcagaccaggttccaccttcccgtgtggctgggagtcggcgcc

SEQ ID NO: 5041 - DNA, 235 bp, Zea mays
  Clone ID: 700439420H1
cgccatcccctggatcttctcgtggactcagaccaggttccaccttcccgtgtggctgggagtcggcgccgcctttaagttcgccatcgacaaggacgtcaggaacttccaggtcctcaaagagatgtacaacgagtggccattctccagggtcacccgggacctgtggagatggttttcgctaagggagaccccggcattgccggcttgtatgacgatctgcttgttggcggaa

SEQ ID NO: 5042 - DNA, 200 bp, Zea mays
  Clone ID: 700098640H1
tgtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcagatcggctacaccggagaccgagtacggg

SEQ ID NO: 5043 - DNA, 273 bp, Zea mays
  Clone ID: 700427059H1
ggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcac

SEQ ID NO: 5044 - DNA, 212 bp, Zea mays
  Clone ID: 700099478H1
cgcttcacggccgccacgctggagcacggcatgcacccgccggtctctcccaagcccgagtggcgcaactcatggacgagatggcggtcgtggccacggaggagtaccgctcggtcgtcgtcaaggagccgcgcttcgtcgagtacttcagatcggctacaccggagaccgagtacgggaggatgaacatcggcagccggccagccaagagg

SEQ ID NO: 5045 - DNA, 230 bp, Zea mays
  Clone ID: 700425005H1
ggcccgaggacaagaggcaggagtggctgctgtcggatgtccagcttcaccagggagagcccgaacgtgaacacctggcgcaggaggtccaggaggctcccgtccgcgatggccttgtcgccgcagtcacacagtgatttgtagcacagctcaagtggctcaaggaactcttcgatactggtaaatgacgattccgctgaaatttcagaaactccagttctagatcgcga

SEQ ID NO: 5046 - DNA, 169 bp, Zea mays
  Clone ID: 700101925H1
ggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctcc

SEQ ID NO: 5047 - DNA, 166 bp, Zea mays
  Clone ID: 700099430H1
gcgccgcctttaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggc

SEQ ID NO: 5048 - DNA, 177 bp, Zea mays
  Clone ID: 700429358H1
cgaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaa

SEQ ID NO: 5049 - DNA, 163 bp, Zea mays
  Clone ID: 700447220H1
caagagatgtatgcttgctggccagaatgatggctgcaaacttgtacatcgatcagattgaagagctgatgtttgagctctctatgtggcgctgcaacgatgagcttcgcgttcgtgccgaagagctccacagttcgtctggttccaaagttaccaagtatta

SEQ ID NO: 5050 - DNA, 154 bp, Zea mays
  Clone ID: 700100706H1
gtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagaca

SEQ ID NO: 5051 - DNA, 216 bp, Zea mays
  Clone ID: 700209112H1
cggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctgatgaagctggacatccggcaggagtcggagcggcacaccgacgtgatcgacgccatcaccacgcacctcg

SEQ ID NO: 5052 - DNA, 153 bp, Zea mays
  Clone ID: 700098367H1
cccacgcgtccgggagacacagcagcttctcctccagatcgctgggcacaaggatattcttgaaggcgatccattcctgaagcaggggctggtgctgcgcaacccctacatcaccaccctgaacgtgttccaggcctacacgctgaagcggat

SEQ ID NO: 5053 - DNA, 140 bp, Zea mays
  Clone ID: 700045489H1
gatcgctgggcacaaggatattcttgaaggcgatgcattcctgaagcaggggctgctgctgcgcaacccctacatcaccagcctgaacgtgttccaggcctacacgctgaagcggataagggaccccaacttcaaggtga

SEQ ID NO: 5054 - DNA, 129 bp, Zea mays
  Clone ID: 700043353H1
cactcttgttgtcaagtccaagtggaaaatcttggcatattatacatattgtaataataaacatcgtacaatctgcatgctgttttgtaataattaattaatatcccagcccattggatggacttgttt

SEQ ID NO: 5055 - DNA, 123 bp, Zea mays
  Clone ID: 700097654H1
gttcgagaggctggccgacctgcagtcggcgcccgcgtccgtggagcgcctcttctcggtggactggtacatggaccggatcaagggcaagcagcaggtcatggtcggctactccgactccgg

SEQ ID NO: 5056 - DNA, 148 bp, Zea mays
  Clone ID: 700423550H1
caagcccgccggactggtcaagctgaacccggcgagcgagtacccgcccggcctggaagacacgctcatcctcaccatgagaggcatcgccgccggcatgcagaacactggctaggcggcttctcttcactcacctgcaaagtgaacc

SEQ ID NO: 5057 - DNA, 126 bp, Zea mays
  Clone ID: 700439981H1
gtcggctactccgactccggcaaggacgccggccgcctgtccgcggcgtggcagctgtacatggcgcaggaggagatagcgcaggtggccaagcgctacggcgtcaagctcaccttcttccacggc

SEQ ID NO: 5058 - DNA, 114 bp, Zea mays
  Clone ID: 700097894H1
cgatccattcctgaagcaggggctggtgctgcgcaacccctacatcaccaccctgaacgtgttccaggcctacacgctgaagcggataagggaccccaacttcaaggtgacgcc

SEQ ID NO: 5059 - DNA, 105 bp, Zea mays
  Clone ID: 700423563H1
cggagaccgagtacgggaggatgaacatcggcagccggccagccaagaggaggcccggcggcggcatcacgaccctgcgcgccatcccctggatcttctcgtgga

SEQ ID NO: 5060 - DNA, 109 bp, Zea mays
  Clone ID: 700213765H1
ccgacgcgtccgggatattcttgaaggcgatccattcctgaagcaggggctggtgctgcgcaacccctacatcaccaccctgaacgtgttccaggcctacacgctgaag

SEQ ID NO: 5061 - DNA, 102 bp, Zea mays
  Clone ID: 700043914H1
cggccccctcggacgtgctcgccgtggagctcctgcagcgcgagtacggcgagcgccactcgctgcccgtggtgccgctgttcgagaggctggccgacctgc

SEQ ID NO: 5062 - DNA, 94 bp, Zea mays
  Clone ID: 700434554H1
ccagtccaagtggaaaatcttggcatattatacatattgtaataatagacatcgtacaatctgcatgctgtgttgtaataattaattaatatcc

SEQ ID NO: 5063 - DNA, 93 bp, Zea mays
  Clone ID: 700088748H1
cgcacacgtccgaccacgcgtccgagcaaattcctccaaacgagccctaccgggtgatactaggccatgtaagggtcaagctgtacaacacac

SEQ ID NO: 5064 - DNA, 103 bp, Zea mays
  Clone ID: 700097692H1
cggaccgtgggcggacgcgtgggcggacgcgtgggcggacgcgtgggtgtggcgctgcaacgatgagcttcgtgttcgtgccgaagagctccacagttcgtct

SEQ ID NO: 5065 - DNA, 307 bp, Zea mays
  Clone ID: 700098887H1
gctcaacctcgccaacctggccgaggaggtgcagatcgcgcaccgccgccgcaacagcaaactcaagaaaggtggcttcgccgacgaaggctccgccaccaccgagtccgacatcgaggagacgctcaagcgcctcgtgtccgacgtcggcaagtcccccgaggaggtgttcgaggcgctcaagaaccagaccgtcgacctcgtcttcaccgcgcatcccacgcagtccgcccgccgctcgctcctgcagaaaaacgcgaggatccggaattgtctgacccagctgaatgccaaggacatcactgac

SEQ ID NO: 5066 - DNA, 291 bp, Zea mays
  Clone ID: 700101171H1
aaaacgcgaggatccggaattgtctgacccagctgaatgtcaaggacatcactgacgacgacaagcaggagctcgatgaggctctgcagagagagatccaagcagccttcagaactgatgaaatcaggagggcacaacccaccccacaggacgaaatgcgctatgggatgagctacatccatgagactgtatggaagggcgtgcctaagttcttgcgccgtgtggatacagccctgaagaatatcggcatcaatgagcgccttccctacaatgtttctctcattcggttct

SEQ ID NO: 5067 - DNA, 303 bp, Zea mays
  Clone ID: 700098335H1
cccacgcgtccgccatcctcgtggcgagctccatcctgcacatgctcaacctcgccaacctggccgaggaggtgcagatcgcgcaccgccgccgcaacagcaaactcaagaaaggtggcttcgccgacgaaggctccgccaccaccgagtccgacatcgaggagacgctcaagcgcctcgtgtccgaggtcggcaagtcccccgaggaggtgttcgaggcgctcaagaaccagaccgtcgacctcgtcttcaccgcgcatcccacgcagtccgcccgccgctcgctcctgcagaaaaacgcga

SEQ ID NO: 5068 - DNA, 289 bp, Zea mays
  Clone ID: 700101419H1
acctcgtcttcaccgcgcatcccacgcagtccgcccgccgctcgctcctgcagaaaaacgcgaggatccggaattgtctgacccagctgaatgccaaggacatcactgacgacgacaagcaggagctcgatgaggctctgcagagagagatccaagcagccttcagaactgatgaaatcaggagggcacaacccaccccacaggacgaaatgcgctatgggatgagctacatccatgagactgtatggaagggcgtgcctaagttcttgcgccgtgtggatacagccct

SEQ ID NO: 5069 - DNA, 308 bp, Zea mays
  Clone ID: 700098187H1
agcagcacgagcagcacgtcgtgccgctccaaccatctcgcttccgtgcttagcttcccgccgtcgccatggcgtcgaccaaggctcccggccccggcgagaagcaccactccatcgacgcgcactccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgg

SEQ ID NO: 5070 - DNA, 310 bp, Zea mays
  Clone ID: 700099874H1
cccacgcgtccgagcagcacgagcagcacgtcgtgccgctccaaccatctcgcttccgtgcttagcttcccgccgcgccatggcgtcgaccaaggctcccggccccggcgagaagcaccactccatcgacgcgcactccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgtgggcaaaggagacacga

SEQ ID NO: 5071 - DNA, 301 bp, Zea mays
  Clone ID: 700098983H1
gctcaagcgcctcgtgtccgaggtcggcaagtcccccgaggaggtgttcgaggcgctcaagaaccagaccgtcgacctcgtcttcaccgcgcatcccacgcagtccgcccgccgctcgctcctgcagaaaaacgccaggatccggaattgtctgacccagctgaatgccaaggacatcactgacgacgataagcaggagctcgatgaggctttgcagagagagatccaagcagccttcagaaccgatgaaatcaggagggcacaacccaccccgcacgacgaaatgcgctatgggatgagc

SEQ ID NO: 5072 - DNA, 270 bp, Zea mays
  Clone ID: 700045302H1
gcagcagcacgagcagcacgccgtccgctccaaccgtctcgcttccctgcttagcttgccgccgcgccatggcgtcgaccaaggcacccggccctggcgagaagcaccactccatcgacgcgcactccgtcagctggtcccaggcaaggtctccgaggacgacaagctcatcgagtacgatgcgctgctcgtcgaccgcttcctcaacatcctccaggacctccacgggcccagccttcgcgaatttgtccagcagtgctacgaggtgtc

SEQ ID NO: 5073 - DNA, 273 bp, Zea mays
  unsure (1)...(273): unsure at all n locations
  Clone ID: 700218247H1
cgcacagcacgagcagcacgccgtgccgctccaaccgtctcgcttccctgcttagcttcccgccgcgccatggcgtcgaccaaggcacccggccccggcgagaagcaccactccatcgacgcgcantccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggttcggc

SEQ ID NO: 5074 - DNA, 266 bp, Zea mays
  Clone ID: 700100826H1
gcacagcacgagcagcacgccgtccgctccaaccgtctcgcttccctgcttagcttcccgccgcgccatggcgtcgaccaaggcacccggccccggcgagaagcaccactccatcgacgcgcagtccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggt

SEQ ID NO: 5075 - DNA, 303 bp, Zea mays
  Clone ID: 700098774H1
atcgcagcagcacgagcagcacgtcgtgccgctccaaccatctcgcttccgtgcttagcttcccgccgcgccatggcgtcgaccaaggctcccggccccggcgagaagcaccactccatcgacgcgcactccgtcagctggtcccaggcaaggtctccgaggacgacaagctcatcgagtacgatgcgctgctcgtcgaccgcttcctcaacatccttcaagacctccacgggcctagccttcgcgaatttggtcaggagtgctacgaggtatcggccgactaagagggcaaaagatacacga

SEQ ID NO: 5076 - DNA, 298 bp, Zea mays
  Clone ID: 700101312H1
catcgcagcagcacgagcagcacgtcgtgccgctccaaccatctcgcttccgtgcttagcttcccgccgcgccatggcgtcgaccaaggctcccggccccggcgagaagcaccactccatcgacgcggagtccgtcagctggtcccaggcaaggtctccgaggacgacaagctcatcgagtacgatgcgctgctcgtcgaccgcttcctcaacatccttcaggacatctacgggcctagccttcgcgaatttgtccaggagtgctacgaggtatcggccgactacgagggcaaaggag

SEQ ID NO: 5077 - DNA, 271 bp, Zea mays
  Clone ID: 700053403H1
gccgctcgctcctgcagaaaaacgcgaggatccggaattgtgcgacccagctgaatgccaaggacatcactgacgacgacaagcaggagctcgatgaggctctgcagagagagatccaagcaggcttcagaactgatgaaatcaggagggcacaacccaccccacaggacgaaatgcgctatgggatgagctacatccatgagactgtatggaagggcgtgcctaagttcttgcgccgtgtggatacagccctgaagaatatcggcatcaa

SEQ ID NO: 5078 - DNA, 241 bp, Zea mays
  Clone ID: 700045034H1
cacgggcccagccttcgcgaatttgtccaggagtgctacgaggtctcagccgactacgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgccgccgcaacagcaatctcaagaaaggtgggttcgccg

SEQ ID NO: 5079 - DNA, 299 bp, Zea mays
  Clone ID: 700097293H1
cgcctccctaaggccgggacctgcgacgtggcgagcagcacgccgtgccgctccaaccgtctcgcttccctgcttagcttcccgccgcgccatggcgtcgacctaggaccccggctccaccgaggagcaccactccatcgacgcgcactccgtcagctggtcccaggcaaggtctccgatgacgacaagctcatcgagtacgatgcgctgctcgtcgaccgcttcctcaacatcctccaggacctccacggggcgagccttcgggaatttgtccaggagtgctacgaggtctcggccga

SEQ ID NO: 5080 - DNA, 264 bp, Zea mays
  Clone ID: 700578474H1
ggagcaggcagggcatcagttatgccgacgctgacggcgacggctacatcgacgacagcgaggtcgatggcctcatcgagctccatcctgcacatgctcaacctcgccaacctggccgaggaggtgcagatcgcgcaccgccgccgcaacagcaaactcaagaaaggtggcttcgccgacgaaggctccgccaccaccgagtccgacatcgaggagacgctcaagcgcctcgtgtccgaggtcggcaagtcccccgacgaggtg

SEQ ID NO: 5081 - DNA, 269 bp, Zea mays
  Clone ID: 700578374H1
ggagcaggcagggcatcagttagcgccgacgctgacggcgacggctacatcgacgacagcgaggtcgatggcctcatcgagctccatcctgcacatgctcaacctcgccaacctggccgaagaggtgcagatcgcgcaccgccgccgctacagcaaactcaagaaaggtggcttcgccgacgaaggctccgccaccaccgagtccgacatcgaggagacgctcaagcgcctcgtgtccgaggtcggcaagtcccccgaggaggtgttcg

SEQ ID NO: 5082 - DNA, 280 bp, Zea mays
  Clone ID: 700549932H1
cgtttttcagggtgacgatagacctggtcgagatggtgttcgccaagggtgatcctggcatcgcggcgctgtacgacaagcttctggtttcagaggatctgtgggcattaggggcgcgtctcagagccaactacgaagaaacaaagcagcttctcctgcaggtcgctgggcacaaggaccttctggagggcgacccgtacctgaagcagaggctgcgcatccgtgactcgtacaccacggcgctgaacgtttgccaggcctacacgctgaagcgcatcag

SEQ ID NO: 5083 - DNA, 230 bp, Zea mays
  Clone ID: 700020030H1
gcacgagtagacctggtcgagatggtgttcgccaagggtgatcctggcatcgcggcgctgtacgacaagcttctggtctcagaggatctgtgggcattaggggcgcgtctcagagccaactacgaagaaacaaagcagcttctcctgcaggtcgctgggcacaaggaccttctggagggcgacccgtacctgaagcagaggctgcgcatccgtgactcgtacaccacggc

SEQ ID NO: 5084 - DNA, 310 bp, Zea mays
  Clone ID: 700264360H1
cctggctcctctccttcctgcttggtttttgctttcagctcttgaaccgaatccactgccgcggcgcttagcattggggactagggggccgacatggctgccttaggggcgaagatggagcgtctgtcgtcgatcgacgcgcactgcggatgctggtgccggggaaggtttcggaggacgataagctcatcgagtacgacgctctcctcctcgatcggttcctcgacatccttcaggacctccatggcgacgacctcaaggaaatggttcaagaatgctatgaggtagctgctgagtatgaaacaaaaca

SEQ ID NO: 5085 - DNA, 284 bp, Zea mays
  Clone ID: 700238856H1
cttcctgcttggtttttgctttcagctcttgaaccgaatccactgccgcggcgcttagcattggggactagggggccgacatggctgccttaggggcgaagatggagcgtctgtcgtcgatcgacgcgcacgtgcggatgctggtgccggggaaggtttcggaggacgataagctcatcgagtacgacgctctcctcctcgatcggttcctcgacatccttcaggacctccatggcgacgacctcaaggagatggttcaagaatgctatgaggtagctgctgag

SEQ ID NO: 5086 - DNA, 426 bp, Zea mays
  Clone ID: 700074903H1
ggacgtccttgaaggtgatccttatctgaagcagcgtctgcggctgcgtgagtcctacatcaccactctgaacgtgtgccaggcctacaccctgaagcggatacgcatcccgagcttccaggtgagcccgcagccgcccctgtccaaggagttcaccgacgagagtcagccggcggactggtgcagctgaaccagcagagcgagtacgctccaggcctggaggacaccctcatcctgaccatgaagggcatcgccgccggcatgcagaacaccggctaggccaagatcttcggtgtgcaaataacctgtctcccatgagacggtggacgatatgtgtaggcctgtgagcagttagtacaccggcgccagtgtgttctggaggatttctcatgtcagagcctttctcttgtgtgcttgctgtagatg

SEQ ID NO: 5087 - DNA, 308 bp, Zea mays
  Clone ID: 700620292H1
ctggtcacaaggacgtccttgaaggtgatccttatctgaagcagcgtctgcggctgcgtgagtcctacatcaccactctgaacgtgtgccaggcctacaccctgaagcggatacgcgacccgagcttccaggtgagcccgcagccgcccctgtccaaggagttcaccgacgagagtcagccggcggagctggtgcagctgaaccagcagagcgagtacgctccaggcctggaggacaccctcatcctgaccatgaagggcatcgccgccggcatgcagaacaccggctaggccaagatcttcggtgtg

SEQ ID NO: 5088 - DNA, 286 bp, Zea mays
  Clone ID: 700616392H1
aatgagtggccattcttcagggtcaccttgatttgcttgagatggttttcgcgaagggagacccgggaatcgcagctgtgtacgacaaattgctagtggctgatgatttgcaatccttcggcgagcaactgaggaagaactatgaggagacaaaagagctactccttcaggttgctggtcacaaggacgtccttgaaggtgatccttatctgaagcagcgtctgcggctgcgtgagtcctacatcaccactctgaacgtgtgccaggcctacaccctgaagcggat

SEQ ID NO: 5089 - DNA, 262 bp, Zea mays
  Clone ID: 700049716H1
caaagaggaagcctagtgggggaatagaatcactccgtgcaattccatggatctttgcttggacacaaacaaggttccatctgcctgtctggcttggatttggtgcagcgataaagcacatcatgcagaaggacatcaggaacatccatatactgagagaaatgtacaatgagtggccattcttcagggtcacccttgatttgcttgagatggttttcgcgaagggagacccgggaatcgcagctgtgtacgacaaattgct

SEQ ID NO: 5090 - DNA, 276 bp, Zea mays
  Clone ID: 700028563H1
tttgcttggacacaaacaaggttccatctgcctgtctggcttggatttggtgcagcgataaagcacatcatgcagaaggacatcaggaacatccatatactgagagaaatgtacaatgagtggccattcttcagggtcacccttgatttgcttgagatggttttcgcgaagggagacccgggaatcgcagctgtgtacgacaaattgctagtggctgatgatttgcaatccttcggcgagcaactgaggaagaactatgaggagacaaaagagcta

SEQ ID NO: 5091 - DNA, 302 bp, Zea mays
  Clone ID: 700105527H1
accacgcgtccgcggacggtgggcgtacgtggatgtagtggccattcttcagggtcacccttgatttgcttgagatggttttcgcgaagggagacccgggaatcgcagatgtgtacgacaaattgcaagtggctgatgatttgcaatccttcggcgagcaactgaggaagaactatgaggagacaaaagagctactccttcaggttgctggtcacaaggacgtccttgaaggtgatccttatctgaagcagcgtctgcagctgcgtgagtcctacatcaccactctgaacgtgtgccaggcc

SEQ ID NO: 5092 - DNA, 346 bp, Zea mays
  Clone ID: 700615230H1
gtctggcttggatttggtgcagcgataaagcacatcatgcagaaggacatcaggaacatccatatactgagagaaatgtacaatgagtggccattcttcagggtcacccttgatttgcttgagatggttttcgcgaagggagacccgggaatcgcagctgtgtacgacaaattgctagtggctgatgatttcaatccttcggcgagcaactgaggaagaactatgaggagacaaaagagctactccttcaggttgctggtcacaaggacgtccttgaaggtgatccttatctgaagcagcgtctgcggctgcgtgagcctacatcaccatctgaagtgtgcaggct

SEQ ID NO: 5093 - DNA, 269 bp, Zea mays
  Clone ID: 700550579H1
catggatctttgcttggacacaaacaaggttccatctgcctgtctggcttggatttggtgcagcgataaagcacatcatgcagaaggacatcaggaacatccatatactgagagaaatgtacaatgagtggccattcttcagggtccccttgatttgcttgagatggttttcgcgaagggagacccgggaatcgcagctgtgtacgacaaattgctagtggctgatgatttgcaatccttcggcgagcaactgaggaagaactatgagg

SEQ ID NO: 5094 - DNA, 280 bp, Zea mays
  Clone ID: 700381592H1
tggacacaaacaaggttccatctgcctgtctggcttggatttggtgcagcgataaagcacatcatgcagaaggacatcaggaacatccatatactgagagaaatgtacaatgagtggcaattcttcagggtcacccttgatttgcttgagatggttttcgcgaagggagacccgggaatcgcagctgtgtacgacaaattgctagtggctgatgatttgcaatctttcggcgagcaactgaggaagaactatgaggagacaaaagagctactccttcagg

SEQ ID NO: 5095 - DNA, 278 bp, Zea mays
  Clone ID: 701186231H1
agcggatacgcgacccgagcttccaggtgagcccgcagccgcccctgtccaaggagttccccgacgagagtcagccggcggagtggtgcagctgaaccagcagagcgagtacgctccaggcctggaggacaccctcatcctgaccatgaagggcatcgccgccggcatgcagaacaccggctaggcaagatcttcggtgtgcaaataacctgtctcccatgagacggtggacgatatgtgtaggcctgtgagcagttagtacaccggcgccagtgtgt

SEQ ID NO: 5096 - DNA, 349 bp, Zea mays
  unsure (1)...(349): unsure at all n locations
  Clone ID: 700572736H1
tgcctgtctggcttggatttggtgcagcgataaagcacatcatgcagaaggacatcaggaacatccatatactgagagatatgtacaatgagtggccattcttcagggtcacccttgatttgcttgagatggttttcgcgaagggagacacgggaatcgcagctgtgtacgacaaattgctagtggctgatgatttgcaatccttcggcgagcaactgaggaagaactatgaggagacnaaagagctactccttcaggttgctggtcacaaggacgtccttgaaggtgatccttatctgaagcagcgtctgcggctgcgtgagtcctacatcaccactctgaacgtgtg

SEQ ID NO: 5097 - DNA, 260 bp, Zea mays
  Clone ID: 700158658H1
tttgcaatccttcggcgagcaactgaggaagaactatgaggagacaaaagagctactccttcaggttgctggttacaaggacgtccttgaaggtgatccttatctgaagcagcgtctgcggctgcgtgagtcctacatcaccactctgaacgtgtgccaggcctacaccctgaagcggatacgcgacccgagcttccaggtgagcccgcagccgcccctgtccaaggagttcaccgacgagagtcagccggcggactggt

SEQ ID NO: 5098 - DNA, 273 bp, Zea mays
  Clone ID: 701186212H1
caaattgctagtggctgatgatttgcaatccttcggcgagcaactgaggaagaactatgaggagacaaaagagctactccttcaggttgctggtcacaaggacgtccttgaaggtgatccttatctgaagcagcgtctgcggctgcgtgagtcctacatcaccactctgaacgtgtgccaggcctacaccctgaagcggatacgcgacccgagcttccaggtgagcccgcagccgcccctgtccaaggagttcaccgacgagagtcagccggc

SEQ ID NO: 5099 - DNA, 235 bp, Zea mays
  Clone ID: 700616621H1
aatgagtggccattcttcagggtcaccttgagttgcttgagatggttgtcgcgaagggagacccgggaatcgcagctgtgtacgaccaattgggtagtggctgatgattttcaatccttcggcgagcaactgaggaagaactatgaggagacaaaagagctactccttcaggttgctggtcacaaggacgtccgtgaaggtgatccttatctgaagcagcgtctgcggctgcgtg

SEQ ID NO: 5100 - DNA, 253 bp, Zea mays
  Clone ID: 701161255H1
gtgccaggcctacaccctgaagcggatacgcgacccgagcttccaggtgagcccgcagtcgcccctgtccaaggagttcaccgacgagagtcagccggcggagctggtgcagctgaaccagcagagcgagtacgctccaggcctggaggacaccctcatcctgaccatgaagggcatcgccgccggcatgcagaacaccggctaggccaagatcttcggtgtgcaaataacctgtctcccatgagacggtgga

SEQ ID NO: 5101 - DNA, 263 bp, Zea mays
  Clone ID: 700222259H1
gagatgtacaatgagtggccattcttcagggtcacccttgatctgctcgagatggttttcgccaagggtgacccgggaatcgcggctgtgtatgacaaattgcttgtggctgatgatttgcaatccttcggcgagcaactgaggaagaactatgaggagacaaaggaactactcctccaggttgccggtcacaaggacgtacttgaaggtgatccttacctgacacagcggctgcggctgcgcgagtcctacatcaccaccct

SEQ ID NO: 5102 - DNA, 227 bp, Zea mays
  Clone ID: 701161671H1
caatgagtggccattcttcagggtcacccttgatttgcttgagatggatttcgcgaagtgagacccgggaatcgcagctgtgtacgacaaattgctagtggctgatgatttgcaatccttcggcgagcaactgaggaagaactatgaggagacaaaagagctactccttcaggttgctggtcacacggacgtccttgaaggtgatccttatctgaagcagcgtctgc

SEQ ID NO: 5103 - DNA, 282 bp, Zea mays
  Clone ID: 700028609H1
caccctgaacgtgtgccaggcctacacgctgaagcggatacgtgacccgagcttccaggtgagcccgcagccgccactgtccaaggagttcaccgacgagagtcagccggcggagctggtgcagctgaacgagcagagcgagtacgccccgggcctggaggacacgctgatcctgaccatgaagggcatcgctgccggcatgcagaacaccggctaggccaagatacatactcggtttgcgaataacccgtctcgcatgagatggtaggcgatatgtgtagc

SEQ ID NO: 5104 - DNA, 255 bp, Zea mays
  Clone ID: 700570011H1
tgaagggagacgcgggaatcgcagctgtgtacgacaaattgctagtggctgatgatttgcaatccttcggcgagcaactgaggaagaactatgaggagacaacagagctactccttcaggttgctggtcacaaggacgtccttgaaggtgatccttatctgaagcagcgtctgctgctgcgtgagtcctacacaccactctgaacgtgtgccaggcctacaccctgaagcggatacgcgacccgagcttccaggt

SEQ ID NO: 5105 - DNA, 271 bp, Zea mays
  Clone ID: 700467579H1
catggatctttgcttggacacaaacaaggttccatctgcctgtctggcttggatttggtgcagcgataaagcacatcatgcagaaggacatcaggaacatccatatactgagagaaatgtacaatgagtggccattcttcaggggtcaccctgtagtgcttgagatggttttcgcgaagggagactccgggaatcgcagctgtgtacgacaaattgctagtggctgatgatttgcatcctttcgcgagaactgaggaagaactatgaagag

SEQ ID NO: 5106 - DNA, 233 bp, Zea mays
  Clone ID: 700020751H1
gcacgaggtcagccggcggactggtgcagctgaacgagcagagcgagtacgccccgggcctggaggacacgctgatcctgaccatgaagggcatcgctgccggcatgcagaacaccggctaggccaagatacatactcggtttgcgaataacccgtctcccatgagatggtaggcgatatgtgtagcctgtaagcagacagttcgtcggcgtgttgcggaggaatttttatgt

SEQ ID NO: 5107 - DNA, 105 bp, Zea mays
  Clone ID: 700612494H1
ctggaggacaccctcatcctgaccatgaagggcatcgccgccggaatgcagaacaccggctaggccaagatcttcggtgtgcaaataacctgtctcccatgagac

SEQ ID NO: 5108 - DNA, 297 bp, Zea mays
  Clone ID: 700028168H1
cgtgaatggactgaagaacgccgccaagaatggttactgtctgaacttaatggcaagcgccctctgtttggctcagaccttcccaagactgaggaaatttctgatgttctagacacattccatgttattgctgagcttccctctgacaattttggtgcgtatatcatttccatggcgacagctccgtcggacgtccttgctgttgaactcctccaacgtgagtgtcatgtgaaaacaccacttagagtagtcccgctgtttgagaagttggccgatcttgaggctgccccggctgca

SEQ ID NO: 5109 - DNA, 232 bp, Zea mays
  Clone ID: 700150081H1
cggacgcgtgggaaattgctgatgttctagacacattccatgttattgctgagcttccctctgacaattttggcgcatatatcatttccatggcgacagctccgtcggacgtccttgctgttgaactcctccaacgtgagtgtcatgtgaaaacaccacttagagtagtcccgctgtttgagaagttggccgatcttgaggctgccccggctgcattggccagactgttctc

SEQ ID NO: 5110 - DNA, 264 bp, Zea mays
  Clone ID: 700104081H1
caatgcaacggaagcatgtttgctagttattagttaaacaaaaaacatagtttcgtactttattttgcatcaggcttcaacagccaataagctccccttggcatctacagcaagcacacaagagaaaggctctgacatgaaaaatcctccagaacacactggcgccggtgtactaactgctcacaggcctacacatatcgtccaccgtctcatgggagacaggttatttgcacaccgaagatcttggcctagccggtgttctgc

SEQ ID NO: 5111 - DNA, 223 bp, Zea mays
  Clone ID: 700258244H1
ggctaggccaagatcttcggtgtgcaaataacctgtctcccatgagacggtggacgatatgtgtaggcctgtgagcagttagtacaccggcgccagtgtgttctggaggatttttcatgtcagagcctttctcttgtgtgcttgctgtagatgccaaggggagcttattggctgttgaagcctgatgcaaaataaagtacgaaactatgttttttgtttaact

SEQ ID NO: 5112 - DNA, 201 bp, Zea mays
  Clone ID: 700206542H1
tgcaaataacctgtctcccatgagacggtggacgatatgtgtaggcctgtgagcagttagtacaccggcgccagtgtgttctggaggatttttcatgtcagagcctttctcttgtgtgcttgctgtagatgccaaggggagcttattggctgttgaagcctgatgcaaaataaagtacgaaactatgttttttgtttaact

SEQ ID NO: 5113 - DNA, 288 bp, Zea mays
  Clone ID: 700238111H1
cccacgcgtccgggcgagaatgatggctgctaacttgtacttctctcagattgaagatttaatgtttgagctgtctatgtggcgctgcagtgatgaacttcggatccgtgcagatgaactacatcgctcttcaagaaaagctgcaaagcactatatagaattctggaagcaagttccgccaaatgaaccatatcgtgtcatacttggtaatgtcagggataaattgtactacacacgtgaacgttctcgtcacctattgacatctggaatttctgagattctagagga

SEQ ID NO: 5114 - DNA, 254 bp, Zea mays
  Clone ID: 700804782H1
tggaaatccaagagtaacaccagaggttacacgggatgtatgcttgttggcgagaatgatggctgctaacttgtacttctctcagattgaagatttaatgtttgagctgtctatgtggcgctgcagtgatgaacttcggatccgtgacaatgaactacatcgctcttcaagaaaagctgcaaagcactatatagaattctggaagcaagttccgccaaatgaaccatatcgtgtcatacttggtgatgtcaggg

SEQ ID NO: 5115 - DNA, 320 bp, Zea mays
  Clone ID: 700050530H1
agcggtcgctgggcacaaggaccttctggagggcgacccgtacctgaagcagaggctgcgcatccgtgactcgtacaccacggcgctgaacgtttgccaggcctacacgctgaagcgcatcagggaccctggcttccaggtgaagccgcggccccacctgtcgaaggacatcatggacatgggcaagccggcgtcggagctcgtgaagctgaacaccaccagcgagtacgccccggggctggaggacaccctcatcctgaccatgaacggcatcgctgccggtatgcagaacacgggatgaacccagtgtgcctgtcttc

SEQ ID NO: 5116 - DNA, 255 bp, Zea mays
  Clone ID: 701180159H1
tggagggcgacccgtacctgaagcagaggctgcgcatccgtgactcgtacaccacggcgctgaacgtttgccaggcctacacgctgaagcgcatcagggaccctggcttccaggtgaagccgcggccccacctgtcgaaggacatcatggacatgggcaagccggcgtcggagctcgtgaagctgaacaccaccagcgagtacgccccggggctggaggacaccctcatcctgaccatgaagggcatcgctgccg

SEQ ID NO: 5117 - DNA, 262 bp, Zea mays
  Clone ID: 700160214H1
caggaacctccacatgctccaggaaatgtacaatgagtggccatttttcagggtgactattgatctggtggagatggtgttcgccaagggtaatcctggcattgccgcactgtatgacaaactcctcgtttcagaggaactgcatccattgggtgagaagctgagggccaactatgaggaaacccagaagcttctacttcaggttgctgggcacagggatcttctggaaggtgacctctacctgaagcagcggctccgcctg

SEQ ID NO: 5118 - DNA, 224 bp, Zea mays
  Clone ID: 700553034H1
caggaacctccacatgctccaggaaatgtacaatgagtggccatttttcagggtgactattgatctggtggagatggtgttcgccaagggtaatcctggcattgccgcactgtatgacaaactcctcgtttcagaggaactgcctccattgggtaagaagctgagggccaactataggaaacccagaagcttctacttcaggttgctgggcacagggatcttct

SEQ ID NO: 5119 - DNA, 227 bp, Zea mays
  Clone ID: 700168584H1
cccacgcgtccgcagaaggacatcaggaacctccacatgctccaggaaatgtacaatgagtggccatttttcagggtgactattgatctggtggagatggtgttcgccaagggtaatcctggcattgccgcactgtatgacaaactcctcgtttcagaggaactgcatccattgggtgagaagctgagggccaactatgaggaaacccagaagcttctacttcaggt

SEQ ID NO: 5120 - DNA, 188 bp, Zea mays
  Clone ID: 700257383H1
cgccgaggaagtacagatcgcgcaccgtcgccggatcaagctaaagcggggagacttcgccgacgaggcctccgcgccgacggagatcgacatcgaggagacgctcaagcacctcgtctcgcagctcggcaagtcgcgggatgaggtcatcgacgcgctcaagaaccagaccatcgacatcgttttca

SEQ ID NO: 5121 - DNA, 128 bp, Zea mays
  Clone ID: 700263133H1
gcagatcgcgcaccgtcgccggatcaagctaaagcggggagacttcgccgacgaggcctccgcaccgacggagtcggacatcgaggagacgctcaagcgcctcgtctcgcagctcggcaagtcgcggg

SEQ ID NO: 5122 - DNA, 303 bp, Zea mays
  Clone ID: 700213133H1
ggacgtgggtactgagtgatgtcagggataaactctacaacactcgtgaacgctcacgagagcttttatccagtgggcattctgatattcctgaggaagctacattgacaaatgttgagcagctgttggagcccttggaactatgttacagatcactctgtgcttgtggtgactctgtaattgctgatggaacccttctggatttcttgcgtcaagtgtccacctttggactctcccttgtgaggcttgacattaggcaagagtcagataggcatactgatgtccttgatgccatcactacat

SEQ ID NO: 5123 - DNA, 242 bp, Zea mays
  Clone ID: 700087946H1
cccacgcgtccgcccacgcgtccggaaggttcctccaaatgagccatatcgggtgatactgagtgatgtcagggataaactgtacaacactcgtgaacggtcacgagagcttttatccagtgggcattctgatattcctgaggaagctacattgacaaatgttgagcagctgttggagcccttggaactatgttacagatcactctgtgcttgtggtgactctgtaattgctgatggaaccc

SEQ ID NO: 5124 - DNA, 236 bp, Zea mays
  Clone ID: 700170629H1
cggaccgtggtttccgccttgcaacgccagagatggagtatggcaggatgaacatcggaagcaggccatcgaaaagaaagccgagtgcgggcatcgagtcgctgcgcgcaatcccttggatcttcgcttggacgcagactcggttccacctgccggtgtggctgggtttcggcgcggcgttcaagcatgtcttgcacaaggacatacggaatctccagacccttcaggagatgtac

SEQ ID NO: 5125 - DNA, 305 bp, Zea mays
  Clone ID: 700451602H1
agtagcctacaaagtcggctcgagcgagtatttccgccttgcaacccctgaaacagagtatggtaggatgaacataggaagcaggccatccaagagaaagccgagcggaggtatcgactcactccgagcaatcccatggatctttgcttggacacagacgcggttccacctcccggtctggctaggatttggagccgcattcaagcatgtcctccagaaggacatcaggaacctccacatgctccaggaaatgtacaatgagtggccatttttcagggtgactattgatctggtggagatggtgt

SEQ ID NO: 5126 - DNA, 259 bp, Zea mays
  Clone ID: 700243536H1
cggacgcgtgggtgcacccaccaaatgcaccaaagccagaatggcgagcacttcttgatgagatggcagttgtggcaactgaggaatatcggtccattgtcttcaaagagccacgctttgtcgagtatttccgccttgcaacccctgaaacagagtatggtaggatgaacataggaagcaggccatccaagagaaagccgagcggaggtatcgactcactccgagcaatcccatggatctttgcttggacacaaacgcg

SEQ ID NO: 5127 - DNA, 297 bp, Zea mays
  Clone ID: 700104327H1
acgggagcgcggacggtggcggacggtggcggaccgtgggcggaccgtgggcggaccgtgggcagcttttcacggagctctaccctgactcatggcatgcaaccaccagatgcaccatagccagaatggcgagcccttcttgatgagatggcagttgtggcaactgaggaatatcggtccattgtcttcaaagagccacgctttgtcgagtatttccgccttgcaacccctgatacagagtatggtaggatgaacataggaagcaggccatccaagagaaagccgagcggaggtatc

SEQ ID NO: 5128 - DNA, 217 bp, Zea mays
  unsure (1)...(217): unsure at all n locations
  Clone ID: 701160410H1
ggcgagcccttcttgatgagatggcagntgtggcaactgaggaatatcggtccattgtcttcaaagagccacgctttgtcgagtatttccgccttgcaacccctgaaacagagtatggcaggatgaacataggaagcaggccatccaagagaaagccgagcggaggtatcgactcactccgagcaatcccatggatctttgctgggacaacagacgc

SEQ ID NO: 5129 - DNA, 302 bp, Zea mays
  Clone ID: 700051281H1
gtggtgacaaacctatagctgatggaagtcttcttgatttcttgcgtcaagtatcaacttttgggcttgcccttgtgaagctcgacatcaggcaggaatctgatcgacacactgatgtccttgattcgataacgacacatcttggaattggctcctatgctgaatggtctgaggagaaacgccaggattggctgttgtctgaactgaggggcaaacgtccattgtttggttcagatcttcctcagactgaagagactgctgatgttttaggcacatttcatgtccttgcagagctcctgcag

SEQ ID NO: 5130 - DNA, 298 bp, Zea mays
  Clone ID: 700075340H1
ctgagattctagaggaggcaacttttactaatgttgaacagtttctggaacctcttgagctctgttatagatcattatgtgcttgtggtgacaaacctatagctgatggaagtcttcttgatttcttgcgtcaagtatcaacttttgggcttgcccttgtgaagctcgacatcaggcaggaatctgatcgacacactgatgtccttgattcgataacgacacatcttggaattggctcctatgctgaatggtctgaggagaaacgccaggattggctgttgtctgaactgaggggcaa

SEQ ID NO: 5131 - DNA, 292 bp, Zea mays
  Clone ID: 700259374H1
gccaggattggctgttgtctgaactgagggacaaacgtccattgtttggttcagatcttcctcagactgaagagactgctgatgttttaggcacatttcatgtccttgcagagcttcctgcagattgctttggcgcgtatatcatctctatggcaactgccccatccgatgtgcttgcggtcgagcttttgcagcgtgagtgccatgtaaaacatccactgagagttgttccactttttgagaaacttgcagatcttgaagcagctccagcagctgtagcacggctcttttc

SEQ ID NO: 5132 - DNA, 285 bp, Zea mays
  Clone ID: 700026464H1
gcttgtggtgacaaacctatagctgatggaagtcttcttgatttcttgcgtcaagtatcaacttttgggcttgcccttgtgaagctcgacatcaggcaggaatctgatcgacacactgatgtccttgattcgataacgacacatcttggaattggctcctatgctgaatggtctgaggagaaacgccaggattggctgttgtctgaactgaggggcaaacgtccattgtttggttcagatcttcctcagactgaagagactgctgatgttttaggcacatttcat

SEQ ID NO: 5133 - DNA, 276 bp, Zea mays
  Clone ID: 700075594H1
gacacatcttggaattggctcctatgctgaatggtctgaggagaaacgccaggattggctgttgtctgaactgaggggcaaacgtccattgtttggttcagatcttcctcagactgaagagactgctgatgttttaggcacatttcatgtccttgcagagcttcctgcagattgctttggcgcgtatatcatctctatggcaactgccccatccgatgtgcttgcggtcgagcttttgcagcgtgagtgccatgtaaaacatccactgagagttgt

SEQ ID NO: 5134 - DNA, 290 bp, Zea mays
  Clone ID: 700074584H1
ctccagcagctgtagcacggctcttttcaattgactggtacatggataggattaatggcaagcaggaggtcatgattgggtattcagactctggcaaagatgccgggcgtctctctgcagcatggcaaatgtataaagcacaagaggagctcatcagagtggcaaagcattatggagtcaagttgacaatgtttcatgggaggggtggaacagttggcagaggaggtggtccaactcatctggccatattatctcagccaccagacacgatacatgggtcacttcgtgta

SEQ ID NO: 5135 - DNA, 308 bp, Zea mays
  unsure (1)...(308): unsure at all n locations
  Clone ID: 700211639H1
cccacgcgtccgcccacgcgtccgggagaaacgccaggattggttgttgtctgaactgaggggcaaacgtccattgtttggttctgatcttcctcagactgaagagactgctgatgttttaggcacatttcatgtccttgcagagcttccagcagattgctttggtgcatatatcatctcgatggcaactgccccatctgatgtgcttgcggtggagcttttgcagcgagagtgccatgtanaacaaccactgagagttgttccactcttcgagaaacttgcagatcttgaagcagctccagcagctg

SEQ ID NO: 5136 - DNA, 271 bp, Zea mays
  Clone ID: 700477352H1
tgaagcagctccagcagctgtagcacggctcttttcaattgactggtacatggataggattaatggcaagcaggaggtcatgattggatattcagactctggcaaagatgccgggcgtctctctgcagcatggcaaattataaagcacaagaagagctcatcaaagtggcaaagcattatggagtcaagttgacaatgtttcatgggaggggtggaacagttggcagaggaggtggtccaactcatctggccatattatctcagccaccag

SEQ ID NO: 5137 - DNA, 263 bp, Zea mays
  Clone ID: 700212885H1
caagtatcaacttttggtcttgcacttgtgaagcttgacatcaggcaggaatctgatcgacacacagatgtccttgattcgataacgacacatcttggaattggctcctatgctgaatggtctgaggagaaacgccaggattggttgttgtctgaactgaggggcaaacgtccattgtttggttctgatcttcctcagactgaagagactgctgatgttttaggcacatttcatgtccttgcagagcttccagcagattgctt

SEQ ID NO: 5138 - DNA, 240 bp, Zea mays
  Clone ID: 700150132H1
ggcgcgtatatcatctctatggcaactgccccatccgatgtgcttgcggtcgagcttttgcagcgtgagtgccatgtaaaacatccactgagagttgttccactttttgagaaacttgcagatcttgaagcagctccagcagctgtagcacggctcttttcaattgactggtacatggataggattaatggcaagcaggaggtcatgattggatattcagactctggcaaagatgccggg

SEQ ID NO: 5139 - DNA, 235 bp, Zea mays
  Clone ID: 700150124H1
ggcgcgtatatcatctctatggcaactgccccatccgatgtgcttgcggtcgagcttttgcagcgtgagtgccatgtaaaacatccactgagagttgttccactttttgagaaacttgcagatcttgaagcagctccagcagctgtagcacggctcttttcaattgactggtacatggataggattaatggcaagcaggaggtcatgattggatattcagactctggcaaagatg

SEQ ID NO: 5140 - DNA, 286 bp, Zea mays
  Clone ID: 700382807H1
gacacactgatgtcttgattcgataacgacacatcttggaattggctcctatgctgaatagtctgaggagaaacgccaggattggctgttgtctgaactgaggggcaaacgtccattgtttggttcagatcttcctcagactgaagagactgctgatgttttaggcacatttcatgtccttgcagagctatcctgcagattgctttggcgcgtatatcatctctatggcaactgccccatccgatgtgcttgcgatcgagcttttgcagcgtgagtgccatgtaaa

SEQ ID NO: 5141 - DNA, 267 bp, Zea mays
  Clone ID: 700219884H1
cggacgcgtgggcggacgcgtgggggaatctgatcgacacactgatgtccttgattcgataacgacacatctatggaattggctcactatgctgaatggtctgaggagaaacgccaggattggctgttgtctgaactgaggggcaaacgtccattgtttggttcagatcttcctcagactgaagagactgctgatgttttaggcacatttcatgtccttgcagagcttcctgcagattgctttggcgcgtatatcatctctatggca

SEQ ID NO: 5142 - DNA, 217 bp, Zea mays
  Clone ID: 700203986H1
gatgtgcttgcggtcgagcttttgcagcgtgagtgccatgtaaaacatccactgagagttgttccactttttgagaaacttgcagatcttgaagcagctccagcagctgtagcacggctcttttcaattgactggtacatggataggattaatggcaagcaggaggtcatgattggatattcagactctggcaaagatgccgggcgtctctctgcag

SEQ ID NO: 5143 - DNA, 190 bp, Zea mays
  Clone ID: 700155306H1
catatatcatctcgatggcaactgccccatctgatgtgcttgcggtggagcttttgcagcgagagtgccatgtaaaacaaccactgagagttgttccactcttcgagaaacttgcagatcttgaagcagctccagcagctgtagcgcgactcttttcaattgacgggtacatgaataggattaatggtaa

SEQ ID NO: 5144 - DNA, 138 bp, Zea mays
  Clone ID: 700474781H1
tgaagcagctccagcagctgtagcacggctcttttcaattgactggtacatggataggattaatggcaagcaggaggtcatgattggatattcagactctggcaaagatgccgggcgtctctctgcagcatggcaaat

SEQ ID NO: 5145 - DNA, 372 bp, Zea mays
  unsure (1)...(372): unsure at all n locations
  Clone ID: 700574802H1
agtcgcacgcangcttactcaactgagatcatggactcgaccaaggctgcggcggagctggtgaagctgaaccctggcagcgaatacgcaccggggctggaggacaccctcatcctgaccatgaagggcatagcagccggcctccagaacaccggttaaaccacgaagaggggatcttttttctcctcctgatcattggctctaggttcttcgtattttcgcggattgtaacttcggccacctctctacaccgtgaggaaataatggtggtttctgcaaaagtggtggtaaatataagggcgacaagccgacaactatcttgtttttcttagtaacttgtaactttacgatgcgataatggaacatggcctg

SEQ ID NO: 5146 - DNA, 304 bp, Zea mays
  Clone ID: 700049340H1
ctgagggccaactatgaggaaacccagaagcttctacttcaggttgctgggcacagggatcttctggaaggtgacctctacctgaagcagcggctccgcctgcgtgatgcgtacatcaccaccctgaacgtctgccaggcctacaccctgaagcggatccgtgacccggactaccatgtcgcgctgcgtccccacctctccaaggagatcatggactcgaccaaggctgcggcggagctggtgaagctgaaccctggcagcgaatacgcaccggggctggaggacacctcatcctgaccatgaa

SEQ ID NO: 5147 - DNA, 273 bp, Zea mays
  Clone ID: 701180032H1
agaagcttctacttcaggtgctgggcacagggatcttctggaaggtgacctctacctgaagcagcggctccgcctgcgtgatgcgtacatcaccaccctgaacgtctgccaggcctacaccctgaagcggatacgtgacccggactaccatgtcgcgctgcgcccccacctctccaaggagatcatggactcgaccaaggctgcggcggagctggtgaagctgaaccctggcagcgaatacgcaccggggctggaggacaccccatcctgacc

SEQ ID NO: 5148 - DNA, 254 bp, Zea mays
  Clone ID: 700611642H1
tgcatccattgggtgagaagctgagggccaactatgaggaaacccagaagcttctacttcaggttgctgggcacagggatcttctggaaggtgacctctacctgaagcagcggctccgcctgcgtgatgcgtacatcaccaccctgaacgtctgccaggcctacaccctgaagcggatccgtgacccggactaccatgtcgcgctgcgcccccacctctcaaaggagatcatggactcgaccagggctgcggcg

SEQ ID NO: 5149 - DNA, 312 bp, Zea mays
  unsure (1)...(312): unsure at all n locations
  Clone ID: 700203138H1
ataagcttctacttcaggttgctgggcacagggatcttctggaaggtgacctctacctgaagcagcggctccgcctgcttgatgcgtacatcaccaccctgaacgtctgccaggcctacaccctgaagcggatccgtgatncggactaccatgtcgcgctgcgcccccacctctccaaggagatcatggactcgaccaaggctgcggcggagctggtgaagctgaaccctggcagcgaatacgcaccggggctggacgacaccctcatcctgaccatgacaggcatagcagcgggcctccagaacaccggtt

SEQ ID NO: 5150 - DNA, 235 bp, Zea mays
  Clone ID: 700029976H1
ccggactaccatgtcgcgctgcgcccccacctctcaaggagatcatggactcgaccaaggctgcggcggactggtgaagctgaaccctggcagcgaatacgcaccggggctggaggacaccctcatcctgaccatgaagggcatagcagccggcctccagaacaccggttaaaccacgaagaggggatcttttttctcctcctgatcattggctctaggtccttcgtattttcgc

SEQ ID NO: 5151 - DNA, 298 bp, Zea mays
  Clone ID: 700614328H1
agaatctgaccggcatactgatgttatggatgctataactgaatacctcggtattggatcataccgtaaatggccagaggagaaacgccaagaatggctactatcggaacttaatggaaagaggccgttatttggtccggaccttcccaagtcagatgagattgctgatgtactagatactttccacgtattagctgaacttccatcagacagctttggtgcatatgtaatatctatggcgactgctccctcagatgtccttgctgtggagctcttgcagcgtgaatgccatgtgaaa

SEQ ID NO: 5152 - DNA, 222 bp, Zea mays
  Clone ID: 700352909H1
actataactgaatacctcggtattggatcataccgtaaatggccagaggagaaacgccaagaatggctactatcggaacttaatggaaagaggccattatttggtccggaccttcccaagtcagatgagattgctgatgttctagatactttccacgtattagctgaacttccatcagacagctttggtgcatatgtaatatctatggcgactgctccctca

SEQ ID NO: 5153 - DNA, 279 bp, Zea mays
  Clone ID: 700073585H1
gattggtacagacagaggatcaatggcaagcaggaggtcatgattgggtattcagactcgggcaaagatgctggtcgcctctcagcagcttggcagctatacaaagctcaggaggagctcatcaaggttgctaaggactttggtgtgaagttaacgatgttccatggacgtggtgggactgttggaaggggtggtggtcccactcaccttgccatcttgtcccagccaccagacacgatccacggatcactcagggtcactgtgcaaggtgaagtcatt

SEQ ID NO: 5154 - DNA, 272 bp, Zea mays
  Clone ID: 700023118H1
ctcgggcaaagatgctggtcgcctctcagcagcttggcagctatacaaagctcaggaggagctcatcaaggttgctaaggactttggtgtgaagttaacgatgttccatggacgtggtgggactgttggaaggggtggtggtcccactcaccttgccatcttgtcccagccaccagacacgatccacggatcactcagggtcactgtgcaaggtgaagtcattgaacagtcatttggtgaggacacttgtgctttaggacactgcaacgttt

SEQ ID NO: 5155 - DNA, 279 bp, Zea mays
  Clone ID: 700456524H1
ctcgggcaaagatgctggtcgcctctcagcagcttggcagctatacaaagctcaggaggagctcatctaggttgctaaggactttggtgtgaagttaacgatgttccatggacgtggtgggactgttggaaggggtggtggtcccactcaccttgccatcttgtcccagccaccagacacgctccacggatcactcagggtcactgtgcaaggtgaagtcattgaacagtcatttggtgaggagcacttgtgctttaggacactgcaacgtttcacggc

SEQ ID NO: 5156 - DNA, 196 bp, Zea mays
  Clone ID: 700030070H1
ggcaagcaggaggtcatgattgggtattcagactcgggcaaagatgctggtcgcctctcagcagcttggcagctatacaaagctcaggaggagctcatcaaggttgctaaggactttggtgtgaagttaacgatgttccatggacgtggtgggactgttggaaggggtggtggtcccatcaccttgccatcttgtc

SEQ ID NO: 5157 - DNA, 313 bp, Zea mays
  Clone ID: 700077313H1
gcacaagaagagctcatcaaagtggcaaagcattatggagtcaagttgacaatgtttcatgggaggggtggaacagttggcagaggaggtggtccaactcatctggccatattatctcagccaccagacacgatacatggatcacttcgtgtaacagttcaaggcgaagttattgagcactcctttggagaggagctcttgtgcttcagaactttgcaacgctacactgcagctactcttgagcatggcatgcatcctccgatttcccctaagccagaatggcgtgctctgatggatgacatggctgttgtag

SEQ ID NO: 5158 - DNA, 295 bp, Zea mays
  Clone ID: 700381893H1
gttccacctcttccatgaaacatggatcgcttcgtgtaacagttcaaggcgaagttattgaacactcctttggagaggagcacttgtgctttagaactttgcaacgctacactgcagctactcttgagcatggcatgcatcctccaatttcccccaagccagaatggcgtgctctgatggatgaaatggctgttgtagcaactaaagaatatcgatcaattgtctttcaagagccacgcttcgttgaatacttcagatcggctacgcctgagactgaatatggcaggatgaatat

SEQ ID NO: 5159 - DNA, 274 bp, Zea mays
  Clone ID: 700574357H2
gtcaagttgacaatgtttcatgggaggggtggaacagttggcagaggaggtggtccaactcatctggccatattatctcagccaccagacacgatacatggatcacttcgtgtaacagttcaaggcgaagttattgagcactcctttggagaggagctcttgtgcttcagaactttgcaacgctacactgcagctactcttgagcatggcatgatcctccgatttcccctaagccagaatggcgtgctctgatggatgaaatggctgttgtagc

SEQ ID NO: 5160 - DNA, 289 bp, Zea mays
  Clone ID: 700548421H1
tgtaacagttcaaggcgaagttattgagcactcctttggagaggagctcttgtgcttcagaactttgcaacgctacactgcagcaactcttgagcatggcatgcatcctccgatttcccctaagccagaatggcgtgctctgatggatgaaatggctgttgtatcaactagagaatatcgatcaattgtcttccaagaaccacgcttcgttgaatacttcagatcggctacacctgagactgaatatggtacgatgaatatgggcagcggtcatcaagaggaagcctag

SEQ ID NO: 5161 - DNA, 256 bp, Zea mays
  Clone ID: 700029043H1
gacacgatacatggatcacttcgtgtaacagttcaaggcgaagttattgagcactcctttggagaggagctcttgtgcttcagaactttgcaacgctacactgcagctactcttgagcatggcatgcatcctccgatttcccctaagccagaatggcgtgctctgatggatgaaatggctgttgtagcaactaaagaatatcgatcaattgtcttccaagaaccacgcttcgttgaatacttcagatcggctacac

SEQ ID NO: 5162 - DNA, 279 bp, Zea mays
  Clone ID: 700553323H1
ggcagaggaggtggtccaactcatctggccatattatctcagccaccagacacgatacatggatcacttcgtgtaacagttcaaggcgaagttattgagcactcctttggagaggagctcttgtgcttcagaactttgcaacgctacactgcagctactcttgagcatggcatgcatcctccgatttcccctaagccagaatggcgtgctctgatggatgaaatggctgttgtagcaactaaagaatatcgatcaattgtcttccagaaccacgcttcg

SEQ ID NO: 5163 - DNA, 240 bp, Zea mays
  Clone ID: 700167824H1
gtccaactcatctggccatattatctcagccaccagacacgatacatggatcacttcgtgtaacagttcaaggcgaagttattgagcactcctttggagaggagctcttgtgcttcagaactttgcaacgctacactgcagctactcttgagcatggcatgcatcctccgatttcccctaagccagaatggcgtgctctgatggatgaaatggctgttgtagcaactaaagaatatcgat

SEQ ID NO: 5164 - DNA, 236 bp, Zea mays
  Clone ID: 700153945H1
cccacgcgtccggttattgagcactcctttggagaggagctcttgtgcttcagaactttgcaacgctacactgcagctactcttgagcatggcatgcatcctccgatttcccctaagccagaatggcgtgctctgatggatgaaatggctgttgtagcaactaaagaatatcgatcaattgtcttccaagaaccacgcttcggtgaatacttcagatcggctacacctgagactga

SEQ ID NO: 5165 - DNA, 212 bp, Zea mays
  Clone ID: 700615517H1
cttgtgcttcagaactttgcaacgctacactgcagctactcttgagcatggcatgcatcctccgatttcccctaagccagaatggcgtgctctgatggatgaaatggctgttgtagcaactaaagaatatcgatcaattgtcttccaagaaccacgcttcgttgaatacttcagatcggctacacctgagactgaatatggtaggatgaata

SEQ ID NO: 5166 - DNA, 160 bp, Zea mays
  Clone ID: 700265822H1
cggctcgagggcagaggaggtggtccaactcatctggccatattatctcagccaccagacacgatacatggatcacttcgtgtaacagttcaaggcgaagttattgagcactcctttggagaggagctcttgtgcttcagaactttgcaacgctacactg

SEQ ID NO: 5167 - DNA, 253 bp, Zea mays
  Clone ID: 700223020H1
cattaatgtcgctaagctgtatggggttaagctaaccatgttccacggacgaggcggaactgtgggaagaggtgggggccctacccatcttgctatactgtcacaacctccagaaaccatccatggatcacttagggtaaccgttcaaggcgaagtcattgagcagtctttcggagaggagcatttgtgctttaggacactgcaacgtttcacggctgcgacccttgaacatggtatgcaccctccaatttcg

SEQ ID NO: 5168 - DNA, 270 bp, Zea mays
  unsure (1)...(270): unsure at all n locations
  Clone ID: 700613182H1
acgaggcggaactgtgggaagaggtgggggccctacccatcttgctatactgtcacaacctccagaaaccatccatggatcacttagggtaaccgttcaaggcgaagtcattgagcagtctttcggagaggagcatttgtgctttaggacactgcaacgtttcacggctgcgacccttcaacatggtatgcaccctccaatttcgccgaaaccagaatggcgtgctttcatggatgagatggctatcgtcgncacaaacgaataccggtc

SEQ ID NO: 5169 - DNA, 118 bp, Zea mays
  unsure (1)...(118): unsure at all n locations
  Clone ID: LIB143-036-Q1-E1-D6
atttttttggtntttgtgtgttngttnntttttttttnttcttntctttttttgtttggttttttttgntnntnattcgtanttattttttanagtttttgttgttnttttttngttt

SEQ ID NO: 5170 - DNA, 195 bp, Zea mays
  unsure (1)...(195): unsure at all n locations
  Clone ID: LIB148-011-Q1-E1-D6
agcggctctcttnagtctttgatcaccacctacctcacctcactgtctacaactcgtccaccccctctcgtgctgttcttcctcaacttcgccatccgttactcgctctcctgcatcgcctgtcacaatatcaacatcattactgtctttactatcttcacggcttacggggttggtcatctattctctcagtcg

SEQ ID NO: 5171 - DNA, 337 bp, Zea mays
  Clone ID: LIB189-031-Q1-E1-H12
cccacgcgtccgcgtctgaccgaccggacatgctgggattgccaggttgaagcagtatgtgcctgcaggggtagaattcacgcgctttgggagccaactcagggaccaataagtcgagacacagcagcttctcggcaatatcgcagggcagaacgatatactatgaacgcgatgcattcctgaagcaggggctggtgcagcgcaaaccctatatcaccagcctgaacgtgttccaggcctacacgctgaagcggataagggaccccaacttcaaggtgacgccccatccgccgctgtccaaggaattcgccgacgagaacaagcccgccggactggt

SEQ ID NO: 5172 - DNA, 337 bp, Zea mays
  Clone ID: LIB3059-060-Q1-K1-G6
gatcaaccgaatggaggagggatgagtgtccctacctgaaagttttcccacagatgggggcaaaaagccagaaatagagggtatcggtataatgttctaatagtatactccatcacaaaaaatgtgcacttctatttacattgctttaagtcaaacaatcttcggttttaccaacttttttactacaaatatataaaagttatatgataccaaataagtaccattaggttcatcatagaatatagttccatcgtatacttatttgtaatattaagtgttgatattattttgacaaacttagtcaaacttaaaatagttatacttgcaccagatctag

SEQ ID NO: 5173 - DNA, 251 bp, Zea mays
  Clone ID: LIB3060-009-Q1-K1-C3
ggcatcgggtcgtaccgcgagtggtcctaggacaagaggcatgagtggctgctgtcggagctgcgaggcaagcgcccgctgctgcccccggacctttcccagaccgactagatcgccgacgtcatcggcgcgttccacgtcctttctgagctcccgcccgacagcttctgcccctacatcatctccatggcgacggtcccctcggacgtactcgccgtagagcttcctgcagcgcgagtgcggcgtgcgcc

SEQ ID NO: 5174 - DNA, 111 bp, Zea mays
  unsure (1)...(111): unsure at all n locations
  Clone ID: LIB3060-011-Q1-K1-F9
ggganncttgagccacttntgctgcnttacaaatnactgtntnactgcggggacaagggnatctttngacgggagccttctgtacctactgngncaggtnttaacgttang

SEQ ID NO: 5175 - DNA, 397 bp, Zea mays
  Clone ID: LIB3060-029-Q1-K1-A8
tcgtgcatggctactgccccctattcgttctcgccgtatagctcctgcatcgcgagtgcggcttgcgccatccgctgcccgtggtgccgctgttctagaggctggccgacctgcagtcgacgccctcgttcatggagcgcctcttctcggcggactgatacatggaccggatcaagggcaagcagcaggtcatggtcggctactgctactccgacaaggactcctgccgactgtccacggcgtggcagctgtacagggcgcatgacgagatggcgcaagtggccaagcgctacggcgtcaagctcaccttgttccacggcctgggaggcaccgtggacaagggtggcggtcccacgcaccttgccatcctgttccagccgccggacaccatcaacgg

SEQ ID NO: 5176 - DNA, 182 bp, Zea mays
  unsure (1)...(182): unsure at all n locations
  Clone ID: LIB3060-040-Q1-K1-D7
caggaaaagacacgttcatantttccttgaacctntcgcatgantctnaaaccataaaaaaaacaacagacaaaaaaaaacaaaggaacaaaaaaaaaaaaaaataaaataaaaacaaaaaaaaaaaaaaaaaagaaagaaaaaaaaaaatgtataacacccaaccaataaatacatcaacc

SEQ ID NO: 5177 - DNA, 291 bp, Zea mays
  unsure (1)...(291): unsure at all n locations
  Clone ID: LIB3060-020-Q1-K1-G9
tatggttaggactgttttcgttnnttggggactangacgatncgatgacgttccggtaccagatccggcggcgatccacgcttaggccctcggacctttctcagaccgatttgatctcctacgtcatctgctcgttcaacttcgtcacgggtctcacgcccgacagcttcagcccctacatcatctacatggcgactgctccctcggacgtgctcgccgttgagctcctgcaacgctattgctgcatgcgccattctctgcctctattgcctctgttctagaggctttcct

SEQ ID NO: 5178 - DNA, 327 bp, Zea mays
  unsure (1)...(327): unsure at all n locations
  Clone ID: LIB3060-019-Q1-K1-B5
agttagttncaccttagaagtcttatttaagttncttcaganctaggtagtagcactgcatctttcctgaactacccactcgagcgacgcgttcgaatttggacacgagcacctaagcttacacattttgcatccctttacgtccgccacgctgcagcgcggcatgcaccctgcggtctctcccaagcccaagtcgcgcacgctcatggacgagatagcgatcgcagccacggaggagtaccactccttcgacttcaaggagccgcgcttcgtcgagatacttcacatcggctacaccgcagaccgagtaccgtaagatgaacatcg

SEQ ID NO: 5179 - DNA, 86 bp, Zea mays
  unsure (1)...(86): unsure at all n locations
  Clone ID: LIB3068-040-Q1-K1-A3
aaaaaaaacaacaacaananaaaacaacacaaacnnaganacaaaaacaaaaaaaaaancacaaaaaaannanaaaaaaanaaaaa

SEQ ID NO: 5180 - DNA, 250 bp, Zea mays
  unsure (1)...(250): unsure at all n locations
  Clone ID: LIB3068-040-Q1-K1-H6
cacaaaanaaaaacaaacaanaaataaaaantnatanacaaanaaatcaataaaaaaaacacnaaaaatanaaaaacaaanacaaatnacnaanaaaacaaaaaattaanccanacaaaccnanaaaaacaacaccacacaaacnataaaacacataaaataacccaatanacataaaacaaanacaaaacaaaaaaantaacacaaacannaaaaaaaaaannatacacaantcncannannaacacaa

SEQ ID NO: 5181 - DNA, 119 bp, Zea mays
  unsure (1)...(119): unsure at all n locations
  Clone ID: LIB3068-010-Q1-K1-E2
ggggggaaatgggggaaaattttaaaaaggccggggggggnaancnaaaaacnnaaaataaaaaananaaaaaaanaaaaaaannaaaaacaaaaaaaanaaacaantnaaaanacaaa

SEQ ID NO: 5182 - DNA, 346 bp, Zea mays
  unsure (1)...(346): unsure at all n locations
  Clone ID: LIB3069-036-Q1-K1-G3
cccacgcgtccgatttgtatcgcatgaattaactcagagcatctcaatgttaaaactgtaaaggggcagacctggtgccagaggctcccacatgagtgggttctagggaagggataatccgaagcaagccttccccctgcaaatgcagagatgcggctttgaacccgtgacctggtgactaagtgagacacctctcaccactgcaacaggcctgtccttcctcatcgntaaaactgagcatattaattcttcttcttaagcaatatgggagctaattgctgcattgctgcaaaggagaggacacagncgtgcattactcctatagaagtatcggcatacaggaatg

SEQ ID NO: 5183 - DNA, 418 bp, Zea mays
  Clone ID: LIB3069-035-Q1-K1-D7
gtgttcttagagatatatgacgccaccggccgaatccgggcgaccagctcgtcaagtgctggcacaggaacttctggaagggaactgtaactgaaccaccggttccctctgcgtgaagcgtacatcaacacccctggaacgtgtggccaggcctacaccttgaagcggatccgggaccgggactaccatgtcacgctgcgccccgacctttccaaggagatcatggactcgaccaaggctgcggcggagctggtgaagctgaaccctggcagcgaatacgcaccggggctggaggacaccctcatcctgaccatgaagggcatagcagccggcctccagaacaccggttaaaccacgaagaggggatcttttttctcctcctgatcattggctctaggttcttcgtattttcgcggat

SEQ ID NO: 5184 - DNA, 425 bp, Zea mays
  unsure (1)...(425): unsure at all n locations
  Clone ID: LIB3078-007-Q1-K1-E3
gccnngntggntggaatncgggnccgatttnaantncgcnttngncagggcctnnngaacgttcnagggcntaaannaannnccacnaggnggccntcnttaaggncaaccntgacnncttgaaannggtttcggccaaggaaaccccgnatttgccgcttggattaacaagctgttgtngccgnagaactcaagccntttggaaacaagntaagggacaaattccttggagnacacagcaacttnttcttcanatcgcttggcccaagggtattcttgaaggggatccattnctgaaacaagggctggtgcttggcaacccctaaattaccaccctgaacgggttccangcctaaacncttaaaccggttaagggnccccaantttaaggngacccccaancgccnttttcaaagggtttcccc

SEQ ID NO: 5185 - DNA, 271 bp, Zea mays
  Clone ID: LIB3078-051-Q1-K1-F1
cccacgcgtccggcgccgccttcaagttcgccatcgacaaggacgtcaggaacttccaggtcgtaaaaaaaatgtccaacgagtggccattcttaagggtaaccttgaacctgctgaaaatggttttcgccaagggaaaccccggctttgccggtttgattaacaagctgcttgtggcggaggaactcaagccttttggaaagcagttcagggacaattacttgaagacacagcagcttttcctccaaatcgttgggcacaaggatattct

SEQ ID NO: 5186 - DNA, 196 bp, Zea mays
  Clone ID: LIB36-008-Q1-E1-B4
cccacgcgtccgcccacgcgtccgggccacggaggagtaccgctccgtcgtcgtcaaggagccgcgcttcgttgagtacttcagatcggctacaccggagaccgagtacgggaggatgaacatcggcagccggccagccaagaggacgcccggcagcggcatcacgaccctgcgcgccaccccctgaatcttcccg

SEQ ID NO: 5187 - DNA, 244 bp, Zea mays
  Clone ID: LIB36-007-Q1-E1-G11
aactggtacctggccgtacgtcggactcagggtcgaccacgcgtccgtagacataatgcatatctaaatgcataccaaaagttatctgtctagatatagtgttttttctatgtatccagacataatgcatatctaaatgcataccaaaagttatctgtctagatacatagaaaaaacaatatatctagaaaagccaaagcattttataatttgtaatagagggagtatatgattgcttcagaag

SEQ ID NO: 5188 - DNA, 225 bp, Zea mays
  Clone ID: LIB84-013-Q1-E1-A10
taaagtcactcgggcggacgcgtgggcgccttcaagttcgccatcgacaaggacgtcaggaacttccaggtcctcaaagagatgtacaacgagtggccattcttcagggtcaccctggacctgctggagatggttttcactagaggatagttcggcactggcagattgttcgaccatatgcctgtcgaggcatttgacataccctggaggatgccgctcacggac

SEQ ID NO: 5189 - DNA, 113 bp, Zea mays
  unsure (1)...(113): unsure at all n locations
  Clone ID: LIB84-029-Q1-E1-F12
ttgttgtttgngttttgttttntggtnttttttgttttntgttttgttgttnntgttttttggtgtttttgtgntttntttgnttttnttntgttttgtgttttttnttnttt

SEQ ID NO: 5190 - DNA, 438 bp, Zea mays
  Clone ID: LIB36-002-Q1-E1-G4
gcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggtctggaagacacgctcatcctcaccatgaagggcatcgccgccggcatgcagaacactggctaggcggcttctcttcactcacctgcagagtgcaccgcaataatcagcttccggatggtggcgttttgtcagttt

SEQ ID NO: 5191 - DNA, 448 bp, Zea mays
  Clone ID: LIB36-002-Q1-E1-E9
caagacctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatgggaatgccgaactgg

SEQ ID NO: 5192 - DNA, 449 bp, Zea mays
  Clone ID: LIB36-002-Q1-E1-D11
cgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggactcagaccaggttccaccttcccgtgtggctgggagttggcgccgcctttaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctg

SEQ ID NO: 5193 - DNA, 425 bp, Zea mays
  Clone ID: LIB3060-035-Q1-K1-E11
cttggatgggtggtgaccgcgatggaaatccaagagttaccccggaggtgacgggagatgtatgcttgctggccagaatgatggctgcaaacttgtacatcgatcagattgaagagctgatgtttgagctctctatgtggcgctgcaacgatgagcttcgcgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgac

SEQ ID NO: 5194 - DNA, 434 bp, Zea mays
  Clone ID: LIB3060-003-Q1-K1-E12
ctgtcgtgcatgcatgcagttccttgagccacttgagctgtgctacatatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagcttctgc

SEQ ID NO: 5195 - DNA, 426 bp, Zea mays
  Clone ID: LIB3060-012-Q1-K1-F9
gagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtagagctcctgcagcgcgag

SEQ ID NO: 5196 - DNA, 432 bp, Zea mays
  Clone ID: LIB36-009-Q1-E1-D9
gagttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataagcatcgtacaatctgcatgctgtt

SEQ ID NO: 5197 - DNA, 427 bp, Zea mays
  Clone ID: LIB3078-014-Q1-K1-G9
cgagtggccattcttcagggtcaccctggacctgttggagatggttttcgcgaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatg

SEQ ID NO: 5198 - DNA, 417 bp, Zea mays
  Clone ID: LIB36-003-Q1-E1-G4
caacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaatactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataagcatcgtacaatctgcatgctgttttgtaataattaattaatatccc

SEQ ID NO: 5199 - DNA, 445 bp, Zea mays
  Clone ID: LIB3060-016-Q1-K1-A6
cggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcg

SEQ ID NO: 5200 - DNA, 461 bp, Zea mays
  unsure (1)...(461): unsure at all n locations
  Clone ID: LIB3060-021-Q1-K1-E1
cgagtacttcagatcggctacaccggagaccgagtacgggaggatgaacatcggcagccggccggccaagaggaggcccggcggcggcatcacgaccctgcgcgccatcccctggatcttctcgtggactcagaccaggttccaccttcccgtgtggctgggagtcggcgccgccttcaagttcgccatcgacaaggacgtcaggaacttccaggtcctcaaagagatgtacaacgagtggccattcttcaaggtcaacctggaacctgctgagatggttttcgccaagggagaccccggcattgccggcttgtatgacgagctgcttgtggcggaagaactcaagccctttgggaagcagctcagggacaaatacgtggagacacagcagcttctnctncagatcgctgggcacaaggatattcttgaaagcgatccattcctgaagcaagggcttgtgc

SEQ ID NO: 5201 - DNA, 442 bp, Zea mays
  Clone ID: LIB36-013-Q1-E1-A10
cacgaccctgcgcgccatcccctggatcttctcgtggactcagaccaggttccaccttcccgtgtggctgggagtcggcgccgccttcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcaaggacaaatacgtggagacacagcagcttctcctccagatcgctgggcacaaggatattcttgaaggcgatccattcctgaagcaagggctggtgctgcgcaacccctacatcaccaccctgaacgtgttccaagcctacacgctgaagcggataagggaccccaac

SEQ ID NO: 5202 - DNA, 425 bp, Zea mays
  Clone ID: LIB36-012-Q1-E1-E3
ctcgtggactcagaccaggttccaccttcccgtgtggctgggagtcggcgccgccttcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaagggctggtgctgcgcaacccctacatcaccaccctgaacgtgttccaggcctacacgctgaagcggataaggggacccaacttcaaggtgacgc

SEQ ID NO: 5203 - DNA, 397 bp, Zea mays
  Clone ID: LIB36-003-Q1-E1-B9
atcttctcgtgaactcagaccaggttccaccttcccgtgtggctgggagtcggcgccgccttcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctga

SEQ ID NO: 5204 - DNA, 418 bp, Zea mays
  unsure (1)...(418): unsure at all n locations
  Clone ID: LIB3078-015-Q1-K1-F11
cccacgcgtccgtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataagcatcgtacaatctgcatgctgntttgtaataattaattaatatccc

SEQ ID NO: 5205 - DNA, 392 bp, Zea mays
  Clone ID: LIB189-024-Q1-E1-A11
gcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgtggtcaag

SEQ ID NO: 5206 - DNA, 389 bp, Zea mays
  Clone ID: LIB36-002-Q1-E1-C1
cgtgaactcagaccaggttccaccttcccgtgtggctgggagtcggcgccgccttcaagttcgccatcgacaatgacgtcaggaacttccaggtcctcaaagagatgtacaacgagtggccattcttcagggtcaccctggacctgctggagatggttttcgccaatggagaccccggcattgccggcttgtatgacgagctgcttgtggcggaagaactcaagccctttgggaagcagctcacggacaaatacgtggagacacagcagcttctcctccagatcgctgggcacaatgatattcttgaatgcgatccattcctgaagcaagggctggtgctgcgcaacccctacatcagcaccctgaacgtgttcaggcctacacgctga

SEQ ID NO: 5207 - DNA, 391 bp, Zea mays
  unsure (1)...(391): unsure at all n locations
  Clone ID: LIB3078-056-Q1-K1-B2
ctccgtcgtcgtcaaggaggcgcgcttcgtcgagtacttcagatcggctacaccggagaccgagtacgggaggatgaacatcggcagccggccagccaagaggaggcccggcggcggcatcacgaccctgcgcgccatcccctggatcttctcgtggacccagaccaggttccacctncccgtgtggctgggagtcggcgccgcattcaagttcgccatcgacaaggacgtcaggaacttccaagtcctcaaagagatgtacaacgagtggccattcttcagggtcaccctggacctgctggagatggttttcgccaagggagaccccggcattgccggcttgtatgacgagctgcttgtggcggaaagaactcaagccctttggggaagc

SEQ ID NO: 5208 - DNA, 425 bp, Zea mays
  unsure (1)...(425): unsure at all n locations
  Clone ID: LIB3060-048-Q1-K1-A9
cgtgcgggacgtcaggaacttccaggtcctcatagagatgtacaacgagtggccattgttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcangggctggtgctgcgcaacccctacatcaccaccctgaacgtgttccaggcctacacgctgaagcggataaggaaccccaacttcaaggtgacgccccagccgacgctgtccaaggagttcgccgacgagaacaagcccgncggactggtcaagctgaacccgc

SEQ ID NO: 5209 - DNA, 394 bp, Zea mays
  Clone ID: LIB189-011-Q1-E1-F6
accggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaaaggcatccccgccggcatgcagaaca

SEQ ID NO: 5210 - DNA, 423 bp, Zea mays
  Clone ID: LIB3060-054-Q1-K1-E7
acgccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacattaccaccctgaacgtgttccaggcctacacgctgaagcggataagggaccccaacttcaaggtgacgccccagccgccgatgtccaaggagttcgccgacgagaacaagcccgccggactggtcaagctgaacccggctagcgagtacccgcccggcctggaagacacgctcatcctcaccatg

SEQ ID NO: 5211 - DNA, 426 bp, Zea mays
  Clone ID: LIB3078-016-Q1-K1-C2
acgggaggatgaacatcggcagccggccagccaagaggaggcccggcggcggcatcacggccctgcgcgccatcccctggatcttctcgtggacccagaccaggttccacctccccgtgtggctgggagtcggcgccgcattcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctccttcagatcgctgggcacaaggatattcttgaaggccgaccatttctgaagcaggggctggtgc

SEQ ID NO: 5212 - DNA, 401 bp, Zea mays
  Clone ID: LIB3060-009-Q1-K1-C11
aagagatgtatgcttgctggccagaatgatggctgcaaacttgtacatcgatcagattgaagagctgatgtttgagctctctatgtggcgctgcaacgatgagcttcgtgttcgtgccgaagagctccacagttcgtctggttccaaagttaccaagtattacatagaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcggcgacaaggccatctcggacgggagcctcctgg

SEQ ID NO: 5213 - DNA, 410 bp, Zea mays
  Clone ID: LIB36-003-Q1-E1-F7
accacgcgtccgcctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtaccgcccggcctggaagacacgctcatcctcac

SEQ ID NO: 5214 - DNA, 386 bp, Zea mays
  Clone ID: LIB3060-045-Q1-K1-B2
ccttgagccacttgagctgtgctacaaatcactgtgtgactgcggcgacaaggccatcgcggacgggagccggctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccct

SEQ ID NO: 5215 - DNA, 434 bp, Zea mays
  unsure (1)...(434): unsure at all n locations
  Clone ID: LIB3060-052-Q1-K1-B6
gctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtagagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaggtcatggtcggctactccgactccggcaaggacgccggccgnctgtccgcggcgtggcagctgtacagggcgcangaggagatggcgcangtggccaagcgctacngcgtcaagc

SEQ ID NO: 5216 - DNA, 441 bp, Zea mays
  Clone ID: LIB36-018-Q1-E1-D4
cccacgcgtccggcttcggggaggagcacctgtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggactcagaccaggttccaccttcccgtgtggctgggagtcggcgccgccttttaagttcgccatcgacaaggacgtcaggaacttccaggtcctcaaagagatgtacaacgagtggccattcttc

SEQ ID NO: 5217 - DNA, 369 bp, Zea mays
  Clone ID: LIB189-024-Q1-E1-E3
agacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagt

SEQ ID NO: 5218 - DNA, 506 bp, Zea mays
  Clone ID: LIB36-010-Q1-E1-H4
attggtttgccggacgtaccggtacggtagtctcggcccgcccgtccggttgagcaaaccctacatcaacaccctgaacgtgttccaggcctacacgcagaagcggataagggaccccagcttcaaggtgacgccccagccgacgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctatgcggcttctcttcactcacctgcagagtgcatcgcaataatcaacttccggatggtggcgttttgtcagttttggatggcaatgccgaactggcagcgtctgttttccctatgcagatgtaatttcctgcctcattataatcacgcctgttgtcaagtccaagtggaaaatcttggcatattatacatagtgtaataatcaacatcctacaatctgcatg

SEQ ID NO: 5219 - DNA, 436 bp, Zea mays
  unsure (1)...(436): unsure at all n locations
  Clone ID: LIB3060-012-Q1-K1-B10
gaaatttcagcggaatcgtcatttaccagtatcgaagagttccttgagccacttgaggtgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggtccgaggacaagaagcaagaatggctgctgtccgagctgcgaagcaagcgcccgctgctgcccccggaccttccccagaccgacgagatcgncgacgtcatcggcgcgttccacgtnctcgcggagcttccgcccgacagcttcggcccctacatcatctccatggcgacggccccctcggacgtgc

SEQ ID NO: 5220 - DNA, 399 bp, Zea mays
  Clone ID: LIB3060-019-Q1-K1-G7
ccgggtgatactaggccatgtaagggacaagctgtacaacacacgcgagcgtgctcgccatctgggggcttctggagtttctgaaatttcagcggaatcgtcatttaccagtatcgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcaaggcaagcgcccgttgttgcccccgga

SEQ ID NO: 5221 - DNA, 478 bp, Zea mays
  Clone ID: LIB36-022-Q1-E1-E7
attcgtcagcctgccggcacagtactaggactcgtgggtcgacgcaagcctctacactgactcttaggaaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaggcggcttctcttcactcacctgcaaagtgcaccccataatcagcttccggaatgttgccttttgtca

SEQ ID NO: 5222 - DNA, 357 bp, Zea mays
  Clone ID: LIB3060-021-Q1-K1-C2
tcgctttgcaatctttcgctatataggaaatccaatagttaccccggaggtgacaagagatgtatgcgtgctggccagaatgatggctgcaaacttgtacatcgatcagattgaagagctgatgtttgagctctatatgtggcgctgcaacgatgagcttcgtgttcgtgccgaagagctccacagttcgtctggttccaaagttaccaagtattacatagaattctggaagcaaattccttcaaacgagccctaccgggtgatactaggccatgtaagggacaagctgtacaacacacgctagcgtgctcgccatctgctggcttctggagtttctgaaatttcagcggaatcgtc

SEQ ID NO: 5223 - DNA, 421 bp, Zea mays
  Clone ID: LIB3060-053-Q1-K1-D6
gttccttgagccacttgagctgtgctacaaatcactgtgtgactgcggcgacaaggccatcgcggacgggagcctcctggacctactgcgccaggtgttcacgttcgggctctccctggtgaagctggacatccggcaggagtcggagcggcacaccgacgtgatcgacgccatcaccacgcacctcggcatcgggtcgtaccgcgagtggtccgaagacaagaggcaggagtggctgctgtcggagctgcgaggcaagcgcccgctgctgcccccggaccttacccagaccgacgagatcggcgacgtcatcagcgcgttccacgtcctcgcggagctcccgcccgacagcttcgggccctacatgatctgcatggcgacggccccctcggacgtgctcggcgtagagctcctgcagcgc

SEQ ID NO: 5224 - DNA, 484 bp, Zea mays
  unsure (1)...(484): unsure at all n locations
  Clone ID: LIB189-006-Q1-E1-D4
cgttgagaaacgtcacctgcaggtaggcgtctacaattcaagggccgaccgacccgtccacggacgagtgggcggacgcgtgggcggacgcgtgggcttcccgtgtggctgggagtcggcgccgccttcaagttcgccatcgacaaggacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaagggctggtgctgcgcaacncctacnatcacaccctgaacgtgttccaggcctacacgctgaagcggataagggaccccaact

SEQ ID NO: 5225 - DNA, 382 bp, Zea mays
  Clone ID: LIB3060-011-Q1-K1-A5
cgaagagttccttgagccacttgagctgtgctacaaatcactgtgtgactgcggcgacaaggccatcgcggacgggagcctcctggacctcctgcgccaggtgttcacgttcgggctctccctggtgaagctggacatccggcaggagtcggagcggcacaccgacgtgatcgacgccatcaccacgcacctcggcatcgggtcgtaccgcgagtggcccgaggacaagaggcaggagtggctgctgtcggagctgcgaagcaagcgcccgctgctgcccccggaccttccccagaccgacgagatcgccgacgtcatcggcgcgttccacgtactcgcggagctccctgccgacagcttcggcccctacatcatctgcatg

SEQ ID NO: 5226 - DNA, 355 bp, Zea mays
  Clone ID: LIB189-022-Q1-E1-H8
acgaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggct

SEQ ID NO: 5227 - DNA, 387 bp, Zea mays
  Clone ID: LIB3061-017-Q1-K1-E11
cacgcaccttgccatcctgtcccagacgccggacaccatcaacgggtccatgcgtgtgacggtgcagggcgaggtcatcgagttctgcttcggggaggagcacctgtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatgccctggatcttctc

SEQ ID NO: 5228 - DNA, 454 bp, Zea mays
  Clone ID: LIB83-002-Q1-E1-E1
cactgtcaactagcggcgcagtgaccgagactagcgggtcgacgcaagcctctagactaactcctagtagccgaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctaagcggcttctcttcactcac

SEQ ID NO: 5229 - DNA, 473 bp, Zea mays
  unsure (1)...(473): unsure at all n locations
  Clone ID: LIB3060-020-Q1-K1-C10
aggtnttttagacgtgagtgtgacctagtctccagtcgtatctcgtcaccgctntgaattcccgggtggcgctgcaacgatgagcttggcgttcgtgccgaagagctccacagttcgtctggttccaaagttaccaagtattacatagaattgtggaagcaaattcctgcaaacgagccctaccgggtgatactaggccatgtaagggacaagctgtacaacacacgcgagcgtgctcgccatctgctggcatctggagtttctgaaatttcagcggaatcgtcatttaccagtatcgaagagttccttgagccacttgagctgtgctacaaatcactgtgtgactgcggcgacaaggccatcgcggacgggagcctnctggacctnctgcgccaggtgttcacgttcgggctctccctggtgaagctggacatccggcaggagtcggagcggaacaccgacgtgatcgacgc

SEQ ID NO: 5230 - DNA, 382 bp, Zea mays
  unsure (1)...(382): unsure at all n locations
  Clone ID: LIB3060-041-Q1-K1-G7
cggagctgcgaggcaagcgcccgctgctgcccccggaccttccccagaccgacgagggcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctcttctcggtggactggtacatggaccggatcaagggcaagcagcaagtcatggtcggctactccgactccggcaaggacgccggccgnctgtccgcggcgtggcagctgtacag

SEQ ID NO: 5231 - DNA, 318 bp, Zea mays
  Clone ID: LIB189-016-Q1-E1-C1
aaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctc

SEQ ID NO: 5232 - DNA, 412 bp, Zea mays
  Clone ID: LIB189-031-Q1-E1-H11
cggacgcgtgggcggacgcgtggggggagaccccggcattgccggcttgtatgacgagctgcttgtggcggaagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaaaccggcgaaacaatttaccccccgggcctggaagacacgctcatcctcaccatgaagggcatcgccg

SEQ ID NO: 5233 - DNA, 370 bp, Zea mays
  Clone ID: LIB189-028-Q1-E1-B6
acagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaagggcatcgccgccggcatgcagaacactggctacgcggcttctcttcactcacctgcagagtgcaccgc

SEQ ID NO: 5234 - DNA, 400 bp, Zea mays
  Clone ID: LIB36-019-Q1-E1-A5
aagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtactcgcccggcctggaagacacgctcatccctcacatgacaggcatcgccgccggcatgcaaaacactggctaggcggcttctcttcactcacctgcatagtgcaccgcaat

SEQ ID NO: 5235 - DNA, 271 bp, Zea mays
  Clone ID: LIB3060-023-Q1-K1-G11
gggaggagcacctgtgcttccagactctgcatcgcttcacggccgccacgctggagcacggcatgcacccgccggtctctcccaagcccgagtggcgcaagctcatggacgagatggcggtcgtggccacggaggagtaccgctcggtcgtcgtcaaggagccgcgcttcgtcgagtacttcagatcggctacaccggagaccgagtacgggaggatgaacatcggcagccggccagccaagaggaggcccggcggcggcatcacgaccct

SEQ ID NO: 5236 - DNA, 391 bp, Zea mays
  Clone ID: LIB36-018-Q1-E1-A4
cgcctcttctcggtggactggtacatggaccggatcaagggcaagcagcaggtcatggtcggctactccgactccggcaaggacgccggccgcctgtccgcggcgtggcagctgtacagggcgcaggaggagatggcgcaggtggccaagcgctacggcgtcaagctcaccttgttccacggccgcggaggcaccgtgggcaggggtggcgggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacgggcgccacgccggagcacggcatgcacccgccggtcctctcca

SEQ ID NO: 5237 - DNA, 405 bp, Zea mays
  unsure (1)...(405): unsure at all n locations
  Clone ID: LIB3060-008-Q1-K1-B10
gtccatccaatgggctgggatattaattaattattacaaaacagcatgcagattgtacgatgtttattattacaatatgtataatatgccaagattttccacttggacttgacaacaagagtgaatataaagaggcaggaaattacatatgcatagggaaaacagacgctgccagttcggcatttccatccaaaactgacaaaacgccaccatccggaagctgattattgcggtgcactctgcaggtgagtgaagagaagccgcctagccagtgttctgcatgccggcggcgatgcccttcatggtgaggatgaancgtgtctttcaagcccggggcgggtactcgctttgccgggttcagcttgaccagtnccggggggcttgttnttgtcggggnaacttcta

SEQ ID NO: 5238 - DNA, 420 bp, Zea mays
  unsure (1)...(420): unsure at all n locations
  Clone ID: LIB83-009-Q1-E1-A11
ggcantgtgngtcngtgngncnngctgcttgtgagcggcagaactcaagccctttgggaagcagctcagggacaaatacgtggagacacagcagcttctcctccagatcgctgggcacaaggatattcttgaaggcgatccattcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgaagcgagtacccgcccggcctggaagacacgctcatcctcaacaanaaagggatccnccncccggnantcnaaaaacactggcctagggggtttctcttca

SEQ ID NO: 5239 - DNA, 371 bp, Zea mays
  Clone ID: LIB189-002-Q1-E1-B7
agcccacgcgtccgcggacgcgtgggcggacgcgtgggcggacgcgtgggggagcacctgtgcttcgagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggaggcgcgcttcgtcgagtacttcagatcggctacaccggagaccgagtacgggaggatgaacatcggcagccggccagccaagatgaggcccggcggcggcatcacgaccctgcgcgccatcccctggatcttctcgtggacccagaccaggttccactccccgtg

SEQ ID NO: 5240 - DNA, 343 bp, Zea mays
  unsure (1)...(343): unsure at all n locations
  Clone ID: LIB3060-045-Q1-K1-B1
cttcgtgttcgtgccgaagagctccacagttcgtctggttccaaagttaccaagtaggacatagaattctggaagcaaattcctccaaacgagccctaccgggtgatactaggccatgtaagggacaagctgtacaacacacgcgagcgtgctcgccatctgctggcttctggagtttctgaaatttcagcggaatcgtcatttaccagtatcgaagagttccttgagccacttgagctgtgctacaaatcactgtgtgactgcngcgacaaggccatcgcggacgggagcctnctggacctnctgcgccaggttgttcacgttcggggctcttccctggtga

SEQ ID NO: 5241 - DNA, 366 bp, Zea mays
  Clone ID: LIB36-007-Q1-E1-A11
aacggttccctggcgtagccgtcggagtccaggtcgaccacgcgtccgccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcagatcggctacaccggagaccgagtacgggaggatgaacatcggcagccggccagccaagaggaggcccggcggcggcatcacgaccctgcgcgccatcccctggatcttctcgtggactcagaccaggttccaccttcccgtgtggctgggagt

SEQ ID NO: 5242 - DNA, 352 bp, Zea mays
  Clone ID: LIB36-006-Q1-E1-D3
cacacgcgtccgcccacgcgtccgggcaggagtggctgctgtcggagctgcgaggcaagcgcccgctgctgcccccggaccttccccagaccgacgagatcgccgacgtcatcggcgcgttccacgtcctcgcggagctcccgcccgacagcttcggcccctacatcatctccatggcgacggccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctcttctccgtggactgggacatggaccgggttaaggggaaggc

SEQ ID NO: 5243 - DNA, 425 bp, Zea mays
  Clone ID: LIB36-002-Q1-E1-E7
aatcgtatgcctgcgctacggtaggtatccgggccgaccacgcgtccacccaagcgtccgcggacgcgtgggcgctgaagcggataagggaccccaacttcaaggtgacgccccagccgccgctgtccaaggagttcgccgacgagaacaagcccgccggactggtcaagctgaacccggcgagctagtacacgcccggtctggaagacacgctcatcctcaccatgaaaggcatcgccgccggcatgcagaacactggctaggcggcttctcttcactcagctgcagagtgcaccgcaataatcagcttccggatggtggagttttgtcaattttggatggaaatgccgaactggcaacgtccgttttccctatgcataagtaatttcctgcctctttatattcacgcttgttgtcaagtccac

SEQ ID NO: 5244 - DNA, 353 bp, Zea mays
  Clone ID: LIB36-012-Q1-E1-F6
gcgatagactcctgaagcaggggctggtgctgcgcaacccctacatcaccaccctgaacgtgttccaggcctacacgctgaagcggataagggaccccaacttcaaggtgacgccccagccgccgctgtccaaggagttcgccgacgagaacaagcccgccggactggtcaagctgaacccggcgagcgagtacccgcccggcctggaagacacgctcatcctcaccatgaatggcatcgccgccggcatgcagaacactggctaggcggcttctcttcactcacctgcagagtgcaccgcaataatcagcttccgggatgtggcgttttgtcagttttggatggaaatgccg

SEQ ID NO: 5245 - DNA, 411 bp, Zea mays
  Clone ID: LIB189-032-Q1-E1-E4
ggtatgcgaaacgtcacctggcgcgaccggtcgcacatatcgggtccacgcacgcgtccgcacacacgtccgcggacgcgtgggcgaaaaggccatcgcggacgggagcctccttgacctccggggcaaggtgttcacgttcgggctctccctgttgaagctggacatcgggcaggagtctgaccggaacaccgacgtgatcgacgccatcacaacgcacctcggcatcgggtcgtaccgcgagtggcccgaggacaagaggcaagagtggctgctgtcggagctgcgaggcaagcgcccgctgctgcccccggaccttccccagaccgacgagatcgccgacgtcatcggcgcgttccacgtcctcgcggagctcccgcccgacaagcttccgccctacatcatctccat

SEQ ID NO: 5246 - DNA, 373 bp, Zea mays
  Clone ID: LIB36-018-Q1-E1-H1
tcctgaagcacgggctggtgctgcgcaacccctacatcaccaccctgaacgtgttccaggcctacacgctgaagcggataagggaccccagcttcaaggtgacgccccagccgccgctgtccaaagagttcgccgacgagaacaagcccgccggactggtcaagctgaacccggcgagcgagtacccgcccggcctggaagacacgctcatcctcaccatgaaaggcatcgccgccggcatgcagaaaactggctaggcggcttctcctcagtcacctgcacagtgcagggcagtagccagcttccggatggtggcgttttgtcagttttgggtgcgaatgggcaaggggcagcgtccggattccccaggcat

SEQ ID NO: 5247 - DNA, 431 bp, Zea mays
  Clone ID: LIB3078-023-Q1-K1-H1
cccacgcgtccggttctagatcgcgagcgccgcccttttttttttttttttttttttttgggtttgttttttttttttttttttttaaacaagtccatccaatgggctgggatattaattaattattacaaaacagcatgcaaattgtaccatgcttattattacaatatgtataatatgccaagattttccacttggacttgacaaccagagtgaattttaagaggccggaaattacatttgcatagggaaaacagacgcttccagttcggcatttccatccaaaactgacaaaacgccaccattcggaagctgattattgcggggcactctgcaggtgagtgaaaagaagcccgctatccagggttctgcatgccggccgggatgcccttcatggtgaggatgaacctgtcttccaagccgggcgggta

SEQ ID NO: 5248 - DNA, 231 bp, Zea mays
  Clone ID: LIB3060-019-Q1-K1-E7
ctcagagcaggttccaccttcccgtgtggctttgagtcggcgccgcctttaagttggccatctgcaacgacgtcaggaacttccaggtcctcaaagagatgtacaacgagtggccattcttcagggtcaccctggacctgctggagatggttttcgccaagggagaccccggcattgccggcttgtatgacgagctgcttgtggcggaagaactcaagccctttgggaagc

SEQ ID NO: 5249 - DNA, 264 bp, Zea mays
  Clone ID: LIB3060-042-Q1-K1-E5
cgcgaggcaagcgcccgctgctgcccccggaccttccccagaccgacgagatcgccgacgtcatgggcgcgttccacgtcctcgcggagctcccgcccgacagcttcggcccctacatcatctccatggcgactgccccctcggacgtgctcgccgtggagctcctgcagcgcgagtgcggcgtgcgccagccgctgcccgtggtgccgctgttcgagaggctggccgacctgcagtcggcgcccgcgtccgtggagcgcctct

SEQ ID NO: 5250 - DNA, 178 bp, Zea mays
  Clone ID: LIB3060-019-Q1-K1-B3
gcttcggggaggagcacctgtgcttccagactctgcagcgcttcacggccgccacgctggagcgcggcatgcacccgccggtctctcccaagcccgagtggcgcaagctcatggacgagatggcggtcgtggccacggaggagtaccgctcggtcgtcgtcaaggagccgcgcttcgt

SEQ ID NO: 5251 - DNA, 283 bp, Zea mays
  Clone ID: LIB36-009-Q1-E1-D2
ggcccacgcaccttgccatcctgtcccagccgccggacaccatcaacgggtccatccgtgtgacggtgcagggcgaggtcatcgagttctgcttcggggaggagcacctgtgcttccagactctgcagcgcttcacggccgccacgctggagcacggcatgcacccgccggtctctcccaagcccgagtggcgcaagctcatggacgagatggcggtcgtggccacggaggagtaccgctccgtcgtcgtcaaggagccgcgcttcgtcgagtacttcagatc

SEQ ID NO: 5252 - DNA, 435 bp, Zea mays
  unsure (1)...(435): unsure at all n locations
  Clone ID: LIB189-009-Q1-E1-G7
acggacgcgtgggctggctaggcggcttctcttcactcacctgcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtagttcgccgacgagaacaagcccgccggactggtcaagctgaacccggcgagcgagtacccgcccggcctggaagacacgctcatcctcaccatgaagggcatcgccgccggcatgcagaacactggctacgcggcttctcttcactcacctgcagagtgcaccgcaataatcagcttccggatggtggcgtattgtcagttttggatggaaatgccgaactggcagcgtctgtnttccctatgcatatg

SEQ ID NO: 5253 - DNA, 232 bp, Zea mays
  Clone ID: LIB83-007-Q1-E1-G12
gcagagtgcaccgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataagcatcgtacaatctgcatgctgttttgtaataattaattaatatcccagccc

SEQ ID NO: 5254 - DNA, 292 bp, Zea mays
  Clone ID: LIB36-007-Q1-E1-G7
cgcaataatcagcttccggatggtggcgttttgtcagttttggatggaaatgccgaactggcagcgtctgttttccctatgcatatgtaatttcctgcctctttatattcactcttgttgtcaagtccaagtggaaaatcttggcatattatacatattgtaataataagcatcgtacaatctgcatgctgttttgtaataattaattaatatcccagcccattggatggacttgtttaataaaaaaaaaaaagataaaatgcataaaaaaagagaagaataaagttaaaaa

SEQ ID NO: 5255 - DNA, 268 bp, Zea mays
  Clone ID: LIB3060-004-Q1-K1-C8
tcgcgtcatttaccagtatcgaagagttccttgagccacttgagctgtgctacaaatcactgtgtgactgcggcgacaaggccatcgcggacgggagcctcctggaccttctgcgccaggtgttcacgttcggtctctccctggtgaagctggacatactgcatgagtctgagcggtacaccgacgtgatcgacgccatcatcacgcacctcggcatggggtcgtaccgcgagtggcccgagggcgagatgcaggagtggctgctgtc

SEQ ID NO: 5256 - DNA, 381 bp, Zea mays
  Clone ID: LIB3060-026-Q1-K1-C11
gcaagccttccggccagggcaaggcaatcaagtccggtttcgtgaaggaacacctgtgcttccaaacggtggggggcttcacggccgccacgctgaaccacggcatgcacccgccggtctttcccaagcccaactggcgcaagctcatggacgagatggcggtcgtggccacggaggagtcccgctcggtcatcgtcaaggagccgcgcttcgtcgagtacttcagatcggctacaccggagaccgagtacgggaggatgaacatcagcagccggacagccaagaggaggcccggcggcggcatcacgaccctgcgcgccatcccctggatcatctcgtggactcagaccaggttccaccttcccgtgtggctgggagtcg

SEQ ID NO: 5257 - DNA, 260 bp, Zea mays
  unsure (1)...(260): unsure at all n locations
  Clone ID: LIB3060-022-Q1-K1-G9
cccccggactcttccccagactcgactgagatcgctcgaccgtcatcggcgccgttccacgtcgctcgcggagcctcccgcccgacagtcttcggcctcctacatcatnnctccatggcgactggccccctcggaccgtgctcgccgtggagcctcctggcagcgcgagtgccggcgtgcgccatgccgctgctccgtggtgccccgctgttcgagaaggctggccgaccatgcagtcggcagcccgcgtncgtggaagc

SEQ ID NO: 5258 - DNA, 338 bp, Zea mays
  unsure (1)...(338): unsure at all n locations
  Clone ID: LIB189-029-Q1-E1-C4
atcaacgggtcaatccgtgtgacggtgcagggcgaggtcatcgagttctgcttcggggaggagcacctgtgcttccagactctgcagcgcttcacggccgccacgctggagcacggcatgcacccgccggtctctccaaaccccgagtggcgcaagctcatggacgagatggccgtcgtgggcacggaggagtaccgctcggtcgtcgtcaaggagccgcgcttcgtcgagtacttcagatcggctacaccgggagaacgatttccggaaggatgaacatcngcagccggccaagcaaagaggaggcccggcggcggcatcacgaccctgcgcgccat

SEQ ID NO: 5259 - DNA, 324 bp, Zea mays
  unsure (1)...(324): unsure at all n locations
  Clone ID: LIB3060-019-Q1-K1-E3
cgtatgatgccttgagatctattttcttttacacgccaagtatagtactgactcaccgttcttgaactaccgactcgagccacgcgtcctctcatgccatgttccaccttcctttgtggctttaagtcggcgccgactttaagttggccatcgagaatgacgtcaagaacttccaggtcctcaaagagatgtacaacgagtggccattcttcaaggtcaccctggacctgctcgagatggttctcgccaaaggagaccccgacattgccggcttgtatgacgagctgcttgttgcggaagaactcaagcnctttgggaagcagc

SEQ ID NO: 5260 - DNA, 267 bp, Zea mays
  Clone ID: LIB36-004-Q1-E1-E2
tcttcactcacatgcagagtgcaccgcaataatcagcttccggatggtggcgttttgtcagttttggatggaaatgcccaactggcagcctctgttttccctatgcatatgtaatttcctgcctctttatattcactcttgttgtcaattccaagtggaaaatcttggcatattatacatattgtgataataaacatcgttaaatctgcatgctgttttgtaataaataattaacatcccagtccattggatggacatgtttaaaaa

SEQ ID NO: 5261 - DNA, 134 bp, Zea mays
  Clone ID: LIB83-005-Q1-E1-A6
atcactcttgttgtcaagtccaagtggaaaatcttggcatattatacatattgtaataataagcatcgtacaatctgcatgctgttttgtaataattaattaatatcccagcccattggatggacttgtttacc

SEQ ID NO: 5262 - DNA, 256 bp, Zea mays
  unsure (1)...(256): unsure at all n locations
  Clone ID: LIB84-026-Q1-E1-F1
gtgaaccggcaagtaccgggtgtagaagtcccggctcgancgacgcgatcgaggtcgggcatgcggaactaacatcgtctgttttccctaaggatagagtgatttcctgcctctttatattcactcttgttgtcaagtccaagtggaaaatcttggcatatgggacatattgtaataataagcatcgtacaatctagatgctgttttgtaataattaattaatatcccagcccattggatggaggtgtttaccaac

SEQ ID NO: 5263 - DNA, 91 bp, Zea mays
  Clone ID: LIB84-014-Q1-E1-A8
cactcttgttgtcaagtccaagtggaaaatcttggcatattatacatattgtaataataaacatcgtacaatctgcatgctgttttgtaat

SEQ ID NO: 5264 - DNA, 139 bp, Zea mays
  Clone ID: LIB36-021-Q1-E1-H5
tcctgtcacacaagcaggcacaagacctaaactcacgggttgacacaagcgtccacacacacgttctggtaataataagcatcgtacaatctgcatgctgttttgtaataattaattaatatcccagcccattggatgg

SEQ ID NO: 5265 - DNA, 466 bp, Zea mays
  Clone ID: LIB3060-041-Q1-K1-A12
gcagatcgcgcaccgccgccgcaacagcaaactcaagaaaggtggcttcgccgacgaaggctcggccaccaccgagtccgacatcgaggagacgctcaagcgcctcgtgtccgaggtcggcaagtcccccgaggaggtgttcgaggcgctcaagaaccagaccgtcgacctcgtcttcaccgcgcatcccacgcagtccgcccgccgctcgctcctgcagaaaaacgcgaggatccggaattgtctgacccagctgaatcccaaggacatcactgacgacgacaagcaggagctcgatgaggctctgcagagagagatccaagcagccttcagaactgatgaaatcaggagggcacaacccaccccacaggacgaaatgcgctatgggatgagctacatccatgagactgtatggaagggcgtgcctaagttcttgcgccgtgtggatacagccctgaagaatatc

SEQ ID NO: 5266 - DNA, 440 bp, Zea mays
  unsure (1)...(440): unsure at all n locations
  Clone ID: LIB3060-007-Q1-K1-C8
agcacgagcagcacgccgtgccgctccaaccgtctcgcttccctgcttagcttcccgccgcgccatggcgtcgaccaaggcacccggccccggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtctcggccgactacgagggcaaaggagacacgacgaagctgggcgagctcggcgccaagctcacggggctggcccccgccgacgccatcctcgtggcgagctccatcctgcacatgctcaacctcgccaacctggccgaggaggtgcagatcgcgcaccgncgncgcaacagcaagc

SEQ ID NO: 5267 - DNA, 413 bp, Zea mays
  unsure (1)...(413): unsure at all n locations
  Clone ID: LIB3060-014-Q1-K1-D4
gcagcacgtcgtgccgctccaaccatctcgcttccgtgcttagcttcccgccgcgccggggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggngctggcccctgccgacgccatcctcgtggcgagctccatcctgcacatgctcaacctcgccaacctggccgaggaggtgcagatcgcgca

SEQ ID NO: 5268 - DNA, 388 bp, Zea mays
  Clone ID: LIB3060-029-Q1-K1-H6
cgcagcagcacgagcagcacgtcgtgccgctccaaccatctcgcttccgtgcttaggttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctc

SEQ ID NO: 5269 - DNA, 449 bp, Zea mays
  unsure (1)...(449): unsure at all n locations
  Clone ID: LIB3060-011-Q1-K1-G8
gcagcagcacgagcagcacgtcgtgccgctccaaccatctcgcttccgtgcttagctgcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgncgncgcaacagcaaactcaa

SEQ ID NO: 5270 - DNA, 431 bp, Zea mays
  Clone ID: LIB3060-007-Q1-K1-E2
cgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccggc

SEQ ID NO: 5271 - DNA, 445 bp, Zea mays
  unsure (1)...(445): unsure at all n locations
  Clone ID: LIB3060-003-Q1-K1-E9
cccccgaggaggtgttnctngcgctnaagantnagaccgtcggacctcgtctttaccgcgcatggccacgcagtgcgcccgccgntcgntcctgcanaaaaacgccnggatccggaatngnctgacccagctgaatgccaaggacatcactgacgaccatnannaggagctnnatgaggnttngcnnagagagatccangcanncttcagaaccgatgaaatcagganggcacaacccaccccgnaggacgaaatgcgctatggnatgagctacatncatgagactgtatggaagggcgtgcctaagntcttgcgccgtgtggatacagccctgaagaatatcggcatcaatgagcgccttcctacaatgattctctcattcggntctctncttggatgggtggtgaccgtgatggaaatccaagaggtaccccggaggngacaa

SEQ ID NO: 5272 - DNA, 304 bp, Zea mays
  unsure (1)...(304): unsure at all n locations
  Clone ID: LIB3060-026-Q1-K1-H9
gaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgncgccgcaacagcaaactcaagaaaggtggcttcgccgacgaaggctccgccaccaccgagtccgacatcgaggagacgctcaagcgcctcgtgtccgaggtcggcaagtcccccgaggaggtgttcgaggcgctcaaga

SEQ ID NO: 5273 - DNA, 274 bp, Zea mays
  Clone ID: LIB3060-020-Q1-K1-F11
catcgcagcagcacgagcagcacgccgtgccgctccaaccgtctcgcttccctgcttagcttccggccgcgccatggcgtcgaccaaggcacccggccccggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctacgaggtc

SEQ ID NO: 5274 - DNA, 354 bp, Zea mays
  Clone ID: LIB3067-017-Q1-K1-H10
gattggcattcctccgcgaccactgaggtgaaccatgaagagacaaaagagctactgggtcatgttgctggtcacaaggacgtccttgaaggtgatccttatctgaagcagcgtctgcggctgcgtgagtcctacatcaccactctgaacgtgtgccaggcctacaccctgaagcggatacgcgacccgagctttcaggtgagcccgcagcctgccctgtccaaggagttcaccgacgagagtcagccggcggagctggtgcaactgaaccagcagagcgagtacgcttcaggcctggaggacaccctcattctgaccatgaagggcatctactgcggcatgcagaacaccggc

SEQ ID NO: 5275 - DNA, 318 bp, Zea mays
  Clone ID: LIB3067-036-Q1-K1-C4
gagcccgcagccgcccctgtccaatgagtttatcgactagagtcagccggcggatctggtgcagctgaaccagcagagcgagtacgctccaggcctggaggacaccctgatcctgaccatgaagggcatcgtcgtcggcatgcagaacaccggctaggccaagaattattgtgtgcagataacctgtcttccatgagacggttgacgatatgtgtaggcctgtgagcagttagtacaccgtggccagtgtgttctggaggatttgtcatgtcagaagccttctcttgtgtgcttgctgtagatgccaaggggagctta

SEQ ID NO: 5276 - DNA, 399 bp, Zea mays
  Clone ID: LIB3069-056-Q1-K1-C9
cggacgcgtgggagaagttgtgaactttgcatcagcatgaggtctggagtctagacacagcgtggcaaactgaggtttaatcatcttagcaactacggtacgtgaccctgagcgcgtgattgttgcgaaacaacgaccacctcggtctacaccttaaaggtttgcgcgacatggcttttcatagtgctcaattggatctatcccctgagcataggagaaaagtatcaatttgtacagtggatccaagtattctataaagcatgcatcctccaatttcccacaagcgagaatggcatgatatgatggatgaaatggctgttgcggtcaattgtctttcaaggatcaattgtctttcaagaaccacactttgtattggtttgtgtgcagttcaagctctac

SEQ ID NO: 5277 - DNA, 415 bp, Zea mays
  Clone ID: LIB36-004-Q1-E1-E1
cggacgcgtggaggacgcgtgggcggacgcgtgggcgattgttaattgttgatggtaaagaagttgtgaactttgcatcagcatgaggtctggagtctagacacagcgttgcaaactgaggtttaatcatcttagcaactacggtacgtgaccctgagcgcgtgattgttgcgaaacaacgaccacctcggtctacaccttaaaggtttgcgcgacatggcttttcatagtgctcaattggatctatcccctgagcataggagaaaagtatcaatttgtacagtggatccaagtattctataaagcatgcatcctccaatttcccacaagcgagaatgggatgatatgatggatgaaatggctgttgcggtcaattgtctttcaaggatcaattgtctttcaagaaccacacttt

SEQ ID NO: 5278 - DNA, 393 bp, Zea mays
  Clone ID: LIB3067-044-Q1-K1-F10
ggcgaagtcattgagtagtctttcggattggatcatttgtgctttaggacactgcaacgtttcacggctgcgacccttgaacatggtatgcaccctccaatttcgccgaaaccagaatggcgtgctttgatggatgagatggctatcgtcgccacaaaggaataccggtcaatcgtatttgaggaaccgcgctttgttgaatatttccgccttgcaacgccagagatggagtatggcaggatgaacatcggaagcaggccatcgaaaagaaagccgagtgcgggcatcgagtcgctgcgcgcaatcccttggatcttcgcttggacgcagactcggttccaccttgccgtgtggctgggtttcggcgcggcgttcaagcatgtcttggacaag

SEQ ID NO: 5279 - DNA, 440 bp, Zea mays
  Clone ID: LIB3059-005-Q1-K1-A6
ctttaggacactgcaacgtttcacggctgctaccctggagcatggcatgcacccaccaaatgcaccaaagccagaatggcgagcccttcttgatgagatggcagttgtggcaactgaggaatatcggtccattgtcttcaaagagccacgctttgtcgagtatttccgccttgcaacccctgaaacagagtatggtaggatgaacataggaagcaggccatccaagagaaagccgagcggaggtatcgactcactccgagcaatcccatggatctttgcttggacacaaacgcggttccacctcccggtctggctaggatttggagccgcattcaagaatgtcctccagaaggacatcaggaacctccacatgctccaggaaatgtacaatgagtggccatttttcaaggtgactattgatctggtggagatggtgttcg

SEQ ID NO: 5280 - DNA, 337 bp, Zea mays
  Clone ID: LIB3060-051-Q1-K1-H4
gtgaacgttctcgtcatctattgacatctggaatttctgagattccagaggaggcaacttttactaacgttgaacagtttctggaacctcttgagctatgttatagatcattatgtgcttgtggtgacaaacctatagctgacggaagtcttcttgatttcttgcgtcaagtatcaacttttggtcttgcacttgtgaagcttgacatcaggcaggaatctgatcgacacacagatgtccttgattcgataacgacacatcttggaattggctcctatgctgaatggtctgaagagaaacgccaggattggttggtgtctgaacttgagggcaaacg

SEQ ID NO: 5281 - DNA, 422 bp, Zea mays
  unsure (1)...(422): unsure at all n locations
  Clone ID: LIB3059-014-Q1-K1-E8
cagggatcttctggaaggtgacctctacctgaagcagcggctccgcctgcgtgagtggtacatcaccaccctgagcgtctgccaggcctacaccctgaagcggatccgtgacccggactaccatgtcgcgctgcgcccccacctctccaaggagatcatggactcgaccaaggctgcggcggagctggtgaagctgaaccctggcagcgaatacgcaccggggctggaggacaccctcatcctgaccatgaagggcatagcagccggcctccagaacaccggttaaaccacgaagaggggatcttttttctcctcctgatcattggctctaggtccttcgtattttcgcggattgtaacttcggccacctctctacaccgtgaggaaataatggtggtttctgcanaagtggtggtaaataa

SEQ ID NO: 5282 - DNA, 379 bp, Zea mays
  Clone ID: LIB3069-044-Q1-K1-F2
ggatgccggtcgtttctctgctgcttggcttctttacaaggctcaagaggagctcattaatgtcgctaagctgtatggggttaagctaaccatgttccacggacgaggcggaactgtgggaagaggtgggggccctacccatcttgctatactgtcacagcctccagaaaccatccatggatcacttagggtaaccgttcaaggcgaagtgattgagcaatctttcggagaggagcatttgtgctttaggacactgcagcgtttcacggctgcgacccttgaacatggtatgcacccttcaatttcgccgaaaccagaatggcgtgctttgatggatgagatggctatcgtcgccacaaaggaataccggtcaatcgta

SEQ ID NO: 5283 - DNA, 274 bp, Glycine max
  unsure (1)...(274): unsure at all n locations
  Clone ID: 700564927H1
aattttggaaagncattcctccanatgaancatatccgtgtgctactgggtgaagtaaggaataggcnttaccagactcgtgaacgntcacgccatttgctagctcacggatactctgacattccagaggaagagacttttacaatgttgangagttctggaaccccttgaactctgttacagatcactctgtgcttgtggcgatcgtgtcaatgncgatggaagccttctagatttctgagacaagtctctatntcggactctccctagtgag

SEQ ID NO: 5284 - DNA, 283 bp, Glycine max
  unsure (1)...(283): unsure at all n locations
  Clone ID: 700567858H1
ggtacagagaccgtatcaatgggcgcccaagaagttatgatagggtactcggactcgggaaaagatgctgntcgtttctctgcagcatgggcactatacaaggctcaagnagagctcataaaggttgcaaaagagtttggtgttaagctcactctgttccatggcagaggaggnactgtgggaagaggaggaggtcccactcatcttgctatattatctcagccaccggatactattcatggctcacttcnggtaacagtgcaaggtgaagttattgaacagt

SEQ ID NO: 5285 - DNA, 318 bp, Glycine max
  unsure (1)...(318): unsure at all n locations
  Clone ID: 700648673H1
gccttcttgatttcatgagacaagtctcncgtctggactgtcactagtgaggcttgatatcaggcaagantcagantcgtcacactgatgtgctggatgccattaccaaacacttggaaattggctcgtaccaggaatggtctgaagagaaaagacaggaatggttgttgtctgagttaagtggcnaaaggcctctatttggacctgaccttcctcaaactgaagaaattagagatgttttggacacatttcatgtcatagcagaactaccaccagacaatttggagcctatatcatanaatggcaactgcaccatct

SEQ ID NO: 5286 - DNA, 269 bp, Glycine max
  Clone ID: 700659068H1
aatgcaggccacacctgagttggagtacgggaggatgaacattggaagtacgaccagcaaagaggaggccaagtggaggtattgagacactccgtgccataccttggatctttgcctggacacaaacaaggttccatcttccagtgtggctaggctttggtgcagcattcaaacatgttattgagaaggatgttaggaatattcatgtgctgcaggagatgtacaatcaatggcctttctttagggtcactattgatttagtggaaatg

SEQ ID NO: 5287 - DNA, 245 bp, Glycine max
  unsure (1)...(245): unsure at all n locations
  Clone ID: 700728930H1
gtcctggggaatgttaaggataagcttgagaaaagtcgtagacggttagaaattcttcttgaggatgttgcatgtgactatgatcctttggattactatgaaacatctgatcagcttttggaacctctnctcctctgttatgaatctctgcaatcgtgtggatctggggtgctagctgatggtcgacttgctgatctgattcgtagagttgctacctttggaatggtgttaatgaagcttgactt

SEQ ID NO: 5288 - DNA, 260 bp, Glycine max
  Clone ID: 700739901H1
aagaacctcgttttgttgaatatttcagatgtgcaactcctgagttggagtatggaagaatgaacattggcagtcgtccatcaaagcgaaagccaagtggaggaattgaatcactacgtgctattccttggatttttgcatggacacaaacgaggtttcatttgccagtgtggcttggttttgggtcagcatttaagcatgtagttgagaaagatccgaagaatctccaaatgcttcaggacatgtacaatcaatggcct

SEQ ID NO: 5289 - DNA, 258 bp, Glycine max
  Clone ID: 700741179H1
gtttccaacatttcttgcttcataattcaagtgaggtcataacacaacacaaagtgttgccaacttcgtggttcatattggttggttcagttaagagtgtggagaacaaagaagatacttagattatggctgctcgtaacatcgagaagatggcctcaattgatgctcaactgaggttgctggcgccacgcaaggtgtctgatgatgacaaactcgttgagtatgatgccttgttgttggatcgtttccttgacattc

SEQ ID NO: 5290 - DNA, 206 bp, Glycine max
  Clone ID: 700742902H1
gatgaacttaggcgttcaaaacccactccagttgatgaagctagggcagaagtggaagaatcccttggtttatttatttttcaattctcccagtattgaatattgtggaggagtcactctgaaaagctgttcctcattatttacgtcgagttagcagcgctttaaagaagcacacaggaaaaccacttccattgacttgcactcca

SEQ ID NO: 5291 - DNA, 244 bp, Glycine max
  Clone ID: 700751669H1
gcgtaatgtcatggaagagatctcaaacatcagttgtcagtgttaccgcaatgtagtgtatgaaaatccagaattcctggcctacttccatgaagccacaccagaggcagaacttggcttccttaacataggtagccgccctacaagaaggaagagctcagtaggaatcggacaccttcgtgcaattccctggttatttgcatggacacaaacaagattcgttcttccagcttggcttggagtc

SEQ ID NO: 5292 - DNA, 232 bp, Glycine max
  Clone ID: 700753587H1
gttcactgcagctacacttgagcatggaatgcatcctcctgtgtcaccgaaaccagaatggcgcgccctcatggacgagatggctgtcattgcaacaaaggagtatcgctctgttgttttcaaagagcctcgttttgttgaatatttcagatgtgcaactcctgagttggagtatggaagaatgaacattggcagtcgtccatcaaagcgaaagccaagtggaggaattgaa

SEQ ID NO: 5293 - DNA, 235 bp, Glycine max
  Clone ID: 700755512H1
ttgcagttgagcttctgcagcgcgaatgccatgtcaagcatccactaagagttgtgccattgtttgagaagctagctgatctagaagcagcaccggccgcgttggcgcgattgttctctgtagactggtacagaaacaggatcaatgggaagcaggaagtgatgataggctattctgattctggcaaagatgctggaaggttttcagctgcatggcagctgtataaggctcagga

SEQ ID NO: 5294 - DNA, 234 bp, Glycine max
  Clone ID: 700755528H1
ctgcagttgagcttctgtagcgcgaatgccatgtcacgcatccactaagagttgtgccattgtatgagaagctagctgatctagaagcagtaccggccgcgttggcgcgattgttctctgtaaactggtacagaaacaggatcaatgggtagcaggctgtgatgataggctagtctgattctggcacagatgctagaaggttttcagctgcatggcagctgtataaggctcagg

SEQ ID NO: 5295 - DNA, 254 bp, Glycine max
  Clone ID: 700834546H1
cggctcgagagaggcttgtgaatcaactgaagaagcagccattaagggttgttccattgtttgaaaaacttgctgatcttgaggctgctcctgctgcggtagcccgcctattctctatagattggtacagagaccgtatcaatgggaaacaagaagttatgatagggtactcggactcgggaaaagatgctggtcgtttctctgcagcatgggcactatacaaggctcaagaagagctcataaaggttgcaaaa

SEQ ID NO: 5296 - DNA, 239 bp, Glycine max
  Clone ID: 700864136H1
ccttacatcaccgagaataacacgatacggctcattgggaggaattatataatacacgtgaacgtgctcggcagttgttagccaatggaagctctgaaatccctgaggagactaccttcacaaatgttgaacagttcctggagcctcttgaattatgttatagatcgctgtgtgcatgtggtgaccaaccaatagctgatggaagccttcttgatttcttgcgccaagtttccacacat

SEQ ID NO: 5297 - DNA, 257 bp, Glycine max
  Clone ID: 700876401H1
gtgcttgctgttgagcttttacaacgtgaatgccatgtgaagcagccactaagggtggtgccactgtttgaaaagcttgctgatcttgaggccgctccggctgcggtggcacgtctttctctatagattggtacagaaaccgcattgatgggaagcaagaagttatgatagggtactcagactcaggaaaagatgcaggccgtctttctgcggcttgggcgctttacaaggctcaagaagaacttgtgaaggttgct

SEQ ID NO: 5298 - DNA, 234 bp, Glycine max
  Clone ID: 700890236H1
ctagttctagatcgcgatcctagaaactagggatactcagattcagggagagatgctgggaggttctctgcagcatggcagctatgtaaggctcaggaggaacttataaatgttgccaagaaacttggtgttagctaagccatgttccatggtcgcggtggaactgttggaagaggaggtggacctactcatcttgctattctgtctcaacctccagacacaatccatggatca

SEQ ID NO: 5299 - DNA, 261 bp, Glycine max
  Clone ID: 700955462H1
tgagaacaatgcaactacagaatcagacattgaagaaactctcaagaaacttgtatttgacttgaagaagtctcctcaggaagtttttgatgcactgaaaaaccagactgttgatttagttcttactgctcatctactcaatcaattcgtagatctttgcttcaaaagcatggacggataaggaattgtttatctcaattgtatgccaaagacattactcctgatgataagcaggagcttgatgaggctctacaaagggag

SEQ ID NO: 5300 - DNA, 249 bp, Glycine max
  Clone ID: 700959358H1
agtaaacctgctgatgaacttataacacttaacccaacaagtgaatatgcacctggtttggaagacaccctcattctcaccatgaagggtattgctgctggcttgcaaaacactggctaaatctgagtttttgtcttctctttggttccacttttattttctgtttcctttatcagaaataacgagtttagctgcatgcaccaaagggtgtttttccctcccctgtacccatgtttccattataagata

SEQ ID NO: 5301 - DNA, 265 bp, Glycine max
  Clone ID: 700971291H1
gtgcagatgaacttaacaggtcttccaagaaaaattcagtcgcaaaacactacatagaattttggaaagccattcctccaaatgaaccatatcgtgtgctactgggtgaagtaaggaataggctttaccagactcgtgaacgctcacgccatttgctagctcacggatactctgacattccagaggaagagacttttaccaatgttgaggagttcttggaaccccttgaactctgttacagatcactctgtgcttgtgggggtcg

SEQ ID NO: 5302 - DNA, 271 bp, Glycine max
  Clone ID: 700979408H1
caatagctgatggaagccttcttgatttcttgcgccaagtttccacatttgggctttcacttgtaagacttgatatccgtcaagaatcagatcggcacactgatgttatggatgctattacaaaccacttagagattggatcttatcgagagtggtctgaggaacgcaggcaggaatggctgctatccgagctcagtggaaagcgccctctctttggtctgatcttcctaaaacagaagaaattgctgatgtattggaaaccttccatgtc

SEQ ID NO: 5303 - DNA, 281 bp, Glycine max
  unsure (1)...(281): unsure at all n locations
  Clone ID: 700987250H1
gcgagcgattaaggtctatgtttgaagaaaccaagagccttctcctccaggttgctggacacaaagatctccttgaaggagacccctacttgaagcaaagacttcgacttcgcgattcatacatcacaaccctcaatgtcctgcaagcctacacattgaagcgaattcgtgatcctgactaccatgtgaagttgaggccacatttgtccaaagactacatggatcaaacaagccagcagctgagcttgtgaaactcaanccnacangtgattctgctccng

SEQ ID NO: 5304 - DNA, 278 bp, Glycine max
  Clone ID: 700987503H1
atgttattaagaaggatccaaagaatctccaaatgcttcaagatatgtataatcaatggcctttcttcagggtcagccttgacttggttgagatggtgttcgccaagggagaccctgggattgcggctctttatgacaaactcctagtgtcagaggaactgtggccatttggcgagcgattaaggtctatgtttgaagaaaccaagagccttctcctccaggttgctggacacaaagatctccttgaaggagacccctacttgaagcaaagacttcga

SEQ ID NO: 5305 - DNA, 257 bp, Glycine max
  unsure (1)...(257): unsure at all n locations
  Clone ID: 700991194H1
cttgagaaagatccgaagaatctccaaatgcttcaggacatgtacaatcaatggcctttcttcagggtcaccctggacttggttgagatggtgtttgctaagggagacccggggattgcagccctatttgacaaactcctagtatcagaagagctgcgtccatttggagaaaatttaagagcnaaatacgangatttggttgatgccatagacaaagttcgatctagctaagaatatataaaagtattctctctctc

SEQ ID NO: 5306 - DNA, 268 bp, Glycine max
  unsure (1)...(268): unsure at all n locations
  Clone ID: 701002203H1
gtcagctgagtacgaaggagagcataagcctganaagttggaggaacttgggaatatgctgacgggtcttgatgctggggattcaattgttattgccaagtcattttctcacatgctcaatttggccaacttggcagaagangttcaaattgcgtatcgaaganggatcagttactgaagaagggtgattttnctgatgagactctgcccattactgagtcagacattgaagagaccttcaagaagcttgtggctccactgaagaagc

SEQ ID NO: 5307 - DNA, 237 bp, Glycine max
  Clone ID: 701043122H1
cttttgatttattttatttgttcatgtggggttattggttatttttctatgatcggttgatcacaggtgcgggactgaaaggtagcaatggcgaccaggaacttggaaaagatggcatccattgatgcacagcttaggcaattggctcctgccaaagtgagtgaggatgacaaactgattgagtatgatgctcttctgctggatcggttccttgatatccttcaagatttacatggg

SEQ ID NO: 5308 - DNA, 241 bp, Glycine max
  Clone ID: 701043454H1
ctggttttggggtactttgaaaagttgcaatggcgaacaggaacttggaaaagatggcatcgattgatgctcagcttcggctgttggttccggccaaagtgagtgaggatgacaaactggttgagtatgtgctttgcttttggatcggttccttgatattcttcaggatttacatggggaggatctgaaagaaacggttcaagaggtgtatgagctttctgctgagtatgaaggtaagcat

SEQ ID NO: 5309 - DNA, 260 bp, Glycine max
  Clone ID: 701046608H1
catgctcctctcattcacttttcttcttggatgggtggagatcgtgatggcaatccaagagtaactacctgaagtgaccagacatgtttgcttattggctagaatgatggctgctaacttgtactactcccagatagaggatcttatgtttgagctgtcaatgtggcgctgcaatgccgagctacgtgtccgtgcagatgaacttaacaggtcttccaagaaaaattcagtcgcaaaacactacatagcattttggaaag

SEQ ID NO: 5310 - DNA, 248 bp, Glycine max
  unsure (1)...(248): unsure at all n locations
  Clone ID: 701062388H1
ctacgtcgttttgatacagcttctaagaatatagtgatcttcgaacgtgtcccttattatgcntctctcattcaattttcttcttggatgggtggagatcgtgatggcaatccaagagtaactcctgaagtgaccagagatgtttgcttattggctagaatgatggctgctaacttgtactactcccagatagaggatcttatgtttgagctgtcaatgtggcgctcccatgacgagctagtgccgtg

SEQ ID NO: 5311 - DNA, 258 bp, Glycine max
  Clone ID: 701119910H1
tatccccatctgatgtgcttgctgttgatatgatgtaggcaccgaagttgtctgagggaagctctgaaatgacacggaaggtttccaaaacatcggtgatttcttctgttttgggaaggtcatggccaaagagagggcgctttccactgagttcagacaatagccactcctgcctcttttcctcgggccactctcggtatgatccaatgtctaagtgttttgtgattgcatccataacatcagtgtgcctatctgact

SEQ ID NO: 5312 - DNA, 276 bp, Glycine max
  Clone ID: 701213104H1
ctccaaatgagccatatcgtgttattcttggtgatgtccgagacaaactgtataacacacgggaacgtgctcgccaattattagccaatgggacctctgatatccccgaggagacaactttcacttacgttgagcagttgctggagcctcttgaacaatgctatagatcactctgtgcctgtggtgacagacctatagcagatggaagcctccttgatttcctgcggcaagtttcgagctttggactctcacttgtgagacttgacatccgtcaag

SEQ ID NO: 5313 - DNA, 256 bp, Glycine max
  Clone ID: 700732365H1
gcaaaacattatattgagttttggaaacagattcctcccaatgagccgtatcgtgttattctcggtgatgtaagggacaaattatataatacacgtgaacgtgctcggcagttgttagccaatggaagctctgaaatccctgaggagactaccttcacaaatgttgaacagttcctggagcctcttgaattatgttatagatcgctgtgtgcatgtggtgaccaaccaatagctgatggaagccttcttgatttct

SEQ ID NO: 5314 - DNA, 285 bp, Glycine max
  unsure (1)...(285): unsure at all n locations
  Clone ID: 700981524H1
ccccaatgagccgtatcgtgttattctcggtgatgtaagggacaaattnnataatacacgtgaangngctngngcagttgttagccaatggaagctctgaaatccctgaggagactaccttcacaaatgttgaacagttcctggagcctcttgaattatgttatagatcgctgtgtgcatgtggtgaccaaccaatagctgatggaagccttcttgatttcttgcgccaagtttccacatttgggctttcgctgtaagacttgatatccgtcaagaatcagatcg

SEQ ID NO: 5315 - DNA, 272 bp, Glycine max
  unsure (1)...(272): unsure at all n locations
  Clone ID: 700663617H1
gaaataacgagtttagctgnatgcnccaaagggtgtttttccctctctgtaanatcttataatggaaacatgggtacaggggagggaaaaacaccctttggtgcatgtttccattataagatattacagagagatagctgccgcaaaatgagacaatgcaagtatgcaactgattcttatgttccaatacgnaattatgctgatttatagacttatttgtatcacctatttcaagcaactctttggtacctaacattttacgtgaggtggtt

SEQ ID NO: 5316 - DNA, 268 bp, Glycine max
  unsure (1)...(268): unsure at all n locations
  Clone ID: 700663717H1
gaaataacgagtttagctgnatgcncccanagggtgtttttccctctctgtaancatcttataatggaaacatgggtacaggggagggaaaaacaccctttggtgcatgtttccattataagatattacagagagatagctgccgcaaaatgagacaatgcaagtatgcaactgattcttatgttccaatacgnaattatgctgatttatagacttatttgtatcacctatttcaagcaactctttggtacactaacatttttacgtg

SEQ ID NO: 5317 - DNA, 146 bp, Glycine max
  Clone ID: 700870993H1
gctgccgcaaaatgagacaatgcaagtatgcaactgattcttatgttccaatacgaaattatgctgatttatagacttatttgtatcacctatttcaagcaactctttggtacactaacatttttacgtgaggtggttaagatgcc

SEQ ID NO: 5318 - DNA, 271 bp, Glycine max
  Clone ID: 700686116H1
atcaccgatgttttggaaacattccgtgtcatttcagagcttccctcagacaacttcggtgcctacatcatatcaatggcaacatccccatctgatgtgcttgctgttgagcttttacaacgtgaatgccatgtgaagcagccactaagggtgggccactgtttgaaaagcttgctgatcttgaggccgctccggctgcggtggcacgtcttttctctatagattggtacagaaaccgcattgatgggaagcaagaagttatgatagggta

SEQ ID NO: 5319 - DNA, 254 bp, Glycine max
  Clone ID: 700944212H1
gaggcaggagtggctcttgtctgaactcagtggaaagcgccctctctttggccatgaccttcccaaaacagaagaaatcaccgatgttttggaaacattccgtgtcatttcagagcttccctcagacaacttcggtgcctacatcatatcaatggcaacatccccatctgatgtgcttgctgttgagcttttacaacgtgaatgccatgtgaagcagccactaagggtggtgccactgtttgaaaagcttgctg

SEQ ID NO: 5320 - DNA, 281 bp, Glycine max
  unsure (1)...(281): unsure at all n locations
  Clone ID: 700985848H1
cattatttnccggngctntggaaagaatttatggatgttgttnnnattcntccccttngttttagagtttatcacaggtgagcgactgaaaggtagcantggcgaacaggnacctggnaaagatggcatccatcgatgcacagcttaggcaattggctcctgccaaagtgagtgaggatgacaaactgattgagtatgatgctcttctnttggatcggntccttgatattcttcaagatttacatggggaggatctgaaggaaacagtccaagaagtatat

SEQ ID NO: 5321 - DNA, 269 bp, Glycine max
  Clone ID: 701120339H1
gttgtgatcttcctcttcctcgtacacaggtgagggactgaaaggtagcaatggcgaccaggaacttggaaaagatggcatccattgatgcacagcttaggcaattggctcctgccaaagtgagtgaggatgacaaactgattgagtatgatgctcttctgctggatcggttccttgatatccttcaagatttacatggggaggatctgaaggaaacagttcaagaagtgtatgaactttcagctgagtatgaaggaaagcatgaccct

SEQ ID NO: 5322 - DNA, 273 bp, Glycine max
  Clone ID: 701214949H1
atttttcattcgttgtgatcttcctcttcctcgtacacagagtttatcacaggtgagcgactgaaaggtagcaatggcgaacaggaacctggaaaagatggcatccatcgatgcacagcttaggcaattggctcctgccaaagtgagtgaggatgacaaactgattgagtatgatgctcttctgttggatcggttccttgatattcttcaagatttacatggggaggatctgaaggaaacagtccaagaagtatatgaactttcagctgagta

SEQ ID NO: 5323 - DNA, 275 bp, Glycine max
  Clone ID: 701096990H1
atttttcattcgttgtgatcttcctcttcctcgtacacaggtgagcgactgaaaggtagcaatggcgaccaggaacttggaaaagatggcatccattgatgcacagttaggcaattgctcctgcaaagtgagtgaggatgacaaactgattgagtatgatgctcttctgctggatcggttccttgatatccttcaagatttacatggggaggatctgaaggaaacagttcaagaagtgtatgaactttcagctgagtatgaaggaaagcatgacc

SEQ ID NO: 5324 - DNA, 277 bp, Glycine max
  Clone ID: 701038039H1
ctttttgatccatttttcattcgttgtgatcttcctcttcctcgtacacaggtgagcgactgaaaggtagcaatggcgaccaggaacttggaaaagatggcatccattgatgcacagcttaggcaattggctcctgccaaagtgagtgaggatgacaaactgattgagtatgatgctcttctgctggatcggttccttgatatccttcaagatttacatggggaggatctgaaggcaacagttcaagaagtgtatgaactttcagctgagtatgaag

SEQ ID NO: 5325 - DNA, 268 bp, Glycine max
  Clone ID: 701006212H2
tcgaatcgagcgaatcggctcgagtctttttgatccatttttcaatcgttgtgatcttcctacttcctcgtacacaggtgaatgactgaaaggtagcaatggcgaccaggaacttggaaaagaggcatccattgatgcacagattaggcaattggctcatgccaaagtgagtgaggatgacaaactgattgagtatgatgctcttctgctggatcggttccttgatatccttcaagatttacatggggaggatctgaaggaaacagtt

SEQ ID NO: 5326 - DNA, 259 bp, Glycine max
  Clone ID: 700730704H1
cggctcgagcaggaggatgttgtagctgcttgcaatgattatggaataaaggttactctattccatggtcgtggaggcagtattggtcgtggtggtggcccaacatatcaggctattcagtcccaaccccctggctctgtgatgggaacgcttcggtctactgagcagggagagatggtagaggctaagtttgggttgccacagatagctgttagacaacttgagatatacacaacagctgtactacttgcaacccttc

SEQ ID NO: 5327 - DNA, 272 bp, Glycine max
  Clone ID: 700685609H1
ggaataaaggttactctattccatggtcgtggaggcagtattggtcgtggtggtggcccaacatatctggctattcagtcccaaccccctggctctgtgatgggaacgcttcggtctactgagcagggagagatggtagaggctaagtttgggttgccacagatagctgttagacaacttgagatatacacaacagctgtactacttgcaacccttcgtccacctatcccaccccgagaagaaaaatggcgtaatgtcatggaagagatctc

SEQ ID NO: 5328 - DNA, 265 bp, Glycine max
  Clone ID: 701041573H1
ctccagacacaatccatggatcacttcgtgtgacagtccaaggtgaagtcattgagcaatcatttggagaacaacacttgtgttttagaacactacaacgtttcactgctgccactctagaacatggcatgcaccccccgatttctccaaaaccagaatggcgtgctttgatggatcagatggctgtcattgctactgaggaataccgttccattgtattcaaggaaccacgctttgttgagtatttccgcctggctacaccgga

SEQ ID NO: 5329 - DNA, 272 bp, Glycine max
  Clone ID: 701099785H1
gaggaggtggacctactcatcttgctattctgtctcaacctccagacacaatccatggatcacttcgtgtgacagtccaaggtgaagtcattgagcaatcatttggagaacaacacttgtgttttagaacactacaacgtttcactgctgccactctagaacatggcatgcaccccccgatttctccaaaaccagaatggcgtgctttgatggatcagatggctgtcattgctactgaggaataccgttccattgtattcaaggaaccacgc

SEQ ID NO: 5330 - DNA, 229 bp, Glycine max
  Clone ID: 700897382H1
caacgtttcactgctgccactctagaacatggcatgcaccccccgatttctccaaaaccagaattgcgtgctttgatggatcagatggctgtcattgctactgaggaataccgttccattgtattcaaggaaccacgctttgttgagtatttccgcctggctacaccggagttggagtatggaaggatgaacattggaagtcgaccagcaaagagaaagcctagtggag

SEQ ID NO: 5331 - DNA, 255 bp, Glycine max
  Clone ID: 700874273H1
atcagagacgtgttggagacattccatgtcatagcagagcttccactagacaactttggcgcatacatcatctcaatggcaactgcaccttctgatgtgcttgcagttgagcttctgcagcgcgaatgccatgtcaagcatccactaagagttgtgccattgtttgagaagctagctgatctagaagcagcaccggccgcgttggcgcgattgttctctgtagactggtacagaaacaggatcaatgggaagcag

SEQ ID NO: 5332 - DNA, 252 bp, Glycine max
  Clone ID: 700684541H1
gttgagtggcaaacggcccctattcggccctgatcttccccaaaccgaagaaatcagagacgtgttgtagacattccatgtcatagcagagcttccactagacaactttggcgcatacatcatctcaatggcaactgcaccttctgatgtgcttgcagttgagcttctgcagcgcgaatgccatgtcaagcatccactaagagttgtgccattgtttgagaagctagctgatctagaagcagcaccggccgc

SEQ ID NO: 5333 - DNA, 245 bp, Glycine max
  Clone ID: 700836067H1
gtgaatatgcccctggtttggaagacacactcattctcactatgaagggtattgctgctggcatgcagaacactggttaagtttgtttgaatactgaaagtgagtgctctagttttgttctcagatacacttttttgttttgttattatgttgccccacctttctgtacaatttggtatgctgctctagaattccagaagagctagctaccacacaaatgaatcaatgacattgatctgttatgt

SEQ ID NO: 5334 - DNA, 276 bp, Glycine max
  unsure (1)...(276): unsure at all n locations
  Clone ID: 700567643H1
gtgtcttccaaaccaggggcatattcactatgaagggtattgctgctggcatgcagaacactggttaagtttgtttgaatactgaaagtgagtgctctagttttgttctcagatacactttttttgttttgttattatgttgccccacctttctgtacaatttggtatgctgctctagaattccagaagagctagctaccacacaaatgaatcaatgacattgatctgttatgtttcttaaaaaanaaaaaaaaanaaaannaaangngggagngt

SEQ ID NO: 5335 - DNA, 234 bp, Glycine max
  Clone ID: 700744392H1
tgtgtgtctgctggctagaatgatggctgctaatttgcacttctctcagattgaggatctcatgtttgagctgtctatgtggcgctgcaatgatgagctacgtgttcgttctgatgaactccttagctcctcaaagagagatgcaaaacattatattgagttttggaaacagattcctcccaatgagccgtatcgtgttattctcggtgatgtaagggcacaattatataatac

SEQ ID NO: 5336 - DNA, 239 bp, Glycine max
  Clone ID: 700747092H1
gtgtgtttgctggctagaatgatggctgctaatttgtacttgtctcagattgaggatctcatgtttgagttgtctatgtggcgctgcaatgatgagctagtgttcgttctgatgaactccttagctcctcaaagagagatgcaaaacattatattgagttttggaaacagattgctcccaatgagccgtatcgtgttattctcggtgatgtaagggacaaattatataatacacgtgaa

SEQ ID NO: 5337 - DNA, 253 bp, Glycine max
  unsure (1)...(253): unsure at all n locations
  Clone ID: 700666285H1
gacattccagaggaagagacttttaccaatgttgaggagttcttggaaccccttgaactctgtnacagatcactctgtgcttgtggcgatcgtgcaattgccgatggaagccttctagatttcttgagacaagtctctactttcggantctccctagtgaggcttgacataaggcaagagtcagaccgccacacagacgtcttagacgccatcaccaaacatttagaaataggctcataccaggaatggtcgg

SEQ ID NO: 5338 - DNA, 262 bp, Glycine max
  Clone ID: 700945580H1
gttcttggaacccttgaactctgttacagatcactctgtgcttgtggcgatcgtgcaattgccgatggaagccttctagatttcttgagacaagtctctactttcggactctccctagtgaggcttgacataaggcaagagtcagaccgccacacagacgtcttagacgccatcaccaaacatttagaaataggctcataccaggaatggtaccggagaaaaacggcagcaatggcttttatctgagttgagtggcaaacgg

SEQ ID NO: 5339 - DNA, 271 bp, Glycine max
  Clone ID: 701068565H1
aaggatgttaggaatattcatgtgctgcaggagatgtacaatcaatggcctttctttagggtcactattgatttagtggaaatggtgtttgccaaaggagacccagggatagctgctctttatgataggttccttgtttcagaggatctgtggtcatttggtgagcagttgacgaccatgtacgatgaaaccaaggaactcctccttcaggtggctggccatagggatcttcttgaaggagatccatacttgaagcaaagactgcgcttgc

SEQ ID NO: 5340 - DNA, 266 bp, Glycine max
  Clone ID: 700943287H1
actcgagccgaatcggctcgagttcgaacatgttattgagaaggatactaggaatattcatgacactgcaggagatgtataatcaatggcctttctttagggtcactattatttagtggaaatggtgtttgccaaaggagacccggggatcgctgctctttatgataggctccttgtttcagaggatctgtggtcatttggagagcagttgaggaccaagtatgaagaaaccaaggaattcctccttcaggtggctggccataggg

SEQ ID NO: 5341 - DNA, 266 bp, Glycine max
  Clone ID: 701040960H1
aagaaattagagatgttttggacacatttcatgtcatagcagaactaccaccagacaactttggagcctatatcatatcaatggcaactgcaccatctgatgtgcttgcagttgagcttctacaacgtgaatgccacatcaagcatcccttaagagttgtgccattgtttgagaagctagctgatctagaggctgctcctgctgctttggcacggttgttctcgatagactggtatagaaataggatcaatgggaagcaagaagtg

SEQ ID NO: 5342 - DNA, 189 bp, Glycine max
  Clone ID: 701038869H1
ggacacatttcatgtcatagcagaactaccaccagacaactttggagcctatatcatatcaatggcaactgcaccatctgatgtgcttgcagttgagcttctacaacgtgaatgccacatcaagcatcccttaagagttgtgccattgtttgagaagctagctgatctagaggctgctcctgctgcttt

SEQ ID NO: 5343 - DNA, 222 bp, Glycine max
  Clone ID: 700834887H1
gtggtgatcgggatggtaatccaagagtaactcctgaagtgacaagggatgtttgcttattggctagaatgatggctgctaatttgtattattcccagatagaagatcttatgtttgagctctctatgtggcgctgcaatgatgaactacgcgttcgtgcagaagaacttcacaggtcttccaagaaagatgaagttgcaaagcactatatagcattctgga

SEQ ID NO: 5344 - DNA, 279 bp, Glycine max
  Clone ID: 701127019H1
attgggggtgatcacgatggtaatccaagagtaactcctgaagtgacaagggatgtttgcttattggctagaatgatggctgctaatttgtattattcccagatagaagatcttatgtttgagctctctatgtggcgctgcaatgatgaactcgcgttcgtgcagaagaacttcacaggtcttccaagaaagatgaagttgcaaaacactatatagatttttggaaaaaggttcccccaaatgaaccatatcgtgtggtactcggtgaagtaagggata

SEQ ID NO: 5345 - DNA, 266 bp, Glycine max
  Clone ID: 701154209H1
tacggctgcgagaagacgacagaagggagaggagcacttgtgcttcagaacacttcagcgcttcactgctgctacacttgagcatggaatgcaccctcctgtggcaccaaaaccagagtggcgtgccctcatggatgagatggctgtcattgctacagaggagtatcgctccattgttttccaggaaccccgtttcgttgagtacttccgatgtgctacacctgagctggagtatggaagaatgaacattggcagtcgtccgtcaa

SEQ ID NO: 5346 - DNA, 262 bp, Glycine max
  Clone ID: 701154248H1
tacggctgcgagaagacgacagaagggagaggagcacttgtgcttcagaacacttcagcgcttcactgctgctacacttgagcatggaatgcaccctcctgtggcaccaaaaccagagtggcgtgccctcatggatgagatggctgtcattgctacagaggagtatcgctccattgttttccaggaaccccgtttcgttgagtacttccgatgtgctacacctgagctggagtatggaagaatgaacattggcagtcgtccg

SEQ ID NO: 5347 - DNA, 270 bp, Glycine max
  Clone ID: 701122563H1
caagcctacacattgaagcgaattcgtgatcctgactaccatgtgaagttgaggccacatttgtccaaagactacatggaatcaaacaagccagcagctgagcttgtgaaactcaaccctacaagtgattatgctcctggtctggaggatacccttattttgacaatgaagggtattgctgctggcatgcaaaacactggttaagaagctgcatgcctgtgttgtattcctatacaagtaacttaactttggatacacacattttaacct

SEQ ID NO: 5348 - DNA, 290 bp, Glycine max
  Clone ID: 701122647H1
caagcctacacattgaagcgaattcgtgatcctgagtaccatgtgaagttgaggccacatttgtccagagactacatggaatcagacaagccagctgctgagcttgtgaaactcaaccctacaagtgattatgctcctggtctggaggatacccttattgtgacactgaagggtattgctgctggcatgcaaaacactggttaagcagctgcatgcctgtgatgccttcctatacgagtagcttagctttggatacacacattgtaacctatgctgtctgctacagatgt

SEQ ID NO: 5349 - DNA, 278 bp, Glycine max
  Clone ID: 701123443H1
aagtcgactcgagcgaaagggaagaggcctcttgttcctgttagtatagaggttcatcctgatgttagagaagtcttggatacattccgaattgacgaactggggagtgattcacttggagcttatgtgatctctatggcctcaaatgcaagtgatgtccttgcagtagagcttttacagaaggatgcacggcttgctgctattggggagttgggaaaagcatgtcctggtggaacgttgcgggttgtccctctgtttgaaactgtgaaagacctgag

SEQ ID NO: 5350 - DNA, 196 bp, Glycine max
  unsure (1)...(196): unsure at all n locations
  Clone ID: 700648723H1
atcattaagaaccataatggacatcaagaggttatggttggatattctgattctggtaaagatgctggncgctttactgctgcttgggaactttacaaagctcaggaggatgttgtagctgctngcaatgattatggataaaggtactctattccatggtcgtggaggcatattggtcgtggtggttggcccacat

SEQ ID NO: 5351 - DNA, 121 bp, Glycine max
  unsure (1)...(121): unsure at all n locations
  Clone ID: 700648341H1
atcataanaaccataatggacatcaagangttatggttggatattctgattctggtaaagatgctngtcgctttactgctgctttgggnacttacaaagctcangaggntgttgtagctgc

SEQ ID NO: 5352 - DNA, 248 bp, Glycine max
  Clone ID: 700889346H1
cagactcaggaaaagatgcaggccgtctttctgcggcttgggcgctttacaaggctcaagaagaacttgtgaaggttgctaaggagtatggtgttaaacttacaatgtttcatgggagaggagggactgttggaagaggaggaggtccaactcatcttgctatattgtctcagccaccagacaccattcatggctcacttcgggtaacggttcagggtgaagtcattgagcagtcttttggagaggaa

SEQ ID NO: 5353 - DNA, 252 bp, Glycine max
  Clone ID: 700741422H1
tatagattggtacagaaaccgcattgatgggaagcaagaagttatgatagggtactcagactcaggaaaagatgcaggccgtctttctgcggcttgggcgctttacaaggctcaagaagaacttgtgaaggttgctaaggagtatggtgttaaacttacaatgtttcatgggagaggagggactgttggaagaggaggaggtccaactcatcttgctatattgtctcagccaccagacaccattcatggctc

SEQ ID NO: 5354 - DNA, 250 bp, Glycine max
  Clone ID: 700962862H1
aatcaatggcctttctttagggtcacacttgatttggtggaaatggtgtttgccaaaggagatccgaaaattgccgctctgaatgatagactccttgtttcaaaggatctgtggccgtttggggatcaattgaggaacaaatatgaagaaactaggaaactcctacttcaggtggctggacacaaggaaattcttgaaggggacccttacttgaagcaaagactcaggcttcgtcatgctcccattacca

SEQ ID NO: 5355 - DNA, 258 bp, Glycine max
  Clone ID: 700729127H1
aagagatgtacaatcaatggcctttctttagggtcacacttgatttggtggaaatggtgtttgccaaaggagatccgaaaattgccgctctgaatgatagactccttgtttcaaaggatctgtggccgtttgcggatcaattgaggaacaaatatgaagaaactaggaaactcctacttcaggtggctggacacaaggaaattcttgaaggggacccttacttgaagcaaagactcaggcttcgtcatgctcccatta

SEQ ID NO: 5356 - DNA, 262 bp, Glycine max
  Clone ID: 700962754H1
aatcaatggcgtttctttagggtcacacttgatttggtggaaatggtgtttgccaaaggagatccgaaaattgccgctctgaatgatagactccttgtgtcaaaggatctgtggccgtttggggatcaattgaggaacaaatatgcagaaactaggaaactcctacttcaggtggctggacacaagggaattcttgaaggggacccttacttgaagcaaagactcaggcatcgtcatgctcccattaccagcctcaatattg

SEQ ID NO: 5357 - DNA, 257 bp, Glycine max
  Clone ID: 701042717H1
gaccagcaaagagaaagcctagtggaggcattgaaacactgcgtgcaataccttggatttttgcatggactcagacaaggtttcatcttccagtgtggctaggctttggagcagcatttaaagaagtcattgagaaaaatgttaacaatctcaatatgctgcaagagatgtacaatcaatggcctctctttagggtcacacttgatttggtggaaatggtgtttgccaaaggagatccgaaaattgctggtctgaat

SEQ ID NO: 5358 - DNA, 250 bp, Glycine max
  Clone ID: 700943121H1
ggatttttgcatggactcagacaaggtttcatcttccagtgtggctaggctttggagcagcatttaaaaaagtcattgaggaaaatgttaagaatctcaatatgctgcaagagatgtacaatcaatggcctttctttagggtcacacttgatttggtggaaatggtgtttgccaaaggagatccgacaattgccgctctgaatgatagactccttgtttcaaaggatctgtggccgtttggggatcaatt

SEQ ID NO: 5359 - DNA, 210 bp, Glycine max
  unsure (1)...(210): unsure at all n locations
  Clone ID: LIB3049-036-Q1-E1-F5
gttgttttntntttttttttgtgtntntgttgnttnttcttgttttttgngntgtttntttttttgttttgttgtnttngctttttttnttttngttnntgnttgttttgtnttttgttttttttttnttgtnttgctgntttttgntttgtntttgttgttttttttttcttnttnctgttgtgtngtgttttttgttttgtgtgtttt

SEQ ID NO: 5360 - DNA, 87 bp, Glycine max
  unsure (1)...(87): unsure at all n locations
  Clone ID: LIB3049-037-Q1-E1-D7
ttttnttttntttntttntttgtgtttgttttgtttttntntttttttttgtntttttgngtggtttttctttttttgttttttgtt

SEQ ID NO: 5361 - DNA, 120 bp, Glycine max
  unsure (1)...(120): unsure at all n locations
  Clone ID: LIB3049-037-Q1-E1-A8
gttttctttttnggtnttttgnttctntttttgttnntttntttnttctgtttttgtctcttntttctgtttttgtntttgnctnttttttttgtccttnctttttgttttttgtttntt

SEQ ID NO: 5362 - DNA, 270 bp, Glycine max
  unsure (1)...(270): unsure at all n locations
  Clone ID: LIB3049-037-Q1-E1-E12
tggttttagctttatcgggntcggcctatgngtanatataagctgngagattattatagangggtcttnttngagatgnttggatttttctcgtttgtgnttgatttcnnttttngtntntttntggttgtgtttgttttcnattggtttttgtgttttttttttgttttngnttgnngtgggtgtgttttntttttnntcttnttgtntttntgttnttnttngcttttttttggttttttntttgctgtttattgtntttttttgtnt

SEQ ID NO: 5363 - DNA, 439 bp, Glycine max
  Clone ID: LIB3049-046-Q1-E1-A2
atacggctgcgagaagacgacagaaggggagactaattttacattggaatcttccttaaggtatgttgctgactgttctcaagctgtagttgtacacatgtaactctgtcaacattttcagaccaaatccaacgttgtttctggcaaaaatggatgcattccgtttatcacattcatttatgctcagcaccaacatccacagcccctcctctctctgcacccttcgttccctctccaccaatccccgcaacaggtggttcaaggtggaagccaccgccggcggcagccagaagaagaacaataacaaggccttcgacgcggcggcgttcgaggcggagcgacttgccctcgacgcagaggcccggcgaaccatggcggacgccgccgacccgaaggcctggaaatggataatccggaagagaatatgggatatgatgga

SEQ ID NO: 5364 - DNA, 241 bp, Glycine max
  unsure (1)...(241): unsure at all n locations
  Clone ID: LIB3049-048-Q1-E1-E12
agttggggacntgtttgtnggantgtgtctggttttttgctcngcttttntgtttcntctattttnattttntttttttgtttgngtctggttttggtgtttttggttctttgtttttttttntgngggggggtcgtnttcttttgttgttntttctgtnggtttttntgnntttgttnttgttngggttnttgtctttgttcctntgttngtttttgtttnttggnttttntctttnncc

SEQ ID NO: 5365 - DNA, 136 bp, Glycine max
  unsure (1)...(136): unsure at all n locations
  Clone ID: LIB3049-051-Q1-E1-C6
ctttctttctcttnctctcnttttgttttngtcntcttttgntcttttcnctntttgtcctnttttgttctctctttttntttcnttttttttgttcttccntntttttctntctttttgtnctcttntnttcttg

SEQ ID NO: 5366 - DNA, 186 bp, Glycine max
  unsure (1)...(186): unsure at all n locations
  Clone ID: LIB3049-056-Q1-E1-D1
aagttcccaggtcccctgtccatatcgnanatnngtgtacttctgnttgngaanggttnatttttttttgatttttgtttttttacttcgttggtttgnttcntttttttctttgnttttttgtcagtntnntttntgnggggtgnnttgntnttttnttnttggtgtttcggttctttttttttt

SEQ ID NO: 5367 - DNA, 120 bp, Glycine max
  unsure (1)...(120): unsure at all n locations
  Clone ID: LIB3040-011-Q1-E1-G3
tgtttttttgctttttgtttttttttnntttnttttttcgtntttgttcttctntgtttcttctntngttcatttttcnttntntctctttgtngtttttgttnntttgtttcttcnttt

SEQ ID NO: 5368 - DNA, 109 bp, Glycine max
  unsure (1)...(109): unsure at all n locations
  Clone ID: LIB3028-013-Q1-B1-H1
atnttnattttgtnttttttttttntgtttttanggttttcttttntttttttntngggggtttttgtntttatttgttttttttgngtgnnggnttttttttgttttt

SEQ ID NO: 5369 - DNA, 110 bp, Glycine max
  unsure (1)...(110): unsure at all n locations
  Clone ID: LIB3039-025-Q1-E1-C6
cgttttccttgtgttgtttgtntttttgcntctttttttttgtgttgtttttnntttttntntgttgtnttgttttntgttgtttnntgtttttnttcgttngttgttgt

SEQ ID NO: 5370 - DNA, 175 bp, Glycine max
  unsure (1)...(175): unsure at all n locations
  Clone ID: LIB3039-024-Q1-E1-C7
ttttggtggngtttgttgntttgngtcgttttggcngggggttntttntcttttgctttttgtgtttggttnggttntcttttngtggttgtttttttgttcttttctttgtttgnttttttctcngttttttngtttttnnttngttnttntntttncttttttnnttttttgt

SEQ ID NO: 5371 - DNA, 358 bp, Glycine max
  Clone ID: LIB3056-009-Q1-N1-H12
ggctctaggtttgaagcggcccctttggtttaagtgaaggactgaaagggtacagtggccaccaggaacttggaaaagatggcatccattgatgcacagcttaagcaattggctcctgccaaagtgagtgaagatgacaaactgattgagtatgatgctcttctgctggatcggttccttgatatccttcaagatttacatggggaggatctgaaggaaacagttcaagaagtgtatgaactttcagctgagtatgaaggaaagcatgaccctaagaaactggaagaacttggaaatttgataaccagtttggatgctggggactctattcttgttgccaagtccttttcccacatgc

SEQ ID NO: 5372 - DNA, 230 bp, Zea mays
  Clone ID: 700579267H1
gcgttggccatcttacaggatgaggggagtgcatgttgtgatcgtccggaagataccatgctaccaggagaagtgtagtttagttacagaagcagcagcagtggaatgcattttgccaatacattagctgagacttgaaacatctgcttgcgagatgcagcaactacttatgtatatgtgtatattcaataattatgccacacgaatttgactaagaagtaggagtgggg

SEQ ID NO: 5373 - DNA, 323 bp, Zea mays
  unsure (1)...(323): unsure at all n locations
  Clone ID: 700098054H1
cagcattggcatagatccttacgtggtctttcaagatgtagattgggcccttcttattggcgctaaccccgaggtcccggcatggagcgagctgcgctactggatatcaatggccaaatctttgctgaccaggggaaagcacttaatgcggtcgcctcgcggaaccgnaagtcttagttgtcggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgac

SEQ ID NO: 5374 - DNA, 312 bp, Zea mays
  Clone ID: 700097706H1
cgcgacggaggcgcacgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaatagcacttaagctactcggctcagaaagatcgtttcaggccctcgaaggtgtagctatggaactggaggactcgctgtatccactgctgagggaagtcagcattggcatagatccttacg

SEQ ID NO: 5375 - DNA, 317 bp, Zea mays
  Clone ID: 700097409H1
cggacggtggggcttcggggtcttctgcaccacctacgacctcaaggcggaggacaagaccaagtcgtggaagaagctagtgaatgttgctgtgtcaggcgcacccgggatgatatcaaatcacctgctgttcaaactcgcttctggtgaggttttcggacaagaccaaccaatagcacttaagctactcggctcagaaagatcgtttcaggccctcgaaggtgtagctatggaactggaggactcgctgtatccactgctgagggaagtcagcattggcatagatccttacgtagtctttcaagatgtagattggg

SEQ ID NO: 5376 - DNA, 289 bp, Zea mays
  Clone ID: 700100389H1
ccaaatctttgctgaccaggggaaagcacttaatgcggtcgcctcgcggaaccaaagtcttagttgttggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgatttcttgaatgccaaaattgatggaag

SEQ ID NO: 5377 - DNA, 308 bp, Zea mays
  Clone ID: 700098228H1
ccactccctcctctcctctcccgtcctatccatccggcacgcccagcatccatccactcctcccctgctccggctccggctccggctccgccatgggcctttcaacagtttactccccggccggaccgcgcctcgtgccggcccctctcggccgctgccgctctgcccagccccgccgcccgcgccgagccccgctcgccaccgtcccgtgctccgtcgacgccaccaagcaggcgcaggatggcgtggcgaccgcggtcgtgacggaggcgccggcgtcgcggaaggagtgcttcggggtcttctgc

SEQ ID NO: 5378 - DNA, 275 bp, Zea mays
  Clone ID: 700042625H1
cgtgactatttggaggaacattcgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgactggaaa

SEQ ID NO: 5379 - DNA, 274 bp, Zea mays
  Clone ID: 700044532H1
tcaaacgtgactatttggcggaacattcgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgac

SEQ ID NO: 5380 - DNA, 294 bp, Zea mays
  Clone ID: 700426221H1
acgatatcgtgttcagcatgccatgcagatcgaagggtgatggtgattacgaactagctagtgatgtgttgatggacgattttctctgggaacggattaaaaagagcgaactgaattgcttgctgagaagaaatgcgttgcccatcttacaggagaggggaatgcattctgtgatcttccggaagataccatgctaccaggagaagtgtagtttagttacagaagcaacagcagcggaatgcatttgccaatacattagctgagacttgaaacatctgcttgccagatgcagca

SEQ ID NO: 5381 - DNA, 282 bp, Zea mays
  Clone ID: 700045403H1
aatctttgctgaccaggggaaagcacttaatgcggtcgcctcgcggaacgcgaaagtcttagttgtcggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaacattcgacgactcaggttcctgatttcttgaatgccaaaattgat

SEQ ID NO: 5382 - DNA, 298 bp, Zea mays
  Clone ID: 700100550H1
ggagccagctgcgctactggatatcaatggccaaatctttgctgaccaggggaaagcacttaatgcggtcgcctcgccgaaccgaaagtcttagttgtcggaaatccctgtaacactaatgcgctgatttgtttgaaaaatgccccaaacataccggcaaaaaaaactttcatgcattgacgaggttggatgaaaatagagcaaagtgccagctggcactaaaagcaggtgtattttatgacaaagtatcaaacgtgactatttggcggaaccattcgacgactcaagttcctgattt

SEQ ID NO: 5383 - DNA, 281 bp, Zea mays
  Clone ID: 700439608H1
ggggaaagcacttaatgcggtcgcctcgcggaacgccaagtcttagttgttggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaacattcgacgactcaggttcctgatttcttgaatgccaaaattgatggaagaccaggaaag

SEQ ID NO: 5384 - DNA, 272 bp, Zea mays
  Clone ID: 700578318H1
tggaggactcgctgtatccactgctgagggaagtcagcattggcatagatccttacgtggtctttcaagatgtagattgggcccttcttattggcgctaagccccgaggtcccggcatggagcgagctgcgctactggatatcaatggccaaatccttgctgaccaggggaaagcacttaatgcggtcgcctcgcggaacgcgaaagtcttagttgtcggaaatccctgtaacactaatgcgctgatttgtttgaaaaatgccccaaacata

SEQ ID NO: 5385 - DNA, 304 bp, Zea mays
  Clone ID: 700084313H1
cggacgctgtggttgctgtgtcaggcgcggccgggatgatatcaaatcacctgctgttcaaactcgcttctggtgaggttttcggacaagaccaacaagtagcacttaagctactcggctcagaaagatcgtttcaggccctcgaaggtgtagctatggaactggaggactcgctgtatccactgctgagggaagtcagcattggcatagatccttacgtagtctttcaagatgtagattgggcccttcttattggcgctaagcccgaggtcccggcatggagcgagctgcgctactggatatc

SEQ ID NO: 5386 - DNA, 267 bp, Zea mays
  Clone ID: 700434067H1
gtttatacgactggaaatccttatggcatagaggaggatatcgtgttcagcatgccatgcagatcgaagggtgatggtgattacgaactagctagtgatgtgttgatggacgattttctctgggaacggattaaaaagagcgaagctgaattgcttgctgagaagaaatgcgttgcccatcttacaggagaggggaatgcattctgtgatcttccggaagataccatgctaccaggagaagtgtagtttagttacagaagcaacagc

SEQ ID NO: 5387 - DNA, 255 bp, Zea mays
  Clone ID: 700578011H1
tgaaaatagagcaaagtgccagctggcactaaaagcaggtgtattttatgacaaagtatcaaacgtgactatttgggggaaccattcgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgt

SEQ ID NO: 5388 - DNA, 313 bp, Zea mays
  Clone ID: 700099962H1
cccagaaggtgactggttttctacaggggtttatacgactggaaatccttatggcatagcagaggatatcgtgttcagcatgccatgcagatcgaagggtgatggtgattacgaactagctagtgatgtgttgatggacgattttctctgggaacggattaaaaagagcgaactgtaattgcttgctgagaagaaatgcgttgcccatcttacaggagaggggaatgcattctgtgatcttccggaagataccatgctaccaggagaagtgtagtttagttacagaagcaacagcagcggaatgcatttgcca

SEQ ID NO: 5389 - DNA, 278 bp, Zea mays
  Clone ID: 700445309H1
gaaagatcgtttcaggccctcgaaggtgtagctatggaactggaggactcgctgtatccactgctgagggaagtcagcattggcatagatccttacgtagtctttcaagatgtagattgggcccttcttattggcgctaagccccgaggtccggcatggagcgagctgcgctactggatatcaatggccaaatctttgctgaccaggggaaagcacttaatgcggtcgcctcgcggaacgcaaagtcttagttgttggaaatccctgtaacactaatg

SEQ ID NO: 5390 - DNA, 268 bp, Zea mays
  Clone ID: 700213872H1
ggcacgcccagcatccatccactcctcccctgctccggctccgggtccggcactgccatgggcctttcaacagtttactccccggccggaccgcacctcgtgccggcccctctcggccgctgccgctctgcccagccccgccgcccgcgccgggcccagctcgccaccgtccggtgctccgtcgacgccaccaagcaggcgcaggatggcgtggcgacggcggtcgcgacggaggcgccagcgtcgcggaaggagtgcttcggggtct

SEQ ID NO: 5391 - DNA, 245 bp, Zea mays
  Clone ID: 700578418H1
ggaggactcgctgtatccactgctgagggaagtcagcattggcatagatacttacgtggtctttcaagatgtagattgggcccttcttattggcgctaagccccgaggtcccggcatggagcgaactgcgctactggatatcaatggccaaatctttgctgaccaggggaaagcacttaatgcggtcgcctcgcggaacgcaaagtcttagttgtcggaaatcctgtaaactaatgcctgatttg

SEQ ID NO: 5392 - DNA, 255 bp, Zea mays
  Clone ID: 700429351H1
gtgttcagcatgccatgcagatcgaagggtgatggtgattacgaactagctagtgatgtgttgatggacgattttctctgggaacggattaaaaagagcgaagtgaattgcgtgcggagaagaaatgcgttgcccatcttacaggagaggggaatgcattctgtgatcttccggaagataccatgctaccaggagaagtgtagtttagttacagaagcaacagcagcggaagcatttgccaatacattagctgag

SEQ ID NO: 5393 - DNA, 232 bp, Zea mays
  Clone ID: 700045012H1
aagaccaaccaatagcacttaagctactcggctcagaaagatcgtttcaagccctcgaaggtgtagctatggaactggaggactcgctgtatccactgctgagggaagtcagcattggcatagatccttacgtggtctttcaagatgtagattgggcccttcctattggcgctaagcccgaggtcccggcatggagcgagctgcggtagtggatatcaatgggcaaatcctt

SEQ ID NO: 5394 - DNA, 224 bp, Zea mays
  unsure (1)...(224): unsure at all n locations
  Clone ID: 700197938H1
gacaaagtatcaaacgtgactatttgngaggaaccattcgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgcta

SEQ ID NO: 5395 - DNA, 267 bp, Zea mays
  Clone ID: 700433880H1
cgattttctctgggaacggattaaaaagagcgaagctgaattgcttgctgagaagaaatgcgttgcccatcttacaggagaggggaatgcattctgtgatcttccggaagataccatgctaccaggagaagtgtagtttagttacagaagcaacagcagcggaatgcatttgccaatacattagctgagacttgaaacatctgcttgccagatgcagcaactacttttatatatatatgtgtatattcaataattgtgccacacgaa

SEQ ID NO: 5396 - DNA, 246 bp, Zea mays
  Clone ID: 700043693H1
attttctctgggaacggattaaaaagagcgaactcgaattgcttgctgacaagaaatgcgttgcccatcttacaggagaggggaatgcattctgtgatcttccggaagataccatgctaccaggagaagtgtagtttagttacagaagcaacagcagcggaatgcatttgccaatacattagctgagacttgaaacatctgcttgccagatgcagcaactacttttatatatatatgtgtatattc

SEQ ID NO: 5397 - DNA, 286 bp, Zea mays
  Clone ID: 700581629H1
gtgttcagcatgccatgcaagatcgaatgagtatggtgattacgaactaggctagtgatcgtgttgatggacgattttctctggagaacggattaaatagagcgaactgaattgcttgctgagaagaaatgcgttgcccatcttacaggagaggggaatgcattctgtgatcttccggaagataccatgctaccaggagaagtgtagtttagttacagaagcaacagcagcggaatgcatttgccaatacattagctgagacttgaaacatctgcttgccagatgc

SEQ ID NO: 5398 - DNA, 252 bp, Zea mays
  Clone ID: 700422827H1
gaacggattaaaaagagcgaactgaattgcttgctgagaagaaatgcgttgcccatcttacaggagaggggaatgcattctgtgatcttccggaagataccatgctaccaggagaagtgtagtttagttacagaagcaacagcagcggaatgcatttgccaatacattagctgagacttgaaacatctgcttgccagatgcagcaactacttttatatatatatgtgtatattcaataattgtgccacacga

SEQ ID NO: 5399 - DNA, 228 bp, Zea mays
  Clone ID: 700167037H1
gaagaaggcgagcgcgcggtgtccaccactccctctcctctcccgtcctatccatccggcacgcccagcatccatccactcctcccctgctccggctccggctccggctctgccatgggcctttcaacagtttactccccggccggaccgcgcctcgtgccggcccctctcggccgctgccgctctgcccagccccgccgcccgcgccgggcccagctcgctaccgtc

SEQ ID NO: 5400 - DNA, 261 bp, Zea mays
  Clone ID: 700438770H1
tgggggacacaacttaatgcggtcagcctcacggaacgcgacagtgcttaattgttggaaatccctgtaacactaatgcgctgatttgtttgaaaaatgccccaaacataccgagcaaaaactttcatgcattgacgaggttggatgaaaatagaacaaagtgccagctggcactaaaagcaggtgtattttatgacaaagtatcaaacgtgactatttaggggaacattcgacgactcaggttcctgattctgaatgcca

SEQ ID NO: 5401 - DNA, 174 bp, Zea mays
  Clone ID: 700425253H1
atcaaacgtgactatttggtggaacattcgacgactcaggttcctgatttcttgaatgccaaaattgatggaagacagtgaaagaagtcattaaggataccaagtggttagaggaagagttcaccctcacagttcaaaagcgtggaggtgtgctcatccaaaaatggggcagat

SEQ ID NO: 5402 - DNA, 160 bp, Zea mays
  Clone ID: 700423354H1
ggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacg

SEQ ID NO: 5403 - DNA, 146 bp, Zea mays
  Clone ID: 700211538H1
cccacgcgtccgtggaactggaggactcgctgtatccactgctgagggaagtcagcattggcatagatccttacgtggtctttcaagatgtagattgggcccttcttattggcgctaagcccgaggtcccggcatggagcgagctg

SEQ ID NO: 5404 - DNA, 104 bp, Zea mays
  Clone ID: 700097126H1
gcgaatgttgctgtgtcaggcgcggccgggatgatatcaaatcacctgctgttcaaactcgcttctggtgaggttttcggacaagaccaaccaatagcacttaa

SEQ ID NO: 5405 - DNA, 267 bp, Zea mays
  unsure (1)...(267): unsure at all n locations
  Clone ID: 700098826H1
tccactcgtcctactccctcctctcctctcccgtcctatccatcctgcacgctcagcatccatccactcctcccctgctccggctcctgctcctgctccgccattggcctttcaacagtttactccccgtccggaccgctcctcgttccggcccctctcggccgctgccgctctgcccagccccgctgcccgctccgagccccgctcgctaccgtccggagctccgtcgacgccaccaagcaggctcatgatgtcgnggcgactgcg

SEQ ID NO: 5406 - DNA, 120 bp, Zea mays
  unsure (1)...(120): unsure at all n locations
  Clone ID: 700100862H1
tcccacgcgtcctcccacgcgtcctctcacgcgtccgcggacgcgtggcggtncgcgacaggatgcgccggcgtcgcggaaggagtgcttcgaggtcttctgcaccacctacgagctcaa

SEQ ID NO: 5407 - DNA, 388 bp, Zea mays
  Clone ID: LIB3060-016-Q1-K1-C12
ctctaccgtcctatgcatccggtacgcccagcatccatccactactgacatgctgggggtccggctgcggctccggcatgggcctttcaacagtttactccgcggccggaccgcgcctcgtgccggtccctctcgaccgctgccgctctgcccagccccggcgcccgcgccgagccccggtcgccaccgttcggtgctccgtcgacgccaccaagcaagcgcatgatggcgtggcagactgcggtcgcgactgaggcgccgtagtcgcggaaggagtgctctggggtctactgcaccacctacgacctcaaggccgaggacaagaccaagtcgcggaagaagctagtgaatgttgctgagtcaggcgcggccgggatgatatcaaatc

SEQ ID NO: 5408 - DNA, 454 bp, Zea mays
  Clone ID: LIB36-016-Q2-E2-D10
tacacatagacgttctgacaaccactccctctcctctcccgtcctatccatccggcacgcccagcatccatccactcctcccctgctccggctccggctccggctctgccatgggcctttcaacagtttactccccggccggaccgcgcctcgtgccggcccctctcggccgctgccgctctgcccagccccgccgcccgcgccgggcccagctcgccaccgtccggtgctccgtcgacgccaccaagcatgcgcaggatggcgtggcgacggcggtcgcgacggaggcgccagcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgttgttcaaactcgcttctggtgaggtttt

SEQ ID NO: 5409 - DNA, 447 bp, Zea mays
  Clone ID: LIB3078-033-Q1-K1-F11
caaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgactggaaatccttatggcatatcagaggatatcgtgttcagcatgccatgcagatcgaagggtgatggtgattacgaactggctagtgatgtgttgatggacgattttctctgggaaccgattaaaaagagcgaagctgaattgcttgctgagaagaaatgcgttgcccatcttacaggagaggggaatgcattttgtgatcttccggaagataccatgctaccaggagaagt

SEQ ID NO: 5410 - DNA, 442 bp, Zea mays
  Clone ID: LIB36-013-Q1-E1-D5
cccacgcgtccgcggacgcgtgggcggcatggagcgagctgcgctactggatatcaatggccaaatctttgctgaccaggggaaagcacttaatgcggtcgcctcgcggaacgcgaaagtcttagttgtcggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgatttcttgaatgccaaaattgatggaagaccagtgaaagaagtcattaaggataccaagtggttagaggaagagttcaacctcacagttcaaaagcgtggaggtgtgctcatccaaaaa

SEQ ID NO: 5411 - DNA, 444 bp, Zea mays
  Clone ID: LIB3060-021-Q1-K1-F9
gcgagcgcgcggtgtccaccactccctctcctctcccgtcctatccatccggcacgccgagcggccatccactcctcccctgctccggctccggctccggctctgccatgggcctttcaacagtttactccccggccggaccgcgcctcgtgccggcccctctcggccgctgccgctctgcccagccccgccgcccgcgccgggcccagctcgccaccgtccggtgctccgtcgacgccaccaagcaggcgcaggatggcgtggcgacggcggtcgcgacggaggcgccagcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtg

SEQ ID NO: 5412 - DNA, 435 bp, Zea mays
  unsure (1)...(435): unsure at all n locations
  Clone ID: LIB36-015-Q1-E1-A7
cccacgcgtccggctgtttcgatagtggatgctattagatccctcgtaactcctaccccagaaggtgactggttttctacaggggtttatacgactggaaatccttatggcatagcagaggatatcgtgttcagcatgccatgcagatcgaagggtgatggtgattacgaactagctagtgatgtgttgatggacgattttctctgggaacggattaaaaagagcgaagctgaattgcttgctgagaagaaatgcgttgcccatcttacaggagaggggaatgcattctgtgatcttccggaagataccatgctaccaggagaagtgtagtttagttacagaagcaacagcagcggaatgcatttgccaatacattagctgagacttganacatctgcttgccagatgcagcaactacttttatatatatatgtg

SEQ ID NO: 5413 - DNA, 395 bp, Zea mays
  Clone ID: LIB36-002-Q1-E1-D3
cggacgcgtgggcggacgcgtgggatttgggggaaccatttgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgactggaaatccttatggcatagcagaggatatcgtgttcagcatgccatgcagattcaagggtgatggtgattacgaactggctagtgatgtgttgatggacgattttct

SEQ ID NO: 5414 - DNA, 412 bp, Zea mays
  Clone ID: LIB3060-013-Q1-K1-G5
ctcccctgctccggctccggctccggctctgccatgggcctttcaacagtttagtcgcgcggccggaccgcgcctcgtgccggcccctctcggccgctgccgctctgcccagccccgccgcccgcgccgggcccagctcgccaccgtccggtgctccgtcgacgccaccaagcaggcgcaggatggcgtggcgacggcggtcgcgacggaggcgccagcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaagttttcggacaagaccaaccaatagcacttaaactactc

SEQ ID NO: 5415 - DNA, 509 bp, Zea mays
  unsure (1)...(509): unsure at all n locations
  Clone ID: LIB3060-013-Q1-K1-G2
cgggatttgaggtaggagcgtgtgtgcggaccccangctatagcagaccgttccgatcggaataccagcgcgacccacgcgtccgcgcccctgctccggctccggctccggttctgccatgggcctttcaacagtttgactggcggccggaccgcgcctcgtgccggcccctctcggccgctgccgctctgcccagccccgccgcccgcgccgggcccagctcgccaccgtccggtgctccgtcgacgccaccaagcaggcgcaggatggcgtggcgacggcggtcgcgacggaggcgccagcgtcgcggaaggagtgcttcggggtcttctgcaccacctacgacctcaaggcggaagacaagaccaaatcgtggaagaagctagtgaatgttgctgtgtcaggcgcggccgggatgatatcagatcacctgctgttcaaactcgcttctggtgaggttttcggaccagaccaaccaatagcacttaagctactcgggttaaaaagat

SEQ ID NO: 5416 - DNA, 452 bp, Zea mays
  Clone ID: LIB36-020-Q1-E1-F1
tgacacccagtaccgatagtaagcaagccactacttagacacgtgggacgacgcaacactctagagtgagtcgtattagtcggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgatttcttgaatgccaaaattgatggaagaccagtgaaagaagtcattaaggataccaactggttagaggaagagttcaccctcacagttcaaaagcgtggatgtgtgctcatccaaaaatggggcagatcatcagctgcatcgaccgctgtttccatagtggatgctaatagatccct

SEQ ID NO: 5417 - DNA, 391 bp, Zea mays
  Clone ID: LIB3079-013-Q1-K1-G10
cccacgcgtccgccaccactccctcctctcctctcccgtcctatccatccggcacgcgcagcgtccatccactcctcccctgctccggctccggctccggctccgccatgggcctttcaacagtttactccccggccggaccgcgcctcgtgccggcccctctcggccgctgccgctctgcccagccccgccgcccgcgccgagccccgctcgccaccgtccggtgctccgtcgacgccaccaagcaggcgcaggatggcgtggcgacggcggtcgcgacggatgcgccggcgtcgcggaaagagtgcttcggggtcttctgcaccacctacgacctcaaggcggaggacaagaccaagtcgtggaagaagctagtgaaatgtgctgtgtc

SEQ ID NO: 5418 - DNA, 379 bp, Zea mays
  unsure (1)...(379): unsure at all n locations
  Clone ID: LIB189-018-Q1-E1-C10
cccacgcgtccgcccacgcgtccggtaactcctaccccagaaggtgactggttttctacaggggtttatacgactggaaatccttatggcatagcagaggatatcgtgttcagcatgccatgcagatcgaagggtgatggtgattacgaactggctagtgatgtgttgatggacgattttctctgggaacggattaaaaagagcgaagctgaattgcttgctgagaagaaatgcgttgcccatcttacaggagaggggaatgcattttgtgatcttccggaagataccatgctaccaggagaagtgtagtttagttacagaagcaacagcagtggaatgcattttgccaatacattagctgagacttganacatctgct

SEQ ID NO: 5419 - DNA, 448 bp, Zea mays
  unsure (1)...(448): unsure at all n locations
  Clone ID: LIB3078-052-Q1-K1-B9
aggagcnnnagctggcaccgcatatacgagatgctcatggantgccgtaccggtctggaatcacgcgtccgaccaagcaggcgcaggatggcgtggcgactgcggtcgcgacggaggcgccagcgtcggggaaggagtgcttcggggtctgctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaatagcacttaagctactcggctcagaaagatcgtttcaggccctcgaaggtgtagctatgggactggaggactcgctgtatccactgctgagggaagtcagcattggcatagatccttacgtagtctttcaagatgtagaatgggccct

SEQ ID NO: 5420 - DNA, 258 bp, Glycine max
  Clone ID: 701120823H1
atggtgtcttctgccttacctatgatttgagggttggagaagagacaagatcctggaagaaattaattagcattgcagtctcatgtgctgctggaatgattgcaaatcatctgcttttcaagcttgcatctggtgaagtttttgggccagatcaacctattgctctcaaattattgggatcagaaaggtcaatccaagctcttgaaggtgttgcaatagaattggaggactctttgtctccattgttgaaggaagtta

SEQ ID NO: 5421 - DNA, 259 bp, Glycine max
  Clone ID: 700897079H1
cggctcgagccgacttcttaaagctagaattgatggtttgccagtcaaagaggtggttaaggataccgaagtggttggaggaagagttcactgaaaaggttcaaaagagaggtggtgcacttattcaaaaatggggaagatcatcagctgcatcaacttctgtgtcaattgttgatgccataagatcttcagtaactcctactcccgagggtgattggttttcttctggtgtatatagcgatggaaatccttatggaat

SEQ ID NO: 5422 - DNA, 263 bp, Glycine max
  Clone ID: 701139976H1
tcggatcctaagagtaagcctgagtgctatggtgtcttctgccttacctatgatttgagggctgaagaagagacaagatcctggaagaaatttattaacattgcagtctcaggtgctgctggaatgattgcaaatcatctacttttcaagcttgcatctggtgaagtttttggcccagatcaacctattgctctcaaattattgggatcagaaaggtcaatccaagctcttgaaggtgttgcaatggaattggaggactcttt

SEQ ID NO: 5423 - DNA, 237 bp, Glycine max
  Clone ID: 700738591H1
atattaattaacattgcagtctcaggtgctgctggaatgattgcaaatcatctacttttcaagcttgcatctggtgaagtttttggcccagatcaacctattgctctcaaattattgggatcagaaaggtcaatccaagctcttgaaggtgttgcaatggaattggaggactctttgtttcctttgttgagggaggttagtattggtatcgatccttatgaagtgttccaagatgca

SEQ ID NO: 5424 - DNA, 278 bp, Zea mays
  Clone ID: 700028003H1
tgtcacgtatcatttaaaactaatatataacttttaaattgaatatttatttgtaatcatttttaacgattatttacaagttttttctaatatggcatcttggtttatagaagttcttccaacagctccgatcgaaatttttgctcttgctcgagcttttcgggaagattcttttgcagaaaaagttgaccttggcattggagcctatcgtactgatgaaggtcaaccatgggtacttccagttgttcgtgaagccgaaatcagcattgccaatgata

SEQ ID NO: 5425 - DNA, 304 bp, Zea mays
  Clone ID: 700072842H1
ctctggagctgaggaaggctatctgcaaaaagcttgaggaggagaatggtctatcatactccgccgatcaggtgctagtaagcaatggagccaagcagtgcattacacaagcagtactcgctgtctgctcacctggcgatgaagttttgatacctgcaccatattgggtcagctaccctgagatggctagactggctggtgcaacgccagttattctccctacaagcatatcagacaattacctgctaaggccagagtcacttgcctcagtgatcaatgaaaattcaaggatcttgattctctg

SEQ ID NO: 5426 - DNA, 128 bp, Zea mays
  Clone ID: 700194011H1
agaatttcttgcaaggcactatcacgaggttaaacttttcttgctcctatctgttttgctgcttcctgattataatgcatgactgctaaatcatacaaatatattccagcgcactatctacatcccac

SEQ ID NO: 5427 - DNA, 322 bp, Zea mays
  unsure (1)...(322): unsure at all n locations
  Clone ID: 700196486H1
tgnggagatcacccanaagtcttcaccctatctggcttgaacgttaggagctaccgctattatgatcctgcaacatgcagccttcacttcgaaggactcctggaagacctcggttctgctccttcaggttcaattgtactgctgcatgcctgtgctcacaaccctactggagtagatcctaccatcgaacagtgggaacagattaggcagctgatgagatcanaatcactgcttccgttctttgacagtgcctatcaaggctttgcaagtcggagtcttgacnaagatgctcagtcagtgcgtatgttttgtgctgatggtg

SEQ ID NO: 5428 - DNA, 302 bp, Zea mays
  Clone ID: 700331820H1
tgcgaggccgagcgccggatcgcgggcaacctcaacatggagtaccttccgatgggaggcagcatcaagatgattgaagagtcactgaagctggcgtacggagaagattctgacttcatcaaagataagaggatagcagcggtgcaggcgctttcaggcactggtgcctgccggctctttgctgatttccaaaagcgttttttgccggattcgcagatctacataccaacaccaacgtggtccaaccatcacaatatttggagggatgctcaagtgccacagaagacattcacatactacca

SEQ ID NO: 5429 - DNA, 138 bp, Zea mays
  Clone ID: 700454550H1
gttcattctttttgcttcatgcatgtgctcataatcccaccggtgtagctcctacggaggaaccatggcgcgaaatatcccatcagttcaaggtgaacaaacatttaccattctttgacatggaatcacccgggtttg

SEQ ID NO: 5430 - DNA, 181 bp, Zea mays
  Clone ID: 700454567H1
gttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagctgccaaggccatctgattttc

SEQ ID NO: 5431 - DNA, 184 bp, Zea mays
  Clone ID: 700454642H1
gttcattctttttgcttcatgcatgtgctcataatacccactgtgaagatcctaataagacccactggagagaacatatacccatacagttcaaggtgaaaaaacattttccattactttgacatggcataccaagggtttgccagtggtgatccagagagagatgccaaggcaatccgaattt

SEQ ID NO: 5432 - DNA, 135 bp, Zea mays
  Clone ID: 700454849H1
aattcattctttttgcttcatgcatgtgctcataatcccagcggtgtagatcctatggacggactatggagagaaatgacccatcagttcaaggtgaaaaaacattttccattctttgacatggcattcaagggt

SEQ ID NO: 5433 - DNA, 310 bp, Zea mays
  Clone ID: 700468560H1
cagacatatttgtctctgatggtgccaaatgtgacatatctcgcttgcaggtcctttttggatctaatgtgacaattgcggtccaagatccatcataccctgcatatgttgattcaagtgttatcatggggcaaactgacttatatcagcaagacgttcagaagtatggaaacattgagtacatgagatgcggtccagaaaatggatttttcctgatctgtcaactgtccctaggacagatattattttcttttgttcacccaacaatcctactggtgctgctgcatctcgggaccaactaaccaaatta

SEQ ID NO: 5434 - DNA, 296 bp, Zea mays
  Clone ID: 700476413H1
gctgcggcaggccggcgtgccggttatcggtctagccgcgggggagccagacttcgacacgccgcccgcgatcgcggaggccgggatggctgcaattaggaatggttatacaagatacactcctaatgctgggactttggagctgaggaaggctatactgtactaaactccaggagggaacggggtatcctacctcccagatgaggtgctggtgagcaatggagctaagcaatgcatcacataagctgtgcttgcagtttgctcacctggtgatgaggttttgattccagccccat

SEQ ID NO: 5435 - DNA, 119 bp, Zea mays
  unsure (1)...(119): unsure at all n locations
  Clone ID: 700615109H1
gaccacnagtggtccaccgattggactctggacntgaaggccatggctgttaggatcattaacatgaggcaacaactatttatgcgctgaatccagaggaanccctggtgattgagcct

SEQ ID NO: 5436 - DNA, 246 bp, Zea mays
  Clone ID: 701161385H1
ggctaagatcaagtgtagtatctggtcttatcaatttaatatctgatatgtggactatgtgttcactttgatattaaatttattttctgtggcggagagtccaccaccgtggcttgccactggtccccttgagcgtcgctcggactgggccccttgagcgtcgctcggccgttgcactactggctgagcctggcgcaccccaaccaatccaattcgagattttttccccaaccaatctaatttgag

SEQ ID NO: 5437 - DNA, 295 bp, Zea mays
  Clone ID: 700341126H1
cacttaaggaaaatcttgaaaagctaggttcacctttgtcatgggatcatatcactaatcagattggaatgttctgctacagtgggatgacacctgaacaagttgaccgtttaacaaatgaataccacatttacatgacccgcaatgggaggataagcatggctggtgttacgacaggaaatgttagttacctagcaaatgcaattcatgaggttaccaaaccaaattgagttagggtcctaccttctttggtcgatggaagctgatggaatgagactgtgaagcggcgtttccc

SEQ ID NO: 5438 - DNA, 262 bp, Zea mays
  Clone ID: 700160220H1
atcagattggaatgttctgctacagtgggatgacacctgaacaagttgaccgtttaacaaatgaataccacatttacatgacccgcaatgggaggataagcatggctggtgtaacgacaggaaatgttggttacctagcaaatgcaattcatgaggttaccaaaccaaattgagttagggtgctaccttctttggtcgatggaagctgatggaatgagactgtgaagcggcgtttcccccctctgttcctgacagaaataag

SEQ ID NO: 5439 - DNA, 133 bp, Zea mays
  Clone ID: 700158802H1
atcagattggaatgttctgctacagtgggatgacacctgaacaagttgaccgtttaacaaatgaataccacatttacatgacccgcaatgggaggataagcatggctggtgtaacgacaggaaatgttggtta

SEQ ID NO: 5440 - DNA, 372 bp, Zea mays
  Clone ID: 700204319H1
aacgagcaagggccgcagccggagctccaatggcctccttctcctccctctctgcctcctcctccacctccaccccgtccttcaacctccccgcaaaaacctccgctggcacaggctccctgtcattccacagggcgagggagtcgcagaagtccagggccaggatggtgacggtgcgggcggaggcggttgacacgaccatcagcccgcgggtgaatgcgctcaggccgtccaagaccatggccatcaccgaccaggccacggcgctgcgacaggccggcgtgccagtcatcggactcgccgctggggagcccgacttcgacacgccagccgtgatcgccgaggctgggataaatgccatcagagatgggg

SEQ ID NO: 5441 - DNA, 305 bp, Zea mays
  Clone ID: 700095671H1
cggaccgtggtcccgtttcgctctctgccgccgccaccgcacaagaagctagctcctgcctgtaccgccccgtcatggcgatgctatccagtgcagctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctca

SEQ ID NO: 5442 - DNA, 294 bp, Zea mays
  Clone ID: 700214146H1
cggagccgtgggacaaaagcccacagcttcttctccctactcctccagtcctccgtcatccgtttcgctctctgccgccgccaccgcacaagaagctagctcctgcctgtaccgccccgtcatggcgatgctatcccgcgcacctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgac

SEQ ID NO: 5443 - DNA, 263 bp, Zea mays
  Clone ID: 700041823H1
caagaagctagctcctgcctgtaccgccccgtcatggcgatgctatcccgcgcgcgctcctccgctgcccggcgcccgctgctgccgccgcctaggcttctggcggtgagggcgatggcgtcgtcgctcttcggccacgtcgagccggcggccaaggaccccatcctcggcgtcaccgaggctttcctcgccgacgcctcgtccgacaaagtgaacgtcggcgtcggcgcctaccgggacgacaacggccagcccgtcgtgct

SEQ ID NO: 5444 - DNA, 290 bp, Zea mays
  Clone ID: 700094321H1
gtgacaaaagcccacagcttcttctccctactcctccagtcctccgtcatccgtttcgctctctgccgccgccaccgcacaagaagctagctcctgcctgtaccgccccgtcatggcgatgctatcccgcgcagctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagt

SEQ ID NO: 5445 - DNA, 319 bp, Zea mays
  Clone ID: 700089060H1
gaaaattgcagatgtcattcaagagaaaaagcatatgccattctttgatgttgcatatcaaggttttgccagtagaagccttgatgaagatgcattttctgtcaggctttttgttaagcgtggcatggaagtatttgttgcacaatcttacagcaagaaccttggtctatattctgaaaggattggtgcgataaatgtcgtgtgctcagcaccagaagttgcagatagggtaaagagccagctgaaacgattggcacgtcccatgtactcgaacccccctattcacggtgccaagatagttgccaacgttgttggtgat

SEQ ID NO: 5446 - DNA, 295 bp, Zea mays
  Clone ID: 700044414H1
ggttggtgcaataaatgtcgtgtgctcagcaccagaagttgcagatagggtaaagagccagctgaaacgattggcacgtcccatgtactcgaacccccctattcacggtgccaagatagttgccaacgttgttggtgatccaaccatgtttggtgaatggaaacaagagatggagctaatggctggacggatcaagaatgtaagacagaagctctacgacagtttgtctgccaaggacaagagcggcaaggactggtctttcattctgaggcagattggcatgttctcctacacc

SEQ ID NO: 5447 - DNA, 291 bp, Zea mays
  Clone ID: 700101429H1
aatcttacagcaagaaccttggtctatattctgaaagggttggtgcgataaatgtcgtgtgctcagcaccagaagttgcagatagggtaaagagccagctgaaacgattggcacgtcccatgtactcgaacccccctattcacggtgccaagatagttgccaacgttgttggtgatccaatcatgtttggtgaatggaaacaagagatggagctaatggctggacggatcaagaatgtaagacagaagctctacgacagtttgtctgccaaggataagagcggcaaggact

SEQ ID NO: 5448 - DNA, 278 bp, Zea mays
  Clone ID: 700221366H1
cccacgcgtccgcaactcctgaacagtgggagaaaattgcagatgtcattcaagagaaaaagcatatgccattctttgatgttgcatatcagggttttgccagtggaagccttgatgaagatgcattttctgtcaggctttttgttaagcgtggcatggaagtgtttgttgcacaatcttacagcaagaaccttggtttatattctgaaagggttggtgcaataaatgtcgtgtgctcagcaccagaagttgcagatagggtaaatagccagctgaaa

SEQ ID NO: 5449 - DNA, 318 bp, Zea mays
  Clone ID: 700101604H1
cccacgcgtccgctaatggctggacggatcaagaatgtaagacagaagctctacgacagtttgtctgccaaggataagagcggcaaggactggtctttcattctgaggcagattggcatgttctcctacaccggcttgaacaaagcacagagtgacaacatgacggataaatggcatatttacatgaccaaggatgggcggatctccttagctgggctgtccctggctaagtgtgattatcttgccgacgccatcatcgattccttccataatgtgaactaggctgaggtacgatagttgagggtcaagctattgatg

SEQ ID NO: 5450 - DNA, 271 bp, Zea mays
  Clone ID: 700041864H1
ctttttgttaagcgtggcatggaagtgtttgttgcacaatcttacagcaagaaccttggtctatattctgaaagggttggtgcgataaatgtcgtgtgctcagcaccagaagttgcagatagggtaaagagccagctgaaacgattggcacgtcccatgtactcgaacccccctattcacggtgccaagatagttgccaacgttgttggtgatccaatcatgtttggtgaatggaaacaagagatggagctaatggctggacggatcaaga

SEQ ID NO: 5451 - DNA, 251 bp, Zea mays
  Clone ID: 700157048H1
gccattctttgatgttgcatatcagggttttgccagtggaagccttgatgaagatgcattttctgtcaggctttttgttaagcgtggcatggaagtgtttgttgcacaatcttacagcaagaatcttggtttatattctgaaagggttggtgcaataaatgtcgtgtgctcagcaccagaagttgcagatagggtaaatagccagctgaaacgattggcacgtcccatgtactcgaacccccctattcacg

SEQ ID NO: 5452 - DNA, 263 bp, Zea mays
  Clone ID: 700581463H1
gccattctttgatgttgcatatcagggttttgccagtggaagccttgatgaagatgcattttctgtcaggctttttgttaagcgtggcatggaagtgtttgttgcacaatcttacagcaagaaccttggtttatattctgaaagggtgtgtgcaataaatgtcgtgtgctcagcaccagaagttgcagatagggtaaatagccagctgaaacgattggcacgtcccatgtactcgaacccccctattcacggtgccaagatag

SEQ ID NO: 5453 - DNA, 274 bp, Zea mays
  Clone ID: 700579938H1
tgaatggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattct

SEQ ID NO: 5454 - DNA, 252 bp, Zea mays
  Clone ID: 700432477H1
taaagagccagctgaaacgattggcacgtcccatgtactcgaacccccctattcacggtgccaagatagttgccaacgttgttggtgatccaatcatgtttggtgaatggaaacaagagatggagctaatggctggacggatcaaggatgtaagacagaagctctacgacagtttgtctgccaaggataagagcggcaaggactggtctttcattctgaggcagattggcatgttctcctacaccggcttga

SEQ ID NO: 5455 - DNA, 240 bp, Zea mays
  Clone ID: 700154706H1
gcacaatcttacagcaagaaccttggtttatattctgaaagggttggtgcaataaatgtcgtgtgctcagcaccagaagttgcagatagggtaaatagccagctgaaacgattggcacgtcccatgtactcgaacccccctattcacggtgccaagatagttgccaacgttgttggtgatccaaccatgtttggtgaatggaaacaagagatggagctaatggctggacggatcaagaat

SEQ ID NO: 5456 - DNA, 268 bp, Zea mays
  Clone ID: 700043761H1
caagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactaggctgagatatggagcaacaacgacggcggagaagctgttttgcgtccacgacacaagctg

SEQ ID NO: 5457 - DNA, 251 bp, Zea mays
  Clone ID: 700423679H1
tgtttggtgaatggaaacaagagatggagctaatggctggacggatcaagaatgtaagacagaagctctacgacagtttgtctgccaaggataagagcggcaaggactggtctttcattctgaggcagattggcaggtctcctacaacggcttgaacaaagcacagagttaccacatgacgggtaaatgggctaattaacatgaccaagatgggcggatctccttagctgggctgtccctggctaagtgtg

SEQ ID NO: 5458 - DNA, 249 bp, Zea mays
  Clone ID: 700424076H1
gtgattatcttgccgacgccatcatcgattccttccataatgtgaactaggctgaggtacgatagttgagggtcaagctattgatgtttagttccgtggacgctaggctgggatttttgggtccttccagctatacagctcttccgttgtgctccatctggtgtaacttggataaataaaaattttgtcgctgaactaaaactcgtgtgcttttttacctgtaactgtaaggtcagcgcgtggctacag

SEQ ID NO: 5459 - DNA, 193 bp, Zea mays
  Clone ID: 701166426H1
gtcgctgaactaaaaaatattttatgatccaagttacaccagatggagcacaacggaagagctgtatagctggaaggacccaaaaatcccagcctagcgtccacggaactaaacatcaatagcttgaccctcaactatcgtacctcagcctagttcacattatggaaggaatcgatgatggcgtcggcaagat

SEQ ID NO: 5460 - DNA, 314 bp, Zea mays
  Clone ID: 700211160H1
cggacgcgtggcgagacgcgtgggctcccttcttcagtgcagcagcaggccagcgagacccaccaccctcactcccgcctccgatccgctgcttactcgccacccggagatggccaccgccgccgccttctccgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacc

SEQ ID NO: 5461 - DNA, 285 bp, Zea mays
  Clone ID: 700043705H1
aagcgacgggcgtcatatcccatcctgatctctcctcccttcttcagtgcagcagcaggccagcagcacgccacccgccccactcctgcctccgatccgctgcttactcgccacccggagatggccaccgccgccgccttctccgtctcctcgccggcggcctccgccgtcgccgcgcgatccaaggtgtttggaggaggagttaaccaggcgagaactagaactggctgccgcgtcggcatcacgcggaagaactttggccgtgtcatgatggcccttgcagtg

SEQ ID NO: 5462 - DNA, 263 bp, Zea mays
  Clone ID: 700208983H1
cccacgcgtccgactagttctagttctcgcctggttaactcctccaaacaccttggatcgcgcggcgacggcggaggccgccggcgaggagacggagaaggcggcggcggtggccatctccgggtggcgagtaagcagcggatcggaggcggtagtgaggcgggtggcgtgccgctggcctgctgctgcactgaagaagggagcgccccctatatacggaggggcccgagctcatcgccgcggcccctccctccctgcgcctg

SEQ ID NO: 5463 - DNA, 116 bp, Zea mays
  Clone ID: 700101375H1
ctcccgcctccgatccgctgcttactcgccacccggagatggccaccgccgccgccttctccgtctcctcgccggcggcctccgccgtcgccgcgcgatccaaggtgtttggagga

SEQ ID NO: 5464 - DNA, 274 bp, Zea mays
  Clone ID: 700581970H1
ctttatgtatgatggaatggagcactactgcttagaagatgctcatattgtcaacctcttctcgttctcaaaggcttatggaatgatggggtggcgtgtaggatacattgcatttccaaatgaagctgatggcttccatgatcagctcctcaaggtgcaagacaacataccgatctgcgcctccatcatcgggcagcgctggcgctctactcgctggaggccggccccgagtggatcaaagaacgggtgaaagacctggtgaaaaaccgggcgc

SEQ ID NO: 5465 - DNA, 260 bp, Zea mays
  Clone ID: 700194282H1
atggagcactactgcttagaagatgctcatattgtcaacctcttctcgttctcaaaggcttatggaatgatggggtggcgtgtaggatacattgcatttccaaatgaagctgatggcttccatgatcagctcctcaaggtgcaagacaacataccgatctgcgcctccatcatcgggcagcgcctggcgctctactcgctggaggccggccccgagtggatcaaagaacgggtgaaagacctggtgaaaaaccgggcgct

SEQ ID NO: 5466 - DNA, 320 bp, Zea mays
  Clone ID: 700206971H1
ctttagggagctgccaggtgtcaagatatcggaacctcagggagccttctatttattcatcgacttcagctcgtactatgggtctgaggtggaaggttttggtaccatcaaggactctgagtccctctgtctgttcctgttggagaaggcacaggttgcgcttgtccctggggatgcatttggcgatgacaagggtgttcgcatttcatatgctgcagctatgtcgacactgcaaactgcaatgggaaagataaaagaagcgatggctctgctcaggcaccctgttgccgtttaacaaaaccaacgtatcgctaatcagt

SEQ ID NO: 5467 - DNA, 295 bp, Zea mays
  unsure (1)...(295): unsure at all n locations
  Clone ID: 700472363H1
gttgatcaataatccgtcacgtgtcaaggagtacctaccaatcaccggtctggctgaattcaataagctgagcgctaagcttatctttggcgctgacagccctgctattcaggagaatagggttgctaccgtgcagtgcctatcgggtactggttctttagaagtcggaggtgaatttcttgcaaggcactatcacgagcgcactatctacatcccacaaccaacctgggganatcacccaaagtcttcacctatctggcttgaacgtaggagctacgctatatgatctgcacat

SEQ ID NO: 5468 - DNA, 299 bp, Zea mays
  Clone ID: 700472263H1
gttgatcaataatccgtcacgtgtcaatgagtatctaccaatcaccggtctggctgaattcaataagctgagcgctaagcttatctttagcgctgacagccctactattcaggagaatagggttgctaccgtgcagtgcctatcgggtactggtactttaagagtcggaggtgaatttgcttgcaaggcactatcacgagcgcactatctacatcccacaaccaacctggggaaatcacccaaaagtcttcaccctatctggcttgaacgttaggagctaccgctattatgatcctgca

SEQ ID NO: 5469 - DNA, 267 bp, Zea mays
  Clone ID: 700806145H1
ctcgagccgcggtctggctgaattcaataagctgagcgctaagcttatctttggcgctgacagccctgctattcaggagaatagggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatg

SEQ ID NO: 5470 - DNA, 269 bp, Zea mays
  Clone ID: 700076939H1
ctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataa

SEQ ID NO: 5471 - DNA, 294 bp, Zea mays
  Clone ID: 700349974H1
gcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcata

SEQ ID NO: 5472 - DNA, 264 bp, Zea mays
  Clone ID: 700235923H1
agcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacct

SEQ ID NO: 5473 - DNA, 304 bp, Zea mays
  Clone ID: 700206180H1
cagacacctccgccacctccaccctcgaatcgttccccaccatggcgtcgcagggatcctccgtcttcgccgcactcgagcaggccccggtagaccccatcctcggagtgaccgttgcctacaacaaggatcccagccccatgaaggtcaacctcggggttggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaa

SEQ ID NO: 5474 - DNA, 284 bp, Zea mays
  Clone ID: 700476547H1
gcagcagacacctctcccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggc

SEQ ID NO: 5475 - DNA, 291 bp, Zea mays
  unsure (1)...(291): unsure at all n locations
  Clone ID: 700258893H1
cagacaccaccgccacctccancctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtagtcaggcgcgccgagcaaatgttgatcaataatccgtcacgtgtcaaggagtacctaccaatcaccggtctggctgaattcaata

SEQ ID NO: 5476 - DNA, 281 bp, Zea mays
  Clone ID: 700612236H1
gcagcagacacctcgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctg

SEQ ID NO: 5477 - DNA, 247 bp, Zea mays
  Clone ID: 700806537H1
cagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtc

SEQ ID NO: 5478 - DNA, 266 bp, Zea mays
  Clone ID: 700450338H1
gccacctccatcctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcacggtctg

SEQ ID NO: 5479 - DNA, 274 bp, Zea mays
  Clone ID: 700806243H1
cagcagacacctccgccacctccaccctcgaatcgttccccaccatggcgtcgacaggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcac

SEQ ID NO: 5480 - DNA, 299 bp, Zea mays
  Clone ID: 700263732H1
gtgcgcgctgcgcaggcgcaggcccccagcgccgaccgcagattaagtacgctagtggggcacctgctgccttcctccccacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaacgatcccagccccgtgaacgtcaacctcggggtcggcgcctaccggaccgaggaagggaagcccctagtgctgaacgt

SEQ ID NO: 5481 - DNA, 251 bp, Zea mays
  Clone ID: 700806094H1
cagacacctccgccacctccaccctcgaatcgttccccaccatggcgtcgcaaggatcctccgtcttcgccgcactcgagcaggcaccggaggacaccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtc

SEQ ID NO: 5482 - DNA, 237 bp, Zea mays
  Clone ID: 700152610H1
ctgacgcgtggctggacgcgtggggcagcagacacctccgccacctccaccctcgaatcgtaccccaccatggcgtcgcatggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtc

SEQ ID NO: 5483 - DNA, 175 bp, Zea mays
  Clone ID: 700614581H1
tgcgcctaccggaccgacgaagggaagccctagtgctgaacgtggtcaggcgcgccgagcaaatgttgatcaataatccgtcacgtgtcaaggagtacctaccaatcaccggtctggctcaattcaataagctgagcgctaagcttatctttagcgctgacagccctgctattca

SEQ ID NO: 5484 - DNA, 447 bp, Zea mays
  unsure (1)...(447): unsure at all n locations
  Clone ID: 700349161H1
agctgctttagcgtactaactcgnaatcgactcgacagcacagacacctccgccacctccactctcgaatcgttcccaccatggcgtcgcagcngatcctcgcgtcattcgcacgcagctcgagcgaggcactcgggagggacncgcatgcctccggacgtnggaccgtatgcactacatgacataaggatcccccagctcccagtganangggtcaaccattcggnggtcggcggccttacgtcggaccgagggaagggaagctcctagtgctgaacgtggtcaggcgcgccgagcanatgttgatcaataatccgtcacgtgtcaaggagtacctacaatcacagtcatgctgaattcataactgacgctaacttatcttgcgtgacagctgctatcagagataggtctacgtcatgctacggtctgtcttagatcgagtgatct

SEQ ID NO: 5485 - DNA, 274 bp, Zea mays
  Clone ID: 700805964H1
gacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtc

SEQ ID NO: 5486 - DNA, 163 bp, Zea mays
  unsure (1)...(163): unsure at all n locations
  Clone ID: 700450544H1
cagcagcagacacctccgccacctccaccctcgaatcgttccccaccatggcgtgctcggatcctccgtcttcgccgcactcgagcaggccccggaggaccccatcctcggtctcancgttgcctacaacaaggatcccagccccgtgaaggtcaacctcggg

SEQ ID NO: 5487 - DNA, 280 bp, Zea mays
  Clone ID: 700618252H1
tgacactccgccacctccaccctcgaatcgttccccactatggcgtcgcagggatcctccgtcttcgccgcactcgagcaggccccggaggaccccatcctcggagtgaccgttgcctacaacaagggatccagccccgtgaaagtcaacctcgggggtcggcgctaacggaaccgaggaagggaacccctagtgctgaacgtgttaagcgcgcgagcaatgttgatcataatcgtcagtgtcaggagtactaccatcacgttctgctgaatcatagctg

SEQ ID NO: 5488 - DNA, 128 bp, Zea mays
  unsure (1)...(128): unsure at all n locations
  Clone ID: 700615189H1
ctcgaatcgttcnccaccatggcgtcgcagggatcctccgtcttcgccgcactcgagcaggcaccggaggactccatcctcggagtgaccgttgcctacaacaaggatcncagccccgtgaaggtcaa

SEQ ID NO: 5489 - DNA, 183 bp, Zea mays
  Clone ID: 700264196H1
gcagacacctccgccacatccacactcgaatcgttccccaccatggcgtcgcagggatcctccgtcttcgccgcactcgagcaggccccggaggacaccatcctcggagtgaccgttgcctacaacaaggatcccagccccgtgaacgtcaacctcggggtcggcgcctacaggaccgaggaa

SEQ ID NO: 5490 - DNA, 324 bp, Zea mays
  Clone ID: 700211615H1
cccacgcgtccgggcggagacatgggtagcttcgctaagctggcgaggagggcggtggagacggacgctccggtcatggtgaagatacaagaactgctccgaggggccaaggatgtgatgtcgcttgcgcagggagttgtttactggcaacctcccgagtcagctatggataagatcgaaaagatcatcagggaaccaatagtcagtaaatatggttctgatgatgggcttcctgagcttcgagaagcacttctcgaaaagctaagcagagagaacaagcttaccaaatcatcagtcatggtcactgctggtgcaaatcaggct

SEQ ID NO: 5491 - DNA, 327 bp, Zea mays
  Clone ID: 700073508H1
gtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattc

SEQ ID NO: 5492 - DNA, 318 bp, Zea mays
  Clone ID: 700098793H1
gcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtacaggtactatgaccccaagactgttgggttggattttgagggaatgatagctgatattgaggctgctcctgaaggatcttttgttctgctacat

SEQ ID NO: 5493 - DNA, 319 bp, Zea mays
  Clone ID: 700101956H1
agagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtca

SEQ ID NO: 5494 - DNA, 301 bp, Zea mays
  Clone ID: 700100132H1
gaagctaaagtgctgatatcgtcgcctacctggggtaaccacaagaatatcttcaatgatgctagggtacttggtcagagtacaggtactatgaccccaagactgttgggttggattttgagggaatgatagctgatattgaggctgctcctgaaggatcttttgttctgctacatggttgtgctcacaacccaactggaatagacccaactcctgaacagtgggagaaaattgcagatgtcattccagagaaaaagcatatgacattctttgatgttgcatatcaaggttttgccagtgg

SEQ ID NO: 5495 - DNA, 264 bp, Zea mays
  Clone ID: 700799335H1
ttttgagggaatgatagctgatattgaggctgctcctgaaggatcttttgttctgctacatggttgtgctcacaacccaactggaatagacccaactcctgaacagtgggagaaaattgcagatgtcattcaagagaaaaagcatatgccattctttgatgttgcatatcaaggttttgccagtggaagccttgatgaagatgcattttctgtcaggctttttgttaagcgtggcatggaagtgtttgttgcacaatcttacag

SEQ ID NO: 5496 - DNA, 293 bp, Zea mays
  Clone ID: 700446909H1
attggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgc

SEQ ID NO: 5497 - DNA, 285 bp, Zea mays
  Clone ID: 700444305H1
tggattttgagggaatgatagctgacattgaggctgctcctgaaggttcttttgttctgctacatggttgtgctcacaacccaactggaatagacccaactcctgaacagtgggagaaaattgcagatgtcattcaagagaaaaagcatatgccattctttgatgttgcatatcagggttttgccagtggaagccttgatgaagatgcattttctgtcaggctttttgttaagcgtggcatggaagtgtttgttgcacaatcttacagcaagaaccttggtttat

SEQ ID NO: 5498 - DNA, 275 bp, Zea mays
  Clone ID: 700222187H1
caagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgcta

SEQ ID NO: 5499 - DNA, 268 bp, Zea mays
  Clone ID: 700093340H1
gataaaagcgcactgaagctcaatcttggtgttggtgcctataggacagaagagctgcagccatacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcag

SEQ ID NO: 5500 - DNA, 261 bp, Zea mays
  Clone ID: 700576310H1
agcagataaaagcgagctgaagctcaatcttggtgttggtgcctataggacagaagagctgcagccatacgtgctcaatgtagtcaagaaggctgaaaatcttatgttggagaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgt

SEQ ID NO: 5501 - DNA, 261 bp, Zea mays
  Clone ID: 700443474H1
tggattttgagggaatgatagctgacattgaggctgctcctgaaggttcttttgttctgctacatggttgtgctcacaacccaactggaatagacccaactcctgaacagtgggagaaaattgcagatgtcattcaagagaaaaagcatatgccattctttgatgttgcatatcagggttttgccagtggaagccttgatgaagatgcattttctgtcaggctttttgttaagcgtggcatggaagtgtttgttgcacaat

SEQ ID NO: 5502 - DNA, 247 bp, Zea mays
  Clone ID: 700440955H1
gagtgccaatggctcctccagacccaattcttggggtttctgaggcctttaaagcagataaaagcgagctgaagctcaatcttggtgttggtgcctataggacagaagagctgcagccctacgtgctcaatgtagtcaagaaggctgaaaatcttatgttggagaaaggagaaaacaaagagtatcttcccattgaaggtttagccgcgtttaacaaagcaacagcagagctattgcttggagctga

SEQ ID NO: 5503 - DNA, 293 bp, Zea mays
  Clone ID: 700446111H1
caaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgatgcttagggaccttggtcagagtaca

SEQ ID NO: 5504 - DNA, 281 bp, Zea mays
  Clone ID: 700259835H1
ctcgagccgtgcagccatacgtgctcaatgtagtcaagaaggctgaaaatcttaagttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcacagcgtctcgctgcagcattcatacaaagatactttcctgaagctaaagtgctgatatcgtcgcctacctggggt

SEQ ID NO: 5505 - DNA, 262 bp, Zea mays
  Clone ID: 700551206H1
gagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaagctaaagtgctgatatcgtcgcctacctggggtaaccacaagaatatcttcaatgtgctagggtacttggtca

SEQ ID NO: 5506 - DNA, 278 bp, Zea mays
  Clone ID: 700445905H1
tggattttgagggaatgatagctgacattgaggctgctcctgaaggtgcttttgttctgctacatggttgtgatcacaacccaactggaatagacccaactcctgaacagtgggagaaaattgcagatgtcattcaagagaaaaagcatatgccattctttgatgttgcatatcagggttaggtcagtggaagccttgatgaagatgcattttctgtcaggctttttgttagcgtagcatggaagtgtttgttgcacaatcttacagcaagaacttgg

SEQ ID NO: 5507 - DNA, 180 bp, Zea mays
  Clone ID: 700446192H1
cggattttgagggaatgatagctgacattgaggctgctcctgaaggttcttttgttctgctacatggttgtgctcacaacccaactggaatagacccaactcctgaacagtgggagaaaattgcagatgtcattcaggagaaaaagcatatgccattctttgatgttgcatatcagggtt

SEQ ID NO: 5508 - DNA, 210 bp, Zea mays
  Clone ID: 700614693H1
catggttgtgctcacaacccaactggaatagacccaactcctgaacatgggagaaaattgcagatgtcattcaagagaaaaagcatatgccattcttggatgttgcatatcagggttttgccagtggaagccttgatgaagatgcattttctgtcaggctttttgttaagcgtggcatggaagtgtttgttgcacaatcttacagcaaga

SEQ ID NO: 5509 - DNA, 292 bp, Zea mays
  Clone ID: 700439746H1
gtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccgaattttccttgaagatggacaccaaattggatgtgctcagtcatacgcaaagaacatgggactttatggacagagagcaggatgcctgagtattctgtgtgaggatgagatgcaagcagttgctgtcaagagccaactgca

SEQ ID NO: 5510 - DNA, 290 bp, Zea mays
  Clone ID: 700621225H1
ggcataccaagggtttgccagtggtgatccagagagagatgccaaggcaatccgaattttccttgaagatggacaccaaattggatgtgctcagtcatacgcaaagaacatgggactttatggacaaagagcaggatgcctgagtattttgtgtgaggatgagatgcaagcagttgctgtcaagagccaaatgcaacagatcgcaagaccaatgtacagcaacccacctgttcatggtgcactggttgtctctataatcctcagtgatccagaattgaagagttgtggtt

SEQ ID NO: 5511 - DNA, 281 bp, Zea mays
  Clone ID: 700456918H1
cttcattcttttagcttcatgtatatagatctaaatctagaggtgtagatcctacggacgaacaatggagagatatatcccatcagttcaaggtgaaaaaacattttccattctttgacatggcataccaagggtttgccagtggtgatccagagagagatgccaaggcaatccgaattttccttgaagatggacaccaaattggatgtgctcagtcatacgcaaagaacatgggactttatggacaaagagcaggatgcttgagtattttgtgtgaagat

SEQ ID NO: 5512 - DNA, 175 bp, Zea mays
  Clone ID: 700453876H1
gttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccg

SEQ ID NO: 5513 - DNA, 136 bp, Zea mays
  Clone ID: 700623616H1
aaaacattttccattctttgacatggcataccaagggtttgccagtggtgatccagagagagatgccaaggcaatccgaattttccttgaagatggacaccaaattggatgtgctcagtcatacgcaaagaacatg

SEQ ID NO: 5514 - DNA, 181 bp, Zea mays
  Clone ID: 700454592H1
gttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccgaatttc

SEQ ID NO: 5515 - DNA, 177 bp, Zea mays
  Clone ID: 700454593H1
gttcatactttttgcttcatgcatgtgctcataatcccaccggtgtaaaactacggagaacaatggagagaaatatcacatcagttcaaggtgaaaaaacattttccatactttgacatggcataccaagggtttgccagtggtgatccagagagagatgccaaggcgatccgaatt

SEQ ID NO: 5516 - DNA, 259 bp, Zea mays
  Clone ID: 700197666H1
gtcaactgtccctaggacagatattattttcttttgttcacccaacaatcctactggtgctgctgcatctcgggaccaactaaccaaattagtaaaatttgcaaaggacaacgggtccatcatagtctatgattctgcttatgcaatgtacatatcagatgacagcccaaagtctatctttgaaattcctggagcaaaggaggttgctattgagacagcctcattctcgaagtacgctgggttcacaggtgtccgtcta

SEQ ID NO: 5517 - DNA, 343 bp, Zea mays
  Clone ID: 700615228H1
tgacagcccaaagtctatctttgaaattcctggagcaaaggaggttgctattgagacagcctcattctcgaagtacgctgggttcacaggtgtccgtctaggttggactgttgtcgccaaggagctccttttctcggatggacatccagttgctaaagatttcaatcgcatagtttgcacttgcttcaatgggcatcaaacattgcgcaactggtggtttagcctgcctctctccagacggtctaaaggctatgcaagatgttgttggcttctacaaggagaacactgaaataatcgttgagacatttacatcactcggattcgacgtctatggcgcaaagac

SEQ ID NO: 5518 - DNA, 171 bp, Zea mays
  unsure (1)...(171): unsure at all n locations
  Clone ID: 700030129H1
ccaaagtctatctttgacattcctggagcaaaggaggttgctattgagacagcctcattctcgaaatacgctgggttcacaggtgtccgtctaggttggactgttgtccccaaggagctccttttctcggatggacatccagttgctanagatttcaatcgcatagtttgc

SEQ ID NO: 5519 - DNA, 256 bp, Zea mays
  Clone ID: 700579227H1
ctgacttatatcagcaagacgttcagaagtatggaaacattgagtacatgagatgcggtccagaaaatggattttttcctgatctgtcaactgtccctaggacagatattattttcttttgttcacccaacaatcctactggtgctgctgcatctcgggaccaactaaccaaattagtaaaatttgcaaaggacaatgggtccatcatagtctgtgattctgcttatgcaatgtacatatagatgacagcccaaag

SEQ ID NO: 5520 - DNA, 299 bp, Zea mays
  unsure (1)...(299): unsure at all n locations
  Clone ID: 700476002H1
gctccttcaggttcaattgtactgctgncatgcctgtgctcacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtatgtaaagtgccgatgt

SEQ ID NO: 5521 - DNA, 297 bp, Zea mays
  unsure (1)...(297): unsure at all n locations
  Clone ID: 700461103H1
aagaacttctcatgggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgatangatcattaacatgaggcaacaactatttaatgcgctgaaatccagaggaacc

SEQ ID NO: 5522 - DNA, 279 bp, Zea mays
  Clone ID: 700240702H1
gtatgtttgttgctgatggtggtgaacttctcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgg

SEQ ID NO: 5523 - DNA, 269 bp, Zea mays
  Clone ID: 700470851H1
gctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttc

SEQ ID NO: 5524 - DNA, 318 bp, Zea mays
  unsure (1)...(318): unsure at all n locations
  Clone ID: 700262654H1
gtttgttgctgatggtggtgaacttctcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcataacatgaggcaacaatatttaatgcgctgaaatccagangaacccctggtg

SEQ ID NO: 5525 - DNA, 282 bp, Zea mays
  unsure (1)...(282): unsure at all n locations
  Clone ID: 700452647H1
tttgganatcacccaaaagtcttcaccctatctggcttgaacgttaggtgctaccgctattatgatcctgcaacatgcagccttcacttcgaaggactcctggaagacctcggttctgctccttcaggttcaattgtactgctgcatgcctgtgctcacaaccctactggagtagatcctaccatcgaacagtgggaacagattaggcagctgatgagatcaaaatcactgcttccgttctttgacagtgcctatcaaggctttgcaagtggaagtcttgac

SEQ ID NO: 5526 - DNA, 260 bp, Zea mays
  Clone ID: 700194349H1
gttgctgatggtggtgaacttctcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggat

SEQ ID NO: 5527 - DNA, 302 bp, Zea mays
  Clone ID: 700472225H1
gggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagatgaacgctattatgatcctgcaacatgcagccttcacttcgaaggactcctggaagacctcggttctgctccttcaggttcaattgtactgctgcatgcctgtgctcacaaccctactggagtagatcctaccatcgaacagtg

SEQ ID NO: 5528 - DNA, 280 bp, Zea mays
  unsure (1)...(280): unsure at all n locations
  Clone ID: 700461203H1
cgaacttctcatggctcagagctacgctaagancatgggattgtatggngagcgtgttggcgctttgagcattgtatgtnaaagtgccgatgtagctgttagggttganagtcaactcaaacttgtcatcaggcctatgtattcaaaccctcctcttcatggtgcctctatcgttgctaccatactcagggacagcgagatgttcaacgaatggactctggaactgaaggccatggctgataggntcttaacatgaggcaacaactatttaatgcgctga

SEQ ID NO: 5529 - DNA, 264 bp, Zea mays
  Clone ID: 700581588H1
acttctcatggctcagagctacgctaagaacatgggattgtatggagagcgtgttggcgctttgagcattgtatgtaaaagtgccgatgtagctgttagggttgaaagtcaactcaaacttgtcatcaggccatgtattcaaaccctcctcttcatggtgcctctatcgttgctaccatactcagggacagcgagatgttcaacgaatggactctggaactgaaggccatggctgataggatcattaacatgaggcaacaactt

SEQ ID NO: 5530 - DNA, 252 bp, Zea mays
  Clone ID: 700194330H1
caggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtcgcattcatgaggcaggaataccacatttatatgacatctgatgggaggatcagcatggccggtttgagcatg

SEQ ID NO: 5531 - DNA, 254 bp, Zea mays
  Clone ID: 700194016H1
taagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtcgcattcatgaggcaggaataccacatttatatgacatctgatgggaggatcagcatggccggtttgagcatgaggactgtgc

SEQ ID NO: 5532 - DNA, 254 bp, Zea mays
  Clone ID: 700157347H1
gtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattggg

SEQ ID NO: 5533 - DNA, 255 bp, Zea mays
  Clone ID: 700195805H1
ctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggc

SEQ ID NO: 5534 - DNA, 235 bp, Zea mays
  Clone ID: 700160255H1
gattaggcagctgatgagatcaaaatcactgcttccgttctttgacagtgcctatcaaggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtatgtaaaagtgccgatgtagctgttagggttgaaagt

SEQ ID NO: 5535 - DNA, 272 bp, Zea mays
  unsure (1)...(272): unsure at all n locations
  Clone ID: 700582138H1
acttctcatggctcagagctacgctaagaacatgggattgtatggagagcgtgttggcgctttgagcattgtatgtaaaagtgccgatntagctgttagggttgaaagtcaactcaaacttgtcancaggcctatgtattcaaaccctcctcttcatggtgcctctatcgttgctaccatannncaggacagcgagatgttcaacgaatggactctggaatgaaggccatggctgataggatcataacatgaggcaacaactattaatgcgc

SEQ ID NO: 5536 - DNA, 243 bp, Zea mays
  Clone ID: 700197148H1
caggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactgggctgaatagcgaacaagtcgcatt

SEQ ID NO: 5537 - DNA, 241 bp, Zea mays
  Clone ID: 700159366H1
gtcttgacaaagatgctcagtcagtgcgtatgtttgttgctgatggtggtgaacttctcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcaggga

SEQ ID NO: 5538 - DNA, 254 bp, Zea mays
  Clone ID: 701184326H1
tgagaagttcaccaccatcagcaacaaacatacgcactgactgagcatctttgtcaagacttccacttgcaaagccttgataggcactgtcaaagaacggaagcagtgattttgatctcatcagctgcctaatctgttcccactgttcgatggtaggatctactccagtagggttgtgagcacaggcatgcagcagtacaattgaacctgaaggagcagaaccgaggtcttccaggagtccttcgaagtgaagg

SEQ ID NO: 5539 - DNA, 221 bp, Zea mays
  Clone ID: 700159491H1
gattaggcagctgatgagatcaaaatcactgcttccgttctttgacagtgcctatcaaggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgtatgtaaaagtgccgatgtagctg

SEQ ID NO: 5540 - DNA, 328 bp, Zea mays
  Clone ID: 700104663H1
ctagttctagatcgccagccgccgctcgggccgctcgatctagaactagcccacgcgtccgcggacgcgtggcacgagcgcactatctacatcccacaaccaatcctggggaaatcacccaaaagtcttcacactatctggcttgaacgttaggagctaccgctattatgatcctgcaacatgcagccttcacttcgaaggactcctggaacacctcggttctgctccttcaggttcaattgtactgctgcatgcctgtgctcacaaccctactggagtagatcctaccatcgaacagtgggaacagattaggcagctgatgagatca

SEQ ID NO: 5541 - DNA, 272 bp, Zea mays
  Clone ID: 700195003H1
atatcattaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtatctactggttgacc

SEQ ID NO: 5542 - DNA, 249 bp, Zea mays
  unsure (1)...(249): unsure at all n locations
  Clone ID: 700218254H1
cggaacgctggttntaatgcgctgaaatccagaggaacccctggtgattggagccatatcaanaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtat

SEQ ID NO: 5543 - DNA, 224 bp, Zea mays
  Clone ID: 700802451H1
gcgagatgttcaacgaatggactctggaactgaaggccatggctgataggatcattaacatgaggcaacaactatttaatgcgctgaaatccagaggaacccctggtgattggagccatatcattaagcaaattggatgtttactttcactgggctgaatagcgaacaagtcgcattcatgaggcaggaataccacatttatatgacatctgatgggaggatca

SEQ ID NO: 5544 - DNA, 234 bp, Zea mays
  Clone ID: 700157772H1
atccagaggaacccctggtgattggagccatatcattaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgacatgaggctagtatcgcagctttcg

SEQ ID NO: 5545 - DNA, 280 bp, Zea mays
  Clone ID: 700473425H1
gggttgctaccgtgcagtgcctatcgggtactggttctttaagagtcggaggtgaatttcttgcaaggcactatcacgagcgcactatctacatcccacaaccaacctggggaaatcacccaaaagtcttcaccctatctggcttgaacgttaggagctaccgctattatgatcctgcaacatgcagccttcacttcgaaggactcctggaaagactcggttctgctacttcaggttcattgtactgctgcatgcctgtgctcacaacctactggagtag

SEQ ID NO: 5546 - DNA, 278 bp, Zea mays
  Clone ID: 700800486H1
gtgaaatccagaggaacccctggtgattggagccatatcattaagcgaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagta

SEQ ID NO: 5547 - DNA, 229 bp, Zea mays
  unsure (1)...(229): unsure at all n locations
  Clone ID: 700185039H1
ggaggtgaatttcttgcaaggcactatcacgagcgcactatctacatcccacaaccaacctggggaaatcacccaaaagtcttcaccctatctggcttgaacgttaggngctaccgctattatgatcctgcaacatgcagccttcacttcgaaggactcctggaagacctcggttctgctccttcaggttcaattgtactgctgcatgcctgtgctcacaaccctactg

SEQ ID NO: 5548 - DNA, 268 bp, Zea mays
  Clone ID: 700800057H1
aagtcgcattcatgaggcaggaataccactttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtatttactggttgacctactgtagtttgcgtcggaatagatatgtttttttactcttcgtgggg

SEQ ID NO: 5549 - DNA, 279 bp, Zea mays
  Clone ID: 700451832H1
cccctggtgattggagccatatcattaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtattt

SEQ ID NO: 5550 - DNA, 209 bp, Zea mays
  Clone ID: 700799994H1
gtcttgacaaagatgctcagtcagtgcgtatgtttgttgctgatggtggtgaacttctcatggctcagagctacgctaagaacatgggattgtatggagagcgtgttggcgctttgagcattgtatgtaaaatgccgatgtagctgttagggttgaaagtcaactcaaacttgtcatcaggcctatgtattcaaaccctcctcttcatg

SEQ ID NO: 5551 - DNA, 270 bp, Zea mays
  Clone ID: 700801486H1
agcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtattactggttgacctactgtag

SEQ ID NO: 5552 - DNA, 187 bp, Zea mays
  Clone ID: 700802086H1
ctgaaatccagaggaacccctggtgattggagccatatcattaagcaaattgggatgtttactttcactgggctgaatagcgaacaagtcgcattcaatgaggcaggaataaccacatttatatgacatctgatgggaggatcagcatggccggtttgagcatgaggactgtgccccatcttcaaga

SEQ ID NO: 5553 - DNA, 214 bp, Zea mays
  Clone ID: 700477105H1
ttgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgacatgaggctagtatcgcagctttcgtgaataaaacctgaatcacccaca

SEQ ID NO: 5554 - DNA, 188 bp, Zea mays
  Clone ID: 700260426H1
tgtagctgttaggattgaaagtcaactcaaacttgtcatcaggcctatgtattcaaacccacctcatcatggtgcctctatcgtagctaccatactcagcgacagcgagatgttcaacgaatggacactggaacagaaggccatggctgataggatcattaacatgaggcaacaactatttaatgcgc

SEQ ID NO: 5555 - DNA, 256 bp, Zea mays
  Clone ID: 700799811H1
ctgaaatccagaggaaccccggtgattggagccatatcattaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgtcgcagttactcaactgaaatgaggatagtatcgcagctttcgtgaataaacctgaatcac

SEQ ID NO: 5556 - DNA, 263 bp, Zea mays
  Clone ID: 700427005H1
tgagccatatcattaagcaaattgggatgtttactttcactgggctgaatagcgaacaagtcgcattcatgaggcaggaataccacatttatatgacatctgatgggaggatcagcatggccggtttgagcatgaggactgtgacccatcttgcagatgccatacacgctgcagttactcaactgaaatgaggatagtatcgcagctttcgtgaataaaacctgaatcacccacaacaatgttctaagtactcagccagtggt

SEQ ID NO: 5557 - DNA, 241 bp, Zea mays
  Clone ID: 700803487H1
atgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcaaccagtggtatttactggttgacctactgtagtttgcgtcggaatagatatgtttttttactcttcgtggggcagtttt

SEQ ID NO: 5558 - DNA, 162 bp, Zea mays
  Clone ID: 700262695H1
gtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactattta

SEQ ID NO: 5559 - DNA, 151 bp, Zea mays
  Clone ID: 700471602H1
ctcgagcgcgctgaaatccagaggaacccctggtgattggagccatatcattaagcatattgggatgtttactttcactgggctgaatagcgaacaagtcgcattcatgaggcaggaataccacatttatatgacatctgatgggaggatc

SEQ ID NO: 5560 - DNA, 276 bp, Zea mays
  Clone ID: 701185813H2
tgccggtttgagcatgaggactgtgccccatcttgcagatgccatacacgctgcagttactcaactgaaatgaggatagtatcgcagctttcgtgaataaaacctgaatcacccacaacaatgttctaagtactcagccagtggtatttactggttgacctactgtagtttgcgtcggaatagatatgtttttttactcttcgtggggcagttttgtactggtggattcataaggactctgattatggtgcgttcggaacttataataataagcac

SEQ ID NO: 5561 - DNA, 112 bp, Zea mays
  Clone ID: 700196744H1
ctgagatcaaaatcactgcttccgttctttgacagtgcctatcaaggctttgcaagtggaagtcttgacaaagatgctcagtcagtgcgtatgtttgttgctgatggtggtg

SEQ ID NO: 5562 - DNA, 164 bp, Zea mays
  Clone ID: 701184204H1
acccacaacaatgttctaagtactcagccagtggtatttactggttgacctactgtagtttgcgtcggaatagatatgtttttttactcttcgtggggcagttttgtactggtggattcataaggactctgattatggtgcgttcggaacttataataataagc

SEQ ID NO: 5563 - DNA, 173 bp, Zea mays
  Clone ID: 700622453H1
caatgttctaagtactcagccagtggtatttactggttgacctactgtagtttgcgtcggaatagatatgtttttttactcttcgtggggcagttttgtactggtggattcataaggactctgattatggtgcgttcggaacttataataataagcacatgaaattttgcttc

SEQ ID NO: 5564 - DNA, 173 bp, Zea mays
  Clone ID: 700618768H1
caatgttctaagtactcagccagtggtatttactggttgacctactgtagtttgcgtcggaatagatatgtttttttactcttcgtggggcagttttgtactggtggattcataaggcctctgattatggtgcgttcggaacttataataataagcacatgaaattttgcttc

SEQ ID NO: 5565 - DNA, 429 bp, Zea mays
  Clone ID: LIB3059-009-Q1-K1-C12
atccgaattttccttgaagatggacaccaaattggatgtgctcagtcatacccaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacc

SEQ ID NO: 5566 - DNA, 325 bp, Zea mays
  Clone ID: LIB3059-022-Q1-K1-H6
tcgcaaactcttcaattctggatcactgaagagctggaggcacttaaggaaaatctggaagagctaggttcacctttgtcatgtgatcatatcactaatcagattggaatgttctgctacagtgggatgacacctgaacaagtttaccgtttaacaaatgaataccagagttacattacccgtaatgggaggataagctttgctggtgttacgacaggatatgttgactacctttcatatgcaattcatgaggttaccaaaccaaattgagttagggtcctaccttctttggtcgatggaagctgatggaatgagactgttaagc

SEQ ID NO: 5567 - DNA, 279 bp, Zea mays
  Clone ID: LIB3059-055-Q1-K1-E5
cgaagagccaactgcaacagatcgcatgaccaatgtacagcaacccacctggtcagtgtgcactggttgtttgtataatcctcagtgatccagaattgaagagtttgtggttaaaagaagtcaagggtatggctgatcgtatcattggaatgcgtaattcacttaaggataaatcttaatagctaggttcacctttgttatggtatcatatatttaattattattgtattgttctttttttgttttatttatttttttttttttttttttttttttttt

SEQ ID NO: 5568 - DNA, 355 bp, Zea mays
  unsure (1)...(355): unsure at all n locations
  Clone ID: LIB3062-040-Q1-K1-H1
gccagctgaaacgattggcacgtcccatgtnttcgaacccccctattcacggtgccaaganggttggnaacnttggtggtgatgcaaccantgtttggtnaaatggaaacangagttgggtctaatngcttgancgantcnaagatngtaananaaaannttaaaaacaggttntttttcaaaggncaaaaaccgcaagaactgggnttttatttnnaggggntattgnaatgtttttttanacggntttaaaaaaanncantgggnaacattgcggntnanntggatnttatttgacaaangnnggggggatttgnaaanatggggtntcctgggttaacggggatatttttgc

SEQ ID NO: 5569 - DNA, 442 bp, Zea mays
  Clone ID: LIB3067-014-Q1-K1-B8
cggacgcgtgggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaggcacttaaggaaaatcttgaaaagctaggttcacctttgtcatgggatcatatcactaatcagattggaatgttctgctacagtgggatgacacctgaacaagttgaccgtttaacaaatgaataccacatttacatgacccgcaatgggtggataagcatggctggtgttacgacaggaaatgttggttacctagcaaattcttttcatgaggttaccaaactcaatttagttatggtcctaccttcttt

SEQ ID NO: 5570 - DNA, 471 bp, Zea mays
  unsure (1)...(471): unsure at all n locations
  Clone ID: LIB3069-012-Q1-K1-F3
gctagcagccgcctcctcgtcaggccntttttncttcaccctcgccaaacccgcctcctnnggtccgaactccgtctgcttcatctgagcgtccgggaggacaaaacacgcggcgaggaccaggatggcgattgtgcgggaggaggcaagtggacacgtccatcagcccaagggtgagcgcgctgcggccgtccaaaaccatggccatcaccgatnaggccatggcgctgcggcaggccggcgtgccggttatcggtctagccgcgggggagccagacttncgacacgcnccccgtgatcgnggangcccggattgatgcaattaggaatggttatacaaagatacacttntaatgctgggacttttgaactgangaangggtatttntactaaaacttnangaggagaacgggggnttctaacttccaaatnaaggtcttngtaacaanggaactaaaaantnnnntana

SEQ ID NO: 5571 - DNA, 433 bp, Zea mays
  Clone ID: LIB3079-007-Q1-K1-B3
caaaagcccacagcttcttctccctactcctccagtcctccgtcatccgtttcggtcgctgccgccgccaccgcacaagaagctagctcctgcctgtaccgccccgtcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcgtcaagatgattgaagagtcac

SEQ ID NO: 5572 - DNA, 237 bp, Zea mays
  Clone ID: LIB143-052-Q1-E1-E4
cggacacgtgggtctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcgtcgctcttcggccacgtcgagccggcgcccaaggaccccatcctcggcgtcaccgaggctttcctcgccgacccctcgtccgac

SEQ ID NO: 5573 - DNA, 371 bp, Zea mays
  Clone ID: LIB3078-040-Q1-K1-H1
ccattctttgatgttgcatatcaaggttttgccagtggaagccttgatgaagatgcattttctgtcaggctttttgttaagcgtggcatggaagtgtttgttgcacaatcttacagcaagaaccttggtctatattctgaaagggttggtgcgataaatgtcgtgtgctcagcaccagaagttgcagatagggtaaagagccagctgaaacgattggcacgtcccatgtactcgaacccccctattcacggtgccaagatagttgccaacgttgttggtgatccaatcatgtttggtgaatggaaacaagagatggagctaatggctggacggatcaagaatgtaagacagaagctctacgacagtttgtc

SEQ ID NO: 5574 - DNA, 433 bp, Zea mays
  Clone ID: LIB3062-040-Q1-K1-H3
acggccaggtgaaacgattggcacgtaccatgtattcgataccccgctattcacggtgccaagatggttggcgaacgttgttggtgatgcaaccatgtttggtgaatggaaacaagagatggagctaatggctggactgatcaagaatgtaagacaaaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactatgctgaagtactatagttgagggtcaagctattgatgttt

SEQ ID NO: 5575 - DNA, 362 bp, Zea mays
  Clone ID: LIB143-054-Q1-E1-F1
acccacgcgtccgggaaacaagagatggagctaatggctggacggatcaagaatgtaagacagaagctctacgacagtttgtctgccaaggacaagagcggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactaggctgaggtacgatagttgagggtcaagctattgatgtttagttccgtggacgctaggctggg

SEQ ID NO: 5576 - DNA, 493 bp, Zea mays
  unsure (1)...(493): unsure at all n locations
  Clone ID: LIB83-001-Q1-E1-A10
gtncgcagtttaggaacgttagcctgtcagtacgcgtcgaaattccaaggtcccaccaagccttcgtaggaaccaaaaaatggaccaaatggctggacggttaaaaaatgtaagacagaacctctacaacagtttgtctgccaaggacaaaaccggcaaggactggtctttcattctgaggcagattggcatgttctcctacaccggcttgaacaaagcgcagagtgacaacatgacggataaatggcatatttacatgaccaaggatgggcggatctcgttagctgggctgtccctggctaagtgtgattatcttgccgacgccatcatcgattccttccataatgtgaactaagctgaggtacgatagttgagggtcaagctattgatgtttagttccgtggacgctaggctgggatttttgggtccttccagctatacagctcttcccgttgtgctcaatctggtgtaacttggataaataaaattttgt

SEQ ID NO: 5577 - DNA, 336 bp, Zea mays
  Clone ID: LIB36-018-Q1-E1-D12
cccgcctccgatccgctgcttactcgccacccggagatggccaccgccgccgccttctccgtctcctcgccggcggcctccgccgtcgccgcgcgatccaaggtgtttggaggagttaagcaggcgagaactagaactggctgccgcatctgcatcacgcggaagaactttggccgtgtcatgatggcccttgcagtggatgtttctcgttttgaaggactgccaatggctcctccagacccaattcttggggtttctgaggcctttaaagcagagtagagcgagctgacgctcaatcttggtgttggtgcctataggacagaggagctgcagcca

SEQ ID NO: 5578 - DNA, 422 bp, Zea mays
  Clone ID: LIB3059-012-Q1-K1-G3
cgaaaagctaagcagagagaacaagcttaccaaatcatcagtcatggtcactgctggtgcaaatcaggcttttgtgaacttggtcctcactctttgtgatgctggtgattccgttgtcatgtttgcaccgtattatttcaatgcctacatgtcattccagatgacaggtgttactgacatattagttggtggctgcgatcccaagacacttcatcctgatgttgattggttggagaaggttctgaaagaaaatgagcctatccctaaacttgtcactgttgtgaatccggggaacccctgtggagcttttatttcaaggcctatgcttgagagaatttcagatctgtgcaaaaatgctggtgcatggcttgtggttgacaatacctatgagtactttatgtatgatggaatggagcactact

SEQ ID NO: 5579 - DNA, 389 bp, Zea mays
  unsure (1)...(389): unsure at all n locations
  Clone ID: LIB143-022-Q1-E1-G3
agacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatanggttgctaccgtgcagtgcctatcgggtactggttctttaagag

SEQ ID NO: 5580 - DNA, 382 bp, Zea mays
  unsure (1)...(382): unsure at all n locations
  Clone ID: LIB143-048-Q1-E1-G12
gcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatanggttgctaccgtgcagtgcctatcgggtactg

SEQ ID NO: 5581 - DNA, 337 bp, Zea mays
  Clone ID: LIB143-001-Q1-E1-H6
ctcgaatcgatccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaattcaataagctgagcgctaagcttatctttggcgctgacagccctgctattcaggagaatagggttgctaccgtgc

SEQ ID NO: 5582 - DNA, 429 bp, Zea mays
  Clone ID: LIB143-002-Q1-E1-H2
gtccgacgtcccaccggcccccgctctcgttttcccccgccggaacaagcacgctcaagcgctgcgcaacggattggccctgctaacgttcgccccgggcaagggcaaggccccaacgcccaacgcaaggtaagttagccaattgggcaactggcggctttctccccaagaaaaacaacaagcaaaaacttcggcaacctcaaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacg

SEQ ID NO: 5583 - DNA, 411 bp, Zea mays
  Clone ID: LIB148-034-Q1-E1-F3
acgcccacctggagagctactcgcgcgtgctcgagagcctggcgtacagcgtcatgtcccgcatcgaggacgtgctgagcgcggacgcggcggcgcagaacctgacggcgagcgaggcggcgcggcgagcgctggagtcgacgtcggcggagctgcccgcggcgcggaagctggacgccaaggaggagctggagaagctgaacgaggccccggcgtcgatgacgctgttcgacttcatgggctggcacttcgaccaggacgagctgatgaagcgcagggaggacggcacactggacgcggacggggaggccatgctcctcaagaaggcgcctagcatggcccccaagaagttctcctacgtcgacagcctctcctccggcggcatgaggagcccctccgcgcgccactgat

SEQ ID NO: 5584 - DNA, 417 bp, Zea mays
  Clone ID: LIB148-032-Q1-E1-H8
ccacgcgtccgcgggtacgccctcctggagagctactcgcgcgtgctggagagcctggcgtacagcgtcatgtcccgcatcgaggacgtgctgagcgcggacgcggcggcacagaacctgacggcgaccgaggcggcgcggcgggtgctggagtcggcggacctgctcgcgccgcggaagctggacgccaaggaggagctggagaagctgaacgaggccccggcgtcgatgacgctcttcgacttcatgggctggcacttcgaccaggacgagctgatgaagcgcagggaggacggcacgctggacgccgacggcgaggccatgctcctcaagaaggcgcccagcgtggcgcccaagaagttctcctacgtcgacagcctctcctccggcggcatgaggagcccctctgcgcgccac

SEQ ID NO: 5585 - DNA, 411 bp, Zea mays
  Clone ID: LIB3062-033-Q1-K1-G2
aacaaagcaacagcagagctattgcttggagctgataaccctgttattaatcaaggactggttgctgcacttcagtctctctcgggcactggatcactgcgtctcgctgcagcattcatacaaagatactttcctgaagctaaagtgctgatatcgtcgcctacctggggtaaccacaagaatatcttcaatgatgctagggtaccttggtcagagtaccggtattatgaccccaagactgttgggttggattttgagggaatgatagctgacattgaagctgctcctgaaggttcttttgttctgctacatggttgtgctcacaacccaactggaatagacccaactcctgaacagtgggagaaaattgcagatgtcattcaagagaaaaagcatatgccattctttgat

SEQ ID NO: 5586 - DNA, 441 bp, Zea mays
  unsure (1)...(441): unsure at all n locations
  Clone ID: LIB3062-033-Q1-K1-G3
tgagggtggagagtgatttgaannttcccagtctcncagtcgcnatatctctggaattaccttatcgacccaggcgtcctaacaaagcaacatcagagctattgcttggttctgattaccctgttattaatcaaggactgtgtgctgcactacagtctctctggggcactggatcactgcgtctcgctgcagcattcatacaaagatactttcctgaagctaaagtgctgatatcgtctcctacctggggtaaccacaagaatatcttcaatgatgctagggtaccttggtcagagtaccggtattatgaccccaagactgttgggttggattttgagggaatgatagctgacattgaggctgctcctgaacgttcttttgttcttctacatggtttgttctcacaacccaactggaatagacccaactccttaacatttt

SEQ ID NO: 5587 - DNA, 318 bp, Zea mays
  Clone ID: LIB3060-005-Q1-K1-C1
gttggtgcctataggacagaagagctgcagccatacgtgctcaatgtagtcaagaaggctgaaaatcttatgttggagaaaggagaaaacaaagagtatcttcccattgaaggtttagccgcgtttaacaaagcaacagcagagctattgcttggagctgataaccctgttattaatcaaggactggttgctacacttcagtctctctcgggcactggatcactgcgtctcgctgcagcattcatacaaagatactttcctgaaactaaagtgctgatatcgtcgcctacctggggtaaccacaagaatatcttcaat

SEQ ID NO: 5588 - DNA, 427 bp, Zea mays
  Clone ID: LIB3059-004-Q1-K1-F4
cggacgcgtgggcaagaatgctccagatggttcattctttttgcttcatgcatgtgctcataatcccaccggtgtagatcctacggaggaacaatggagagaaatatcccatcagttcaaggtgaaaaaacattttccattctttgacatggcataccaagggtttgccagtggtgatccagagagagatgccaaggcaatccgaattttccttgaagatggacaccaaattggatgtgctcagtcatacgcaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattg

SEQ ID NO: 5589 - DNA, 497 bp, Zea mays
  unsure (1)...(497): unsure at all n locations
  Clone ID: LIB3061-042-Q1-K1-E8
ggggggntaaagggggantttattggaaccccaattcccgggtaccggtattatgatcctgcaacatgcagccttcacttcgaaggactcctggaagacctcggttctgctccttnaggttcaatngtactgctgcatgcctgtgctcacaaccctactggagtagatcctaccatcgaacagtgggaacagattaggcagctgatgagatcaaaatcactgcttccgttctttgacagtgcctatcaaggctttgcaagtggaagtcttgacaaagatgctcagtcagtgcgtatgtttgttgctgatggtggtgaacttctcatggctcagagctacgctaagaacatgggattgtatggagagcgtgttggcgctttgagcattgnatgtaaaagtgccgatgtagctgttagggttgaaagtcaactcaaacttgncatcaggcctatgtattcaaacccttctcttcatggngcctctatcgntgctaccat

SEQ ID NO: 5590 - DNA, 386 bp, Zea mays
  Clone ID: LIB143-040-Q1-E1-D11
ttatcatggctcagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgaggcaacaactatttaatgcgctgaaatccagaggaacccctggtgattggagccatatcattaagcaaattgggatgtttactttcactggggcctgaatagcgaaacaaagtcgccccattcatgaggcagga

SEQ ID NO: 5591 - DNA, 405 bp, Zea mays
  unsure (1)...(405): unsure at all n locations
  Clone ID: LIB143-030-Q1-E1-D9
actcccaatagtgagtcgtattacagagctacgctaagaacatgggattgtatggagagcgtgttggcgctttgagcattgtatgtaaaagtgccgatgtagctgttagggttgaaagtcaactcaaacttgtcatcaggcctatgtattcaaaccctcctcttcatggtgcctctatcgttgctaccatactcagggacagcgagatgttcaacgaatggactctggaactgaaggccatggctgataggatcattaacatgangcaacaactatttaatgcgctgaaatccangaggaacccctggtgattggagccatatcattaaagcaaattgggatgtttacnttccctggggncngaaataancgaagcnnggtcggccnnttcangagggnagggag

SEQ ID NO: 5592 - DNA, 396 bp, Zea mays
  Clone ID: LIB3068-035-Q1-K1-A4
cccacgcgtccgcccacgcgtccggcgtgttggcgcttcgagcattgtatgtaaaagtggcgatgtagctgggagggttgaaagtcaactcaaacttgtcatcaggcctatgtattcaaaccctcctatacatggtgcctctatcggtgctaccatactcagggacagccagatgttcaacgaatggactctggaactgaaagccattgctgataagatcattcacatgaggcatcaactatttaatgcccctaaatccaaatgaacccctggagattggagccatatcattgagcacattcggatgtacactgtgactgagctgaataacgaacaagtcgcattcatgaggcaggaatacctcatttacatgacatctgatgatatgaacatcat

SEQ ID NO: 5593 - DNA, 416 bp, Zea mays
  Clone ID: LIB143-017-Q1-E1-C8
agttgctaccatactcagggacagcgagatgttcaacgaatggactctggaactgaaggccatggttgaaaggttaatatacataaggcaacaccaattaatgccccggaatccaaaagaaaccctggtgaatggagccatatcaataagcaaattgggatgtttactttcactgggctgaatagcgaacaagtcgcattcacgaggcacgaataccacatttatatgacatctgatgggaagatcagcatggccggtttgagcatgaggactgtgccccatcttgcacatgccatacacgctgcagttactcaactgaaatgaggatagtatcgcagctttcgtgaataaaacctgaatcatccacaacaatgttctaagtactcatccactggtatttactggttgacctactg

SEQ ID NO: 5594 - DNA, 404 bp, Zea mays
  unsure (1)...(404): unsure at all n locations
  Clone ID: LIB143-030-Q1-E1-D11
ccctatagtgagtcgtattaaagagctacgctaagaacatgggattgtatggagagcgtgttggcgctttgagcattgtangtaanagtgccgatgtagcngtnagggntgaaagtcanctcaancttgtcatcaggcnnatgtattcaaaccctcctcttcatggtgcctctancgttgctaccatnctcagggacagcgagatgttcancgaatggactctggaactgaaggccatggctgataggatcattaacangaggcaacaactatttaatgcgctgaaatccagaggaacccctggtgantggagccatntcngttaagncaaattgggatgtntactttcanngggggcctnaagtaagcgaaacagnntncgncctttcccggngggcggggag

SEQ ID NO: 5595 - DNA, 294 bp, Zea mays
  Clone ID: LIB3061-048-Q1-K1-D7
atacacgctgcagttactcaactgaaatgaggatagtatcgcagctttcgtgaataaaacctgaatcacccacaagaatgttctaagtactcagccagtggtatttactggttgacctactgtagtttgcgtcggaatagatatgtttttttactcttcgtggggcagttttgtactggtggattcataaggactctgattatggtgcgttcggaacttataataataagcacatgaaattttgcttcaaaaaaaaactatatcaccctcaatactacaacaacagtcagccac

SEQ ID NO: 5596 - DNA, 259 bp, Zea mays
  Clone ID: LIB3059-056-Q1-K1-B1
actgaaatgaggatagtatcgcagctttcgtgattaaaacctgaatcacccacagcggtgttctaagtactcagccagtggtatttactggttgacctactgtagtttgcgtcggaatagatttgtttttttactcttcgtggggcagttttgtactggtggattcataaggactctgattatggtgcgttcggaacttataataataagcacatgaaattttgcttcaaaaaaatactaccattcaaacagataaaaa

SEQ ID NO: 5597 - DNA, 233 bp, Zea mays
  Clone ID: 700201453H1
ctaccagattggtatgttcgcatacaccggcctcaagcccgaacagatggaggctcttgccaaggatgactccgtttacgctaccaaggatggtcgtatttccgtcgctggtatcaccaccggaaacgtcaagagacttgccgagtctattttcaaggtcactggttaagggttaaattatacggattagaaggtggctgtactctggtctagaccgcgaaaaagattggatg

SEQ ID NO: 5598 - DNA, 285 bp, Zea mays
  Clone ID: 700243862H1
gccgctcgctctgcgcgtcgctccggacgatctcccacatggcctccgccgccgcccccacctccgcgcccgtcgccaccaccgagaacggcgccgcgaaggcgatagagcagcggcccgtgcaggtcgcagagcggctggaaaagttcaagacaacaattttcactcagatgagcatgcttgccatcaagcatggagcaataaaccttggccagggctttccgaattttgatggcccagactttgtgaaagaggccgcaattcaagctatcaatgctgggaaga

SEQ ID NO: 5599 - DNA, 154 bp, Zea mays
  Clone ID: 701169557H1
ctcagatgagcatgcttgccatcaagcatggagcaataaaccttggccagggctttccgaattttgatggcccagactttgtgaaagaggccgcaattcaagctatcaatgctgggaagaatcagtacgcaagaggatttggtgtgcctgaact

SEQ ID NO: 5600 - DNA, 434 bp, Zea mays
  Clone ID: LIB3059-049-Q1-K1-E5
ggcaaactgacttatatcagcaagacgttcagaagtatggaaacattgagtacatgagatgcggtccagaaaatggattttttcctgatctgtcaactgtccctaggacagatattattttcttttgttcacccaacaatcctactggtgctgctgcatctcgggaccaactaaccaaattagtaaaatttgcaaaggacaacaggtccatcatagtctatgattctgcttatgcaatgtacatatcagatgacagcccaaagtctatctttgaaattcctggagcaaaggaggttgctattgagacagcctcattctcgaaatacgctgggttcacaggtgtccgtctaggttggactgttgtccccaaggagctccttttctcggatggacatccagttgctaaagatttcaatcgcatagtttgcacttgc

SEQ ID NO: 5601 - DNA, 262 bp, Glycine max
  unsure (1)...(262): unsure at all n locations
  Clone ID: 700668054H1
ccaaagaggttgccatcgagacttcatcatttagcaagtatgctgggttcactggagtccgattgggttggactgtggttccaaagcagttgctgttttctgatggatttcctgttgccaaggacttcaaccgtattgtatgcacttgtttcaatggtgcatcaaatatttcccaggcaggtggtctggcttgcctttcaccagacggtcttaaggctatgcgagatgttattggattctacaaaganaataccgacattat

SEQ ID NO: 5602 - DNA, 262 bp, Glycine max
  Clone ID: 700685655H1
ctcgagccgctgtcatacccacttccccttcaagagcacacgcccagatcagcgttaacaacgtcttacaactgcgaaacaaaaccaatctgaaatgtccgaccaacaagagatttacgctgcgttccccaacgtccctcaggctcctcctgattccatcttccaattgaccgctcgttacgtcgccgacaagcatccgaacaagatcaacctgggtgtcggggcatacaggacggacgatgggaaaccttgggtcttgccc

SEQ ID NO: 5603 - DNA, 271 bp, Glycine max
  Clone ID: 700729138H1
gtcgactatagaaggatacagtgggtatggagctgaacaaggtgaaaagccattaagaagggcacttgcttcaacattttacagcgatcttggcatagaagaggatgatatatttgtctcagatggagcaaagtgtgatatatccgtctccagattgtctttgggtcaaatgtaaaaatggctgtgcaatacccttcatatccggcctatgtagactctagtgtaattatgggccagactggcctcttccagaagaatgttgagaagtttg

SEQ ID NO: 5604 - DNA, 256 bp, Glycine max
  Clone ID: 700734818H1
gttttgtgccagagtataaagcaagtagctgcactaaaaagccaactgcagctgatgtcccatgcaatgtatagcagcattccttttcagggtatttcactagttactatgatattaagcgagccagatacagaagcactttggagaaaagagataaaggtcatggctaaacggattcaaactatgcgaactaccttgcggcattgtcttgagaacttgcattcatctttcaattgggagcacataactgatcagg

SEQ ID NO: 5605 - DNA, 286 bp, Glycine max
  Clone ID: 700787411H2
ctgaaatccagaggaacccctggtgattggagccatatcattaagcaaattgggatgtttactttcactgggctgaatagcgaacaagtcgcattcatgaggcaggaataccacatttatatgacatctgatgggaggatcagcatggccggtttgagcatgaggactgtgccccatcttgcagatgccatacacgctgcagttactcaactgaaatgaggatagtatcgcagctttcgtgaataaaacctgaatcacccacaacaatgttctaagtactcagcca

SEQ ID NO: 5606 - DNA, 256 bp, Glycine max
  Clone ID: 700868646H1
tcttccaggtaaaaaatcatttcccattctttgacatggcttatcaaggattttcaagtggggatcttgacaaggatgcaatagcacttcgaattttccttgaagatgggcatttgattggttgtgctcaatcttttgcaaagaacatgggattatcagaacataaagctggttgtcttaggtaagaatagtcctatatcctagtgagtagagattcagaggcagagcatattctatgacacgtataatagaagtt

SEQ ID NO: 5607 - DNA, 232 bp, Glycine max
  Clone ID: 700874369H1
ctttttatgatgttctgttctgcattattttcaggtcacgcaacaaggaatatattccgttcgttgggcttgctgattttaataaattgagtgctaagcttatttttcgggctgacagccctgctattcaagacaacagggttaccactgttcaatgcttgtctggaactggttctttaagagttgggggtgaatttttggctaaacactatcaccaacggactatatactt

SEQ ID NO: 5608 - DNA, 209 bp, Glycine max
  unsure (1)...(209): unsure at all n locations
  Clone ID: 700974412H1
gccgaaaggnttggngcaatcaatgtggtttcatcatcgcccgaatctgcagcaagggtananagtcagttgtaaggattgcccgaccangtactctaatctncagtacacgnggtagatagtngcgtgtgttggaancagtccttatgatgaagngaatgcatgtggtggagntaagnttagcacgtatagtattattcaagacanag

SEQ ID NO: 5609 - DNA, 236 bp, Glycine max
  Clone ID: 701009475H1
ttccagagccccttctaaagaggatttcagatctctgcaagaatgctggctcttggcttgttgttgataatacatacgagtattttatgtatgatggcctgaaacactcttgtgttgagggaaatcatattgttaatgttttctcattctcaaaagcatatggaatgatgggatggcgggttggatatatagcgtacccctctgaagtaaaagacttcgctgaacaacttctcaaa

SEQ ID NO: 5610 - DNA, 247 bp, Glycine max
  Clone ID: 701050301H1
ggaacttttgtgtgctgttctacttctgttacatctcgtgaatcgtttgcaacttcttcaccgttttctgtatgcagatggcttcttcgtttctatccgcagcttcgcacgctgtctcaccctcttgttctctgtccaccacgcacaacgggaagcacatgcttggaggcaacactttgagatttcacaaaggacccaattccttctctagttcaaggtctagaggtcggatctctatggctgttgc

SEQ ID NO: 5611 - DNA, 153 bp, Glycine max
  Clone ID: 701061267H1
ccacagaggacccaattccttctctagttcaaggtctaccggctggatctctatggctgttgcagttaacgtttctcggtttgaaggcatacctctggcgcctcctgatccaattctaggagtttctgaggcatttaaggtggacaatagtga

SEQ ID NO: 5612 - DNA, 271 bp, Glycine max
  Clone ID: 701129551H1
agagcagttgaaaaggattgcccgaccaatgtactctaatccaccggtacacggggctaggatagttgccgatgttgttggaaacccagttctctttaatgaatggaaagcagagatggaaatgatggctggaaggataaagaatgttagacagcagctatatgatagtattacttcgaaagacaaaagtggaaaggattggtcattcgtacttaagcagataggcatgttctcattcactggcttgaacaagaaccagagtgacaacatg

SEQ ID NO: 5613 - DNA, 247 bp, Glycine max
  Clone ID: 700904367H1
aacggagccaaacagagtattgctcaggcagtgcttgcagtttcctcccctggagatgaggttattattccagctccattctgggttagttacccagaaatggcaaggttggctgatgcaacacctgtgattcttccaaccttaatatctgataatttccttttggatcccaaactcctcgaatccaaaattactgaaagatcaagactgcttattctttgttctccatctaacccaacgggatctg

SEQ ID NO: 5614 - DNA, 261 bp, Glycine max
  Clone ID: 700895714H1
cggagcaaacagagtattgctcaggcagtgcttgcagtttcctcccctggagatgaggttattattccagctccattctgggttagttacccagaaatggcaaggttggctgatgcaacacctgtgattcttccaaccttaatatctgataatttccttttggatcccaaactcctcgaatccaaaattactgaaagatcaagactgcttattctttgagctccatctaacccaacgggatctgtctaccccaaagaatta

SEQ ID NO: 5615 - DNA, 273 bp, Glycine max
  Clone ID: 700727795H1
gggattagttatactcctgaccaagttgtggttagtatcggagccaaacagagcattgctcaggcagtgcttgcagtttgctcccccggagatgaggttattattccagctccattctgggttagttacccagaaatggcaaggttggctgatgcgacacctgtgattcttccaaccttaatatctgataatttccttttggatcccaaactccttgaatccaaaattactgaaagatcgagactgctcattctttgttcaccatctaaccca

SEQ ID NO: 5616 - DNA, 273 bp, Glycine max
  unsure (1)...(273): unsure at all n locations
  Clone ID: 700974712H1
cggggctaggatagtngccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacatgacaaacaagtggcacgtatacatgacaaaggatggaaggatttccctggcagg

SEQ ID NO: 5617 - DNA, 258 bp, Glycine max
  Clone ID: 700895483H1
aaagaatgttagacagcagctatatgatagtattacttcaaaagacaaaagtggaaaggattggtcattcatacttaagcagataggcatgttctcattcacgggcttgaacacgaaccagagtgacaacatgacaaacaagtggcacgtatacatgacaaaggatggaaggatttccctggcaggattgtcattggctaaatgtgaataccttgcagatgctattattgactcatatcataatgtcagctgaaactc

SEQ ID NO: 5618 - DNA, 249 bp, Glycine max
  Clone ID: 700846207H1
tgccgatgttgttggaaacccagttctctttaatgaatggaaagcagagatggaaatgatggctggaaggataaagaatgttagacagcagctatatgatagtattacttcaaaagacaaaagtggaaaggattggtcattcatacttaagcagataggcatgttctcattcactggcttgaacaagaaccagagtgacaacacgacaaacaagtggcacgtatacatgacaaaggatggaaggatttc

SEQ ID NO: 5619 - DNA, 268 bp, Glycine max
  Clone ID: 700909477H1
gttcgcactctgtctttcccctgtttccgcgtcactgagtcatcgcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggaaaacctgtggttttggaatg

SEQ ID NO: 5620 - DNA, 268 bp, Glycine max
  Clone ID: 700732673H1
ctctctccctctctgttcgcactctgtctttcccctgtttccgcgtcactgagtcatggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggcaaacct

SEQ ID NO: 5621 - DNA, 241 bp, Glycine max
  Clone ID: 700890192H1
cctctctgttcgcactctgtctttcccctgtttccgcgtcactgagtcattgcgattcgcaactcgctcaccggccaattcctccgccgcagctccgtcgccggagcaaggctcatgtcttcttcgtcctcatggttccggagcatcgagcccgttcccaaggatcctatcctcggagtcactgaagctttcctcgccgatcagagtccaaacaaagtcaacgtcggagtgggtgcgtatc

SEQ ID NO: 5622 - DNA, 170 bp, Glycine max
  Clone ID: 700727008H1
ctctctccctctctgttcgcactctgtctttcccctgtttccgcgtcactgagtcatcgcgattcgcaactcgctcaccggccaattcctccgccgcagctccgtcgccggagcaaggctcatgtcttcttcgtcctcatggttccggagcatcgagcccgctcccaagg

SEQ ID NO: 5623 - DNA, 284 bp, Glycine max
  unsure (1)...(284): unsure at all n locations
  Clone ID: 700567458H1
ggagatgggttcgtccgtgaagctttcaggagggccttggaaactgagatgcccgttatggttcagatgcaggaattgcaacgaggagctaagaatgccttgtctttggcccagggggtggtttactggcagcctcccaagcaagcgttggaaaaagtgaaagaacttgtatctgagcctttaattagtcgttatggtaacgatgaaggtattcctgaactcagagcagcattagtcaaaaagttgcgngatgaaaataatttgcacaaatcttcagtatggtt

SEQ ID NO: 5624 - DNA, 276 bp, Glycine max
  Clone ID: 701045375H1
caacattttactgggtatataagtggagagtgtaactgaaattatgtggaggtgcatcaatggaagaattgccagaagatttttatccacttcttctgccagtgcccgtggttggtgggaccatgtaaggccagcaccgaaggaccccattgttcgtgtgaacgaggcatttctagctgacccttttccccataagatcaatcttggaataggtacttataagggtgatgatggcaaagctttcattcctcaaagcgttcgtgaggcagaaacaaa

SEQ ID NO: 5625 - DNA, 290 bp, Glycine max
  unsure (1)...(290): unsure at all n locations
  Clone ID: 700567374H1
attaagcaacattttactgntgtatataagtggagagtgtaactgaaattatgtggaggtgcatcaatggaagaattgccagaagatttttatccacttcttctgccagtgcccgtggttggtgggaccatgtaaggccagcaccgaaggaccccattgttcgtgtgaacgaggcatttctagctgacccttttccccataagagcaatcttggaataggtacttataagggtgatgatggcaaagctttcattcctcaaagcgttcgtgaggcagaaacaaagattcag

SEQ ID NO: 5626 - DNA, 273 bp, Glycine max
  Clone ID: 701102885H1
caacattttactgggtatataagtggagagtgtaactgaaattatgtggaggtgcatcaatggaagaattgccagaagatttttatccacttcttctgccagtgcccgtggttggtgggaccatgtaaggccagcaccgaaggaccccattgttcgtgtgaacgaggcatttctagctgacccttttccccataagatcaatcttggaataggtacttataagggtgatgatggcaaagctttcattcctcaaagcgttcgtgaggcagaaac

SEQ ID NO: 5627 - DNA, 263 bp, Glycine max
  Clone ID: 701213187H1
aagcaacattttactgggtatataagtggagagtgtaactgaaattatgtggaggtgcatcaatggaagaattgccagaagatttttatccacttcttctgccagtgcccgtggttggtgggaccatgtaaggccagcaccgaaggaccccattgttcgtgtgaacgaggcatttctagctgacccttttccccataagatcaatcttggaataggtacttataagggtgatgatggcaaagctttcattcctcaaagcgttc

SEQ ID NO: 5628 - DNA, 246 bp, Glycine max
  Clone ID: 701055675H1
gaattaagcaacattttactgggtatataagtggagagtgtaactgaaattatgtggaggtgcatcaatggaagaattgccagaagatttttatccacttcttctgccagtgcccgtggttggtgggaccatgtaaggccagcaccgaaggaccccattgttcgtgtgaacgaggcatttctagctgacccttttccccataagatcaatcttggaataggtacttataagggtgatgatggcaaa

SEQ ID NO: 5629 - DNA, 261 bp, Glycine max
  unsure (1)...(261): unsure at all n locations
  Clone ID: 701052631H1
taacattttactgggtatataagtggagagtgtaactgaaattatgtggatgtgcatcaatggaagaattgccagaagatttttatccacttcttctgccagtgcccgtggttggtgggaccatgtaaggccagcaccgaaggaccccattgttcgtgtgaacgaggcatttctagctgacccttttccccataagatcaatcttggnaaaggtacttataagggtgatgatggcaaagctttcattcctcaaagcgttcg

SEQ ID NO: 5630 - DNA, 236 bp, Glycine max
  Clone ID: 701213639H1
aagcaacattttactgggtatataagtggagagtgtaaccgaaattatgtggaggtgcatcaatggaagaattgccagaagatttttatccacttcttctgccagtgcccgtggttggtgggaccatgtaaggccagcaccgaaggaccccattgttcgtgtgaacgaggcatttctagctgacccttttccccataagatcaatcttggaataggtacttataagggtgatgatg

SEQ ID NO: 5631 - DNA, 380 bp, Glycine max
  Clone ID: 700651242H1
ctggttctttaagagttgggggtgaatttttggctaaacactatcaccaacggactatatacttgccaacaccaacttggggcaatcacccgaagttttcaacttagcaggcttgtctgtcaaaacataccgctactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttacctttctttgacagtgcttatcagggttttgctagtggaagtctagatgcagatgcccaacctgttcgtt

SEQ ID NO: 5632 - DNA, 329 bp, Glycine max
  unsure (1)...(329): unsure at all n locations
  Clone ID: 700661083H1
gcggactatatacttgccaacaccaacttggggcaatcacccgaagttttcaacttagcaggcttgtctgtcaaaacataccgtactatgctccagcaacacgaggacttgactttcaaggacttctggaagaccttggttctgctccatctggatctattgttttgctacatgcatgcgcacataaccccactggtgtggatccaacccttgagcaatgggagcagattaggcagctaataagatcaaaagctttgttactttctttgacagtgcttatcagggtttgctatggnatctagattgcagatgccaactgtcgttgttgt

SEQ ID NO: 5633 - DNA, 261 bp, Glycine max
  unsure (1)...(261): unsure at all n locations
  Clone ID: 700668434H1
attgttttgctacatgcatgcgcacataacnacactggtgtggatccaacccttgagcaatgggagcagattaggcagctaataagatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagc

SEQ ID NO: 5634 - DNA, 264 bp, Glycine max
  Clone ID: 700677640H1
ttcaatgcttgtctggaactggttctttaagagttgggggtgaatttttggctaaacactatcaccaacggactatatacttgccaacaccaacttggggcaatcacccgaaggttttcaacttagcaggcttgtctgtcaaaacataccgctactatgctccagcaacacgaggacttgactttcaaggacttctggaagaccttggttctgctccatctggatctattgttttgctacatgcatgcgcacataaccccactg

SEQ ID NO: 5635 - DNA, 264 bp, Glycine max
  unsure (1)...(264): unsure at all n locations
  Clone ID: 700655909H1
gggaagaccttggttctgctccatctggatctattgttttgctacatgcatgcgcacataaccccactggtgtggatccaacccttgagcaatgggagcagattaggcagctaatancgatcaaaagctttgttacctttctttgacagtgcttatcagggttttgctagtggaagtctagatgcagatgcccaacctgttcgtttgtttgttgctgatggaggcgaattgctggtagcacaaagctatgcaaagaatctgggt

SEQ ID NO: 5636 - DNA, 287 bp, Glycine max
  unsure (1)...(287): unsure at all n locations
  Clone ID: 700660728H1
gcggactatatacttgccaacaccaacttggggcaatcacccgangttttcaacttagcaggcttgtctgtacaaaacataccgctactatgctccagcaacacgaggacttgactttcaaggacttctggaagaccttggttctgctccatctggatctatgttttgctacatgcatgcgcacataaccccactggtgtggatccaacccttgagcaatgggagcagattangcagctaataagatcaaaagctttgttactttctttgacagngcttatcagggt

SEQ ID NO: 5637 - DNA, 117 bp, Glycine max
  Clone ID: 700807523H1
caggtattgctacatgcatgcgcacataaccccactggtgtggatccaacccttgagcaatgggagcagattaggctgctaatatgatcaaaagctttgttatcttactacgacagt

SEQ ID NO: 5638 - DNA, 273 bp, Glycine max
  Clone ID: 700660070H1
aacaatcctactggtgctgcggcaacaagggaacaactgacccaactcgttcagtttgctaaggacaatggttctatagtaatccatgattcagcttatgcaatgtatatttctggtgacaaccctcgctctatttttgaaatcctggagccaaagaggttgccatcgagacttcatcatttagcaagtatgctgggttcactggagtccgattgggttggactgtggttccaaagcagttgctgttttctgatggatttcctgttgccaagg

SEQ ID NO: 5639 - DNA, 237 bp, Glycine max
  Clone ID: 700746670H1
aacaatcctactggtgctgcggcaacaagggaacaactgaccccactcgttcagtttgctacggacactggttctatagtaatccatgattcagcttatgcaatgtatatttctggtgacaaccctcgctctatttttgaaattcctggagccacagaggttgccatcgagacttcatcatttagcaagtatgctgggttcactggagtccgattgggttggactgtggttccaaag

SEQ ID NO: 5640 - DNA, 276 bp, Glycine max
  Clone ID: 700749933H1
ggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatccatcatcagtatgcgccaagaacttttcgatgctttatgttccagaggcacacctggcgattggagtcacattatcaaac

SEQ ID NO: 5641 - DNA, 271 bp, Glycine max
  Clone ID: 700793749H1
gcttatcagggttttgctagtggaagtctagatgcagatgcccaacctgttcgtttgtttgttgctgatggaggcgaattgctggtagcacaaagctatgcaaagaatctgggtctttatggggaacgtgttggcgccttaagcattgtctgcaagtcagctgatgttgcaagcagggttgagagccagctgaagctagtgattaggcccatgtactcaagtcctcccattcatggtgcatccattgtggctgccattctcaaggaccgga

SEQ ID NO: 5642 - DNA, 283 bp, Glycine max
  Clone ID: 701127031H1
tgcttatcagggttttgctagcggaagtctagatgcagatgcccagcctgttcgtttgtttgttgctgatgggggtgaattgctggtggcacaaagctatgcaaagaatctgggtctttatggggaacgtgttggcgccttaagcattgtctgaagtcagctgatgttgcaagcagggtcgagagccagctgaaactagtgattaggcccatgtactcaagtcctcctattcatggtgcatccattgtggctgccattctcaaggaccgggatttgttcaatg

SEQ ID NO: 5643 - DNA, 227 bp, Glycine max
  unsure (1)...(227): unsure at all n locations
  Clone ID: 700997259H1
aaagaatctgggtctttatggggaacgngttggcgccttaagccttgtctgnccgtcagctgatgttgcaagcagggttgagagccagctgaagctagtgattaggcccatgtactcaagtcctcccattcatggtgcatccattgtggctgccattctcaaggaccggaatttgttcaatgactggactattgagttgaaggcaatggctgatcgcatcatcagtt

SEQ ID NO: 5644 - DNA, 259 bp, Glycine max
  unsure (1)...(259): unsure at all n locations
  Clone ID: 700670783H1
aagctttgntacctttctttgacagtgcnnatcagggntntgctagnggaagtctagattgcngatggcccaacctgttcgtttgtntgttgntgatgnaggcgaattgctggtagcacaaagctatgcnaagaatctgggtcttnatggggaacgtgttggcgccttaagcanngtctgcaagtcanctgatgttgcaagcagggttgagagccagctgaagctagtgataggcccatgtactcaagtcctcccattt

SEQ ID NO: 5645 - DNA, 280 bp, Glycine max
  Clone ID: 700678487H1
aacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaaaacatgttgacaacagttttcaacatgctccctagtccctataggagaacttccattatttttgtttaataattgtcaacatcaacaatgaaaccttttatttg

SEQ ID NO: 5646 - DNA, 250 bp, Glycine max
  Clone ID: 701049020H1
acattatcaaacagattggaatgtttactttcactggattgaatgcggaacaagtttccttcatgactaaagagttccatatatacatgacatctgatgggaggattagcatggctggtctgagttccaaaactgtcccacttctggcggatgcgatacatgcagctgtaacccgagttgtctaaaacatgttgacaacagttttcaacatgctccctagtccctataggagaacttccattatttttgt

SEQ ID NO: 5647 - DNA, 285 bp, Glycine max
  Clone ID: 701151325H1
tacggctgcgaggacgacagaaggggataatacatacgagtattttatgtatgatggcctgaaacactcttgtgttgagggaaatcatattgttaatgtttcctcattctcaaaagcatttggatagatgggatggcgggttggatatatagcatatccctctgaagtaaaagactttgctgaacatcttctcaaagttcaagacaacattcccatctgtgcttcaatattatcacagtatcttgccctgtattcattggaagtggggcctcaatgggttgtaga

SEQ ID NO: 5648 - DNA, 249 bp, Glycine max
  Clone ID: 700964436H1
gggaaatcatattgttaatgttttctcattctcaaaagcatttggaatgatgggatggcgggttggatatatagcatatccctctgaagtaaaagactttgctgaacaacttctcaaagttcaagacaacattcccatctgtgcttcaatattatcacagtatcttgccctgtattcattggaagtggggcctcaatgggttgtagatcaggtaaaaactcttgaaaagaacagagaaattgttttaga

SEQ ID NO: 5649 - DNA, 264 bp, Glycine max
  Clone ID: 701106241H1
gttgcgtgatgaaaataatttgcacaaatcttcagtaatggttacatcaggtgccaatcaggcatttgtgaatctagttcttactctctgtgatccgggtgattctgtggttatgtttgctccttactacttcaatgcgtacatgtccttccagatgactggcattaccaatattctagttggtcctggtagctcagacacactccatcctgatgcagggggttcacatattggttaaatgttggatggattgggtctgtatac

SEQ ID NO: 5650 - DNA, 296 bp, Glycine max
  Clone ID: 701149504H1
cctggatttacaacagtaacaagctttggagccggtttattttctgataatattctttccaaccaatctgcatcaggatggagtgtgtctgagctaccaggaccaactagaatattggtaatgccagtcatctggaaggacatgtacgcattgaagtagtaaggagcaaacataaccacagaatcacccggatcacagagagtaagaactagattcacaaatgcctgattggcacctgatgtaaccattactgaagatttgtgcaaattattttcatcacgcaactttttgactaa

SEQ ID NO: 5651 - DNA, 284 bp, Glycine max
  Clone ID: 700605347H2
gtggaagccttgatgaagatgcagcttctgtgagactgtttgtggcacgtgggcatcgaggttcttgtagctcaatcttacagtaaaaatctcggtctctatgctgaaaggattggagcaatcaatgtgatttcatcgtcaccagaatctgcagcaagggtaaagagccaactgaaaaggattgcccgaccaatgtactctaatccaccggtacacggggctaggatagttgccgatgttgttggaaacccagttctctttaatgaatggaaagcagagatgga

SEQ ID NO: 5652 - DNA, 253 bp, Glycine max
  Clone ID: 701053078H1
gaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctgaaaggattggagcaatcaatgtgatttcatcgtcaccagaatctgcagcaagggtaaagagccaactgaaaaggattgcccgaccaatgaactctaatc

SEQ ID NO: 5653 - DNA, 262 bp, Glycine max
  unsure (1)...(262): unsure at all n locations
  Clone ID: 700971234H1
gcttcttcgtttctatccgcagcttcgcacgctgtctcaccctcttgttctctgtccaccacgcacaaggganagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtca

SEQ ID NO: 5654 - DNA, 277 bp, Glycine max
  Clone ID: 701205146H1
ctacaacacacttttgtaagtgattcgttcgcagaaacatggcatcttcgttgctatccgcagcttcgcacgctgtctcaccctcttgttctctgtccaccacgcacaagggatagcccatccttggaggcaacactttgagatttcacaaaggacccaattccttctctagttcaaggtctataggtcggatctctatggctgttgcagttaatgtatctcggtttgaaggcatacctatggctcctcctgatccaattctcggattttccgaggt

SEQ ID NO: 5655 - DNA, 266 bp, Glycine max
  Clone ID: 701137753H1
cgcacttcgcacgctgtctcaccctcttgctctctgtccaccacgcacaagggacatccattcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggca

SEQ ID NO: 5656 - DNA, 257 bp, Glycine max
  Clone ID: 700741154H1
gtttccttcatcttcttcttcttcttctatctctctacaacacacttttttaagtgattcgttcgcagaaacatggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcg

SEQ ID NO: 5657 - DNA, 271 bp, Glycine max
  Clone ID: 700954813H1
gagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttatgttgttaagaaggtctttgttccgtattttatgtgtcttctgtgatttg

SEQ ID NO: 5658 - DNA, 244 bp, Glycine max
  unsure (1)...(244): unsure at all n locations
  Clone ID: 701000832H1
ctacaacacacttttttaagtgattcgttcgcagaaacatggcttcttcgnttctatccgcagcttcgcacgctgtctcanctcttgttctctgtccancacgcacaagggagagcccatgcttggaggcaacactttgagatttcacaaaggacccaattcctctctagttcaaggtctagaggtcggatctctatggctgttgcagttaatgtatctcggtttgaaggcatacctatggcnc

SEQ ID NO: 5659 - DNA, 272 bp, Glycine max
  Clone ID: 701039262H1
cactgtttccttcatcttcttcttcttcttctatctctctacaacacacttttttaagtgattcgttcgcagaaacatggcttcttcgtttctatccgcagcttcgcacgctgtctcaccctcttgttctctgtccaccacgacaagggaaagcccatgcttggaggcaacactttgagatttcacaaaggacccaattccttctctagttcaaggtctagaggtcggatctctatggctgttgcagttaatgtatctcggtttgaaggcat

SEQ ID NO: 5660 - DNA, 288 bp, Glycine max
  unsure (1)...(288): unsure at all n locations
  Clone ID: 701108365H1
tgccgaattccgctcgagctcgagccggtttccntcatcttcttcttcttcttctatctctctacaacacacttttttaacacattcgttcgcagaaacatggcttcttcgtttctatccgcagcttcgcacgctgtctcaccctcttgttctctgtccaccacgcacaagggacagcccatgcttggaggcaacactttgagatttcacaaaggacccaattccttctctagttcaaggtctagaggtcggatctctatggctgttgcagttaatgtatctcggttt

SEQ ID NO: 5661 - DNA, 254 bp, Glycine max
  Clone ID: 700953963H1
attttctattgcagatggcttcgtcggttctctccgcagcttcgcactctgtctcaccctcatgttctctgtccaccacgcacaagggaaagcccatgattagagacaacactttgggattccacagaggacccaattccttctctagttcaaggtctagaggtcggatctctatggctgttgcagttaacgtttctcggtttgaaggcatacctatggcgcctcctgatccaattctaggagtttctgaggca

SEQ ID NO: 5662 - DNA, 272 bp, Glycine max
  unsure (1)...(272): unsure at all n locations
  Clone ID: 700971364H1
tgttctgttctgtnctgnnacatctcgtnaatcgnttanaanttcttaaccgtnttctgttgcagctgggcttctncgtttatntaccgcagcttngcacgctgtntcacnctcttgttctctgtnnaccangcacaagggaaagcacatgcttggaggcaacactttgagatttcacaaaggncccaattccttctctagttcaaggtctagaggtcggatctctatggctgttgcagttaatgtatctcggtttgaaggcatacctatng

SEQ ID NO: 5663 - DNA, 275 bp, Glycine max
  Clone ID: 701002832H1
cctcgagccgattcggctcgaggttacatctcgtgaattgttacaatctgttaaccattttccattgcagatggcttcgtcacttctctccgcagcttcgcactctgtctcaccctcatgttctctgtccaccacgcacagggaaagcccatgattagagacaacactttgggtttccacagaggacccaattccttctctagttcaaggtctagaggtcggatctctatggctgttgcagttaacgtttctcggtttgaaggcatacctatggc

SEQ ID NO: 5664 - DNA, 277 bp, Glycine max
  unsure (1)...(277): unsure at all n locations
  Clone ID: 700650013H1
agaaacatggcttcgtcggttctctccgcagcttcgcacncctgtctcaccctcatgttcnctgtncaccacgcacaagggnaagcccatgantagagacaanactttgggattccacagaggacccaattccttctcnagttcaaggtntagaggtcggntctctatggctgttgcagttaacgnttctcgggttngaggcatacctatgggcgcctcctgatccaaattcttagggagtttctgaggnatntaaggtggaccaatagtggtgtnc

SEQ ID NO: 5665 - DNA, 254 bp, Glycine max
  Clone ID: 701139166H1
agattaatcaatcatagatagatccattattcatagttaaacataataactgttgtgttacatctcgtgaattgttacaactgcttaaccattttctattgcagatggcttcgtcggttctctccgcagcttcgcactctgtctcaccctcatgttctctgtccaccacgcacaagggaaagcccatgattagagacaacactttgggattccacagaggacccaatttcttctctagttcaaggtctagaggt

SEQ ID NO: 5666 - DNA, 267 bp, Glycine max
  Clone ID: 701055975H1
atcgtattctctacgctattcctattaaatgaatcatagtcatagatagatccattattcatagtttaaattaggaaccttttgtgttctgttctgttctgttacatctcgtgaatcgtttacaacttcttaaccgttttctgttgcagatggcttcttcgtttctatccgcagcttcgcacgctgtctcaccctcttgttctctgtccaccacgcacaagggaaagcccatgcttggaggcaacactttgagatttcacaaaggac

SEQ ID NO: 5667 - DNA, 259 bp, Glycine max
  Clone ID: 701131513H1
cgctattcctattaaatgaatcatagtcatagatagatccattattcatagtttaaattaggaaccttttgtgctctgttctgttctgttacatctcgtgaatcgtttacaacttcttaaccgttttctgttgcagatggcttcttcgtttctatccgcagcttcgcacgctgtctcaccctcttgttctctgtccaccacgcacaagggaaagcccatgcttggaggcaacactttgagatttcacaaaggacccaat

SEQ ID NO: 5668 - DNA, 259 bp, Glycine max
  Clone ID: 701065138H1
tacgctattccgattaatcaatcatagatagatccattattcatagttaaacataataactgttgtgttacatctcgtgaattgttacaactgcttaaccattttctattgcagatggcttcgtcggttctctccgcagcttcgcactctgtctcaccctcatgttctctgtccaccacgcacaagggacagcccatgattagagacaacactttggattccacagaggacccaattcaatctctagttcaaggtctag

SEQ ID NO: 5669 - DNA, 270 bp, Glycine max
  Clone ID: 701010254H2
ttcgtattctctacgctattccgattaatcaatcatagatagatccattattcatagttaaacataataactgttgtgttacatctcgtgaattgttacaactgcttaaccattttctattgcagatggcttcgtcggttctctccgcagcttcgcactctgtctcaccctcatgttctctgtcaaccacgcacaagggagagcccatgattagagacaacactttgggattccacagaggacacaattccttctctagttcaaggtcta

SEQ ID NO: 5670 - DNA, 266 bp, Glycine max
  Clone ID: 700666429H1
gcatacctatggcgcctcctgatccaattctaggagtttctgaggcatttaaggtggacaatagtgatgtcaagctcaatcttggagttggggcatacagaacagaagaactacagccatatgtgcttaatgttgttaagaaggcagagaatcttatgctggagagaggggataacaaagagtatctcccaattgagggttcggctgcatttaataaggcaactgcagagttgttacttggagcagacaacccagcaatcaaacag

SEQ ID NO: 5671 - DNA, 169 bp, Glycine max
  unsure (1)...(169): unsure at all n locations
  Clone ID: 701001911H1
cttgggagttggggcatacagaacagaagaactacagccatatgtncttaatgttgttaagaaggcagagaatcttatgctggagagaggggataacaaagagtatctcccaattgagggtttggcagcatttaataaggcaactgcagagttgttactcggagcagac

SEQ ID NO: 5672 - DNA, 272 bp, Glycine max
  Clone ID: 701127651H1
ctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttg

SEQ ID NO: 5673 - DNA, 270 bp, Glycine max
  Clone ID: 700668614H1
cttccgcaaatggcttctcacgacagcatctccgcttctccaaactccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgtt

SEQ ID NO: 5674 - DNA, 281 bp, Glycine max
  Clone ID: 701054030H1
tgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgcggattta

SEQ ID NO: 5675 - DNA, 257 bp, Glycine max
  Clone ID: 700890128H1
cgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagc

SEQ ID NO: 5676 - DNA, 282 bp, Glycine max
  Clone ID: 701056607H1
caacactctctccagacacttccttcatcaaatggcttctcacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaactcataaatgacgtgtcacgcaacaaggaatatattccgattgt

SEQ ID NO: 5677 - DNA, 250 bp, Glycine max
  Clone ID: 700973306H1
cttccgcaaatggcttctcacgacagcatctccgcttctccaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaaca

SEQ ID NO: 5678 - DNA, 273 bp, Glycine max
  Clone ID: 700845404H1
ctcgctagacacttccttccgcaaatggcttctcacgacagcatctccgcttctccaacctccgcttcttattccttcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatat

SEQ ID NO: 5679 - DNA, 262 bp, Glycine max
  unsure (1)...(262): unsure at all n locations
  Clone ID: 700650253H1
ctgtgatcgcagactcaacactctcgctagacanttccttccgcaaatggcttctcacgacagcatctccgcttctccaacctccgcttctgattccgtcttcaatcacctcgttcgtnctcccgaagatcctatcctcggggtaactntngcttataacaaagatccaagtccagttaagctcaacttgggagttggtgcttaccgaactgaggaaggaaaacctcttgttttgaatgtagtgaggcgagtgaacagcaat

SEQ ID NO: 5680 - DNA, 239 bp, Glycine max
  unsure (1)...(239): unsure at all n locations
  Clone ID: 700672829H1
agttaagctcaacttgggagttggtgcttaccgaactgaggaaggaaaacctcttgttttgaatgtagtgangcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactg

SEQ ID NO: 5681 - DNA, 253 bp, Glycine max
  Clone ID: 700664509H1
atggcttctcacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaactcataaatgacgtgtcacgcaacaaggaatatattccgattgttg

SEQ ID NO: 5682 - DNA, 252 bp, Glycine max
  Clone ID: 701056892H1
tctaattcgtggagggaatacttttccattacgcacgcactttaattacagacgagaaaattataattaatagtaatacagacagcagcatgcgcccaccggttattctcaaaactaccacctctcttttggattcttcttcttcttcaccaccctgtgatcgcagactcaacactctcgctagacacttccttccgcaaatggcttctcacgacagcatctccgcttctccaacctccgcttctgattccg

SEQ ID NO: 5683 - DNA, 249 bp, Glycine max
  Clone ID: 700605686H2
caaatggcttctcacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaactcataaatgacgtgtcacgcaacaaggaatatattccg

SEQ ID NO: 5684 - DNA, 250 bp, Glycine max
  Clone ID: 700894006H1
atggcttctcacgacggcatctccgctgcttcttcagattccgtcttcaatcacctcgttcgtgctcccgaagatcctatcctcggggtaactgttgcttataacacagatccaagtccagttaagctcaacttgggagttggtgcttaccgaactgaggaaggaaaacctcttgttttgaatgtagtgaggcgagttgagcagcaactcataaatgacgtgtcacgcaacaaggaatatattccgattg

SEQ ID NO: 5685 - DNA, 261 bp, Glycine max
  Clone ID: 700955412H1
gttcatcgcagactcaacactctctccagacacttccttcatcaaatggcttctcacgacggcatctccgctgcttcttcagattccgtcttcaatcacctcgttcgtgctcccgaagatcctatcctcggggtactgttgcttataacaaagatccaagtccagttaagctcaacttgggagttggtgcttaccgaactgaggaaggaaaacctcttgttttgaatgtagtgaggcgagttgagcagcaactcataaatg

SEQ ID NO: 5686 - DNA, 248 bp, Glycine max
  unsure (1)...(248): unsure at all n locations
  Clone ID: 700560909H1
accaccctgtgatngcagactcaacactctcgctagacacttccttccgcaaatngcttctcangacagcatctccgcttctncaacctccgcntctgattccgtcttcaatcacctcgtnngnnctcncnaanatcctatnctcggggtaactnnagcttataacaaagatccaagtncagttaagctcaacttgggagttggtgcttaccgaactgaggaaggaaaacctcttgttttgaatgtag

SEQ ID NO: 5687 - DNA, 235 bp, Glycine max
  Clone ID: 700895972H1
gctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggt

SEQ ID NO: 5688 - DNA, 260 bp, Glycine max
  unsure (1)...(260): unsure at all n locations
  Clone ID: 700663309H1
gttcatcgcagactcaacactctctccagacacttccttcatcaaatggcttctncacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaactcataa

SEQ ID NO: 5689 - DNA, 248 bp, Glycine max
  Clone ID: 700787774H2
cagacacttccttcatcaaatggcttctcacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaactcataaatgacgtgtcacgca

SEQ ID NO: 5690 - DNA, 266 bp, Glycine max
  Clone ID: 701069589H1
ctttggattcttattgttcatcgcagactcaacactctctccagacacttccttcatcaaatggcttctcacgacggcatctccgctgcttcttcagattccgtcttcaatcacctcgttcgtgctcccgaagatcctatcctcggggtaactgttgcttataacaaagatccaagtcctgttaagctcaacttgggagttggtgcttaccgaactgaggaaggaaaacctcttgttttgaatgtagtgaggcgagttgagcagca

SEQ ID NO: 5691 - DNA, 254 bp, Glycine max
  Clone ID: 700663096H1
gttcatcgcagactcaacactctctccagacacttccttcatcaaatggcttctcacgacggcatctccgctgcttcttcagattccgtcttcaatcacctcgttcgtgctcccgaagatcctatcctcggggtaactgttgcttataacaaagatccaagtccagttaagctcaactgggagttggtgcttaccgaactgaggaaggaaaacctcttgttttgaatgtagtgaagcgagttgagcagcaactc

SEQ ID NO: 5692 - DNA, 230 bp, Glycine max
  Clone ID: 700836390H1
cacttccttccgcaaatggcttctcacgacagcatctccgcttctccaacctccgcttctgattccgtcttcaatcacctcgttagttctcccgaagatcctatcctcggggtaactgtcgcttataacaaagatccaagtccagttaagctcaacttgggagttggtgcttaccgaactgaggtaggaaaacctcttgttttgaatgtagtgaggcgagttgaacagca

SEQ ID NO: 5693 - DNA, 249 bp, Glycine max
  Clone ID: 700967858H1
ttaaaaatgaaataagaaaaactcaactttgtaattcgtggagggaatacttttccattacgcacgcactttaattacagacgagaaaattataattaatagtaatacagacagcagcatgcgcccaccggttattctcaaaactaccacctctcttttggattcttcttcttcttcaccaccctgtgatcgcagactcaacactctcgctagacacttccttccgcaaatggcttctcacgacagcat

SEQ ID NO: 5694 - DNA, 266 bp, Glycine max
  Clone ID: 701101575H1
cctcgagccgcttccgcaaatcgcttctcacgacagcatctccgcttctccaacctccgcttcaccttccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacaaggatt

SEQ ID NO: 5695 - DNA, 269 bp, Glycine max
  Clone ID: 700750565H1
ctcttattgttcatcgcagactcaacactctctccagacacttccttcatcaaatggcttctcacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaactcataaat

SEQ ID NO: 5696 - DNA, 251 bp, Glycine max
  Clone ID: 701064276H1
atcgcagactcaacactctctccagacacttccttcattacaatggcttctcacgacggcatctccgctgcttcttcagattccgttttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaact

SEQ ID NO: 5697 - DNA, 264 bp, Glycine max
  unsure (1)...(264): unsure at all n locations
  Clone ID: 700995223H1
ccttcatcaaatggcttctcacgacggcatctccgctgcttcttcagattccgtcttcaatccacctcgttcgtgctcccgaagatcctatcctcggggtaactgttgcttataacaaagatccaagtccagttaanctcaacttggganttggtgttaccgaactgaggaagggaaaacctcttgttttgaatgtagtgaggcgagttgagcagcaactcataaatgangtgtcncgcaacaagnatttnccncgtggggggg

SEQ ID NO: 5698 - DNA, 260 bp, Glycine max
  Clone ID: 700756072H1
tccatgcgcccaccggttattctcaaaactaccacctctcttttggattcttcttcttcttcaccaccctgtgatcgcagactcaacactctcgctagacacttccttccgcaaatcgcttctcacgacagcatctccgcttctccaacctccgcttctgattccgtcttcaatcacctcgttcgtcctcccgaagatcctatcctcggggtaactatcgcttataacaaagatccaagtccagttaagctcaacttggg

SEQ ID NO: 5699 - DNA, 251 bp, Glycine max
  Clone ID: 701147945H1
tacggctgcgagaaggacagaagggtacggctgcgagaagacgacagaagggggcagactcaacactctctccagacacttccttcatcaaatggcttctcacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgagg

SEQ ID NO: 5700 - DNA, 185 bp, Glycine max
  Clone ID: 700888603H1
ctcggggtaactgtcgcttataacaaagatccaagtccagttaagctcaactcgggagttggtgcttaccgaactgaggacagaaaacctcttgttttgaatgtagtacgcgagttgaacagcaactcataaatgacgtgtcacgcaacaaggaatatattccgatcgttgggcttgctgatttt

SEQ ID NO: 5701 - DNA, 276 bp, Glycine max
  Clone ID: 700562918H1
gatagcccgaattgttgcaaagcaccccaggcttctggttctctctgatgaaatttacgaacacataatttatgcaccagcaactcacacgagctttgcatctttaccaggaatgtgggacagaactcttactgtgaatggattttctaaggcctttgcaatgactggttggcggcttggatatattgctggtccaaaacattttgttgcagcatgtggaaagatccaaagtcagtttacttcaggggccagtagtatagctcagaaagctgcagt

SEQ ID NO: 5702 - DNA, 264 bp, Glycine max
  unsure (1)...(264): unsure at all n locations
  Clone ID: 700654444H1
gcaaagcaccccaggntcntggttntctccgatgaaatttatgaacacataatttatgcaccagcaactgcacacaagttttgcatctttaccaggantgtgggacagaactcttactgtgaatggattttccaaggcctttgcaatgantggttggcggcttggatatattgctggtccaaaacactttgttgcagcatgtggaaagatccaaagtcagttcacttcaggggccagtagtatagctcagaaagctgcagttgc

SEQ ID NO: 5703 - DNA, 284 bp, Glycine max
  Clone ID: 701037102H1
ggattttctaaggcctttgcaatgactggttggcggcttggatatattgctggtccaaaacattttgttgcagcatgtggaaagatccaaagtcagtttacttcaggggccagtagtatagctcagaaagctgcagttgctgcattaggactaggccatgctggtggggaggcagtttctaccatggtgaaagcatttagggagcgaagggatttcttagtacaaagttttagagaaatagatggcatcaagatatctgaaccccagggagcattttatctatt

SEQ ID NO: 5704 - DNA, 305 bp, Glycine max
  Clone ID: LIB3055-010-Q1-N1-G4
cgatgctaactcttcaagcttcgtctcgtaaagaaaatgcgaaggctcaatagagagaactcaattgaatcatcaaatgaggacagtgatttcgcgcttgatccattccacgccttacattttcaggctcaatgccacggcagcatccatcacccatacttatatgtgacccttttctatcttactaaatacccaattccttctctaattcacagtctacaggtctgatctctatggctgttgcaattaatgtatctcggtttgaaagcatacctattgctcctcctgatccaatttttagagtt

SEQ ID NO: 5705 - DNA, 247 bp, Glycine max
  Clone ID: LIB3040-027-Q1-E1-F2
cccacgcgtccgtacggctgcaagaagacgacagaaggggagtaatacagacagcaacatgcgcccagcggttattctcaaaactaccatctctcttttggaggcgtcgtcgtcctcaacaccctgtgatggcagactcaacactctcgctagacacgtccttccacaaatggcttctcatgacatgatctgagaatcttcaacctacgcatctgaatccgtcatcaatcatctcgttcgtactccc

SEQ ID NO: 5706 - DNA, 385 bp, Glycine max
  unsure (1)...(385): unsure at all n locations
  Clone ID: LIB3051-109-Q1-K1-F6
attaatagtaatacaaacagcagcatgcgcccacccgttattctcaaaactaccaccgtgtttgtggaatctttcttctcgtcaccaccctgtgatcgcagactcaacactctcgctagacacttcctttcgcaaatggcttctcacgacagcatctccgcttctacaacctccgcttctgattccgtcttcaatcacctcgttcgtgctcccgaagatcctatcctcggggtaactgtcgcttataacaaagatccaagtccagttaagctcaacttgggagttggtgcttaccgaactgaggaaggaaaacctcttgtttttgatgtagtgaggcgagttgaacagncactcataaatgacgtgtcacgcaacaaggaatata

SEQ ID NO: 5707 - DNA, 455 bp, Glycine max
  unsure (1)...(455): unsure at all n locations
  Clone ID: LIB3051-106-Q1-K1-G8
ctctccctctctgttcgcactctgtctttcccctgtttccgcgtcactgagtcatggcgattcgcaactcgctcaccggccaattcctccgccgcagctccgtcgccggagcaaggctcatgtcttcttcgtcctcatggttccggagcatcgagcccgctcccaaggatcctatcctcggagtcactgaagctttcctcgccgatcagagtccaaacaaagtcaacgtcggagtgggtgcgtatcgcgatgaccacggaaaacctgtggttttggaatgtgttagagaagcagagaggagggttgccggaagtcaattcatggagtatcttcccatgggtggaagcataaaaatgatagaagaatcgctgaagctggcatttggagacaactctgagttcatcaaggataaaagaatagctgcagtgcatgctntatctgngactggtgcatgt

SEQ ID NO: 5708 - DNA, 360 bp, Glycine max
  Clone ID: LIB3051-063-Q1-K1-D12
gcgagcggccgcccttttttttttttttttttttttttttttttttttttggggaaacggaataaaaatgttataatgctaaatctctggatggagcccggtaggcagaaaagtttcctttaaaaatctcacatcaaataaaaggtttcattgttgatgttgacaattattaaacaaaaataatggaagttctcctatagggactagggagcatgttgaaaactgttgtcaacatgttttagacaactcgggttacagctgcatgtatcgcattcgccagaagtgggacagttttggaactcagaccagccatgctaatcctcccatcaaatgtcatgtatatatggaactctttaatca

SEQ ID NO: 5709 - DNA, 398 bp, Glycine max
  Clone ID: LIB3065-006-Q1-N1-B10
atcgcagccctgatagccgtcagcacaggtctatggtatacacatgaaattcacgccttcctccaaattcttaggcttttcaaatcacttccactcccttctcgcaccctctttctctccgaccccaaagttctcatcttccttttccgccaccatgtccactctttccactcagaacgacaccgtcacccacaaaacgcagcaacctttgcagattgcaaagcgcttagagaaatttcagacaacaatcttcactcaaatgagcttgcttgccatcaaacatggggccataaaccttggtcaaggctttcccaactttgatggtccagaatttgtaaaggaagcagcgattcaggcaatcagggatgggaaaaatcagtatgccccgggttatggag

SEQ ID NO: 5710 - DNA, 366 bp, Glycine max
  Clone ID: LIB3056-012-Q1-N1-C3
ctgcattgcatgtatctgcatcgagaatgatgttctggttgtcactgatcaagtctatgacaagtgggcttttgatatggagcacatatcgatggcttatttgcctgtaatgttcgaaaggacagtgacattgaactccttggggaagacattctccttaacacgatggaagattggttgggccatagcacccgcacacttatcatggggagtgctacaggcacacgctttgctgactttcgcaactgcccattcttttcagagtgctgctgcagcatctatgagagcaccagactcttactatgtagagctgaagagggattatatggcatatagagctattttgattgaaggattgaaggctgt

SEQ ID NO: 5711 - DNA, 413 bp, Glycine max
  Clone ID: LIB3055-010-Q1-N1-G6
cttttgtgttctgttctgttctgttacatctcgtgaatcgtttacaacttcttaaccgttttctgttgcagatggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagag

SEQ ID NO: 5712 - DNA, 401 bp, Glycine max
  Clone ID: LIB3055-010-Q1-N1-G7
cttttgtgtatcgttctgttctgttacatctcgtgaatcggttacaacttcttaaccgttttctgttgcagatggcttcttcgtttctatccgcagcttcgcacgctgtctcaccctcttgttctctgtccaccacgcacaagggaaagcccatgcttggaggcaacactttgagatttcacaaaggacccaattccttctctagttcaaggtctagaggtcggatctctatggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgtt

SEQ ID NO: 5713 - DNA, 331 bp, Glycine max
  Clone ID: LIB3055-010-Q1-N1-G8
gatcagttctgttctgttacatctcgtgaatgatttacaactaattaaccggtgtctgttgcagatggcttcttcgtttctatccgcagcttcgcacgctgtctcaccctcttgatctctgtccaccacgcacaagggaaagcccatgcttggaggcaacactttgagatttcacaaaggacccaattccttctctagttcaaggtctagaggtcggatctctatggctgttgcagataatgtatctcggtttgaaggcatacctatggctcctcctgatccaattctcggagtttccgaagcgtttaagcatacaatattgatgtcaagc

SEQ ID NO: 5714 - DNA, 349 bp, Glycine max
  Clone ID: LIB3049-021-Q1-E1-C8
acggacgcgagaagacgacagaaggggactactacttgatcacatcgtattctctatgctattccgattaatcaatcatagatagatccattattcatagttaaacataataactgttgtgttacatctcgtgaattgttacaactgcttaaccattttctattgcagatggcttcgtcggttctctccgcagcttcacactctgtctcatcctcatgttctctgtccaccacgcacaagggaaagcccatgattagagacaacactttgggattccacagaggacccaattccttctctagttcaaggtctaaaggtcggatctctatggctgttgcagttaacgttt

SEQ ID NO: 5715 - DNA, 440 bp, Glycine max
  unsure (1)...(440): unsure at all n locations
  Clone ID: LIB3051-105-Q1-K1-F8
cggacgcgtgggttccgcaaatggcttctcacgacagcatctccgcttctccaacctccggttctgattccgtgttcaatcacctcgttcgtgctcccgaagatcctatcctcggggtaactgtcgcttataacaaagatccaagtccagttaagctcaacttgggagttggtgcttaccgaactgaggaaggaaaacctcttgttttgaatgtagtgaggcgagttgaacagcaactcataaatgacgtgtcacgcaacatggaatatattccgatcgttgggcttgctgattttaataaattgagtgctaagcttatttttggggctgacagccctgctattcaagacaacagggttaccactgttcaatgctngtctggaactggttctttaagagttgggggtgaaattttggctaaacactatcaccaacggact

SEQ ID NO: 5716 - DNA, 410 bp, Glycine max
  Clone ID: LIB3028-010-Q1-B1-C7
cttccttccgcaaatggcttctcacgacagcatctccgcttctccaacctccgcttctgattccgtcttcaatcacctcgttcgtgctcccgaagatcctatcctcggggtaactgtcgcttagaagaaagatccaagtccagttaagctcaacttgggagttggtgcttaccgaactgaggaaggaaaacctcttgttttgaatgtagtgaggcgagttgaacagcaactcataaatgacgtgtcacgcaacaaggaatatattccgatcgttgggcttgctgattttaataaattgagtgctaagcttatttttggggctgacagccctgctattcaagacaacagggttaccactgttcaatgcttgtctggaactggttctttaacactttgcggtgaatttttgg

SEQ ID NO: 5717 - DNA, 389 bp, Glycine max
  unsure (1)...(389): unsure at all n locations
  Clone ID: LIB3030-001-Q1-B1-B7
gtaattcgtggagggaatacttttccattacgcacgcactttaattacagacgagacaattataattaatagtaatacagacagcagcatgcgcccaccggttattctcaaaactacgacctctcttttggattcttcttcttcttcaccaccctgtgatcgcagactcaacactctcgctagacacttccttccgcatatggcttctcacgacagcatctccgcatcgccaaactccgcttctggatccgtcttcaagcacctcgtacgtgctcccgaagatcctatcctcggggtaactgtcgcttacaacaaagatccangtccagttaagctcaacttgggagttggtgcataccgaactgaggaatgaaaacctcttgttttga

SEQ ID NO: 5718 - DNA, 427 bp, Glycine max
  unsure (1)...(427): unsure at all n locations
  Clone ID: LIB3051-040-Q1-K1-D4
cccacgcgtccgcccacgcgtccgcttttctattctattaattacagggaccatcaaaaccaaaaaagccaattaatagttattcttttggattcttattgttcatcgcagactcaacactctctccagacacttccttcatcaaatggcttctcacgacggcatctccgctgcttcttcagattccgtcttcaatcacctcgttcgtgctcccgaagatcctatcctcggggtaactgttgcttataacaaagatccaagtccagttaagctcaacttgggagttggtgcttaccgaactgaggaaggaaaacctcttgttttgaatgtagtgaggcgagttgagcagcaactcataaatgacgtgtcacgcaacanggaatatattccgattgttgggctagctgattttaataaattgagtgct

SEQ ID NO: 5719 - DNA, 405 bp, Glycine max
  Clone ID: LIB3065-001-Q1-N1-G1
taaattatgtgttcataaattatgcaccagcaactcacacaagttttgcatctttaccaggaatgtgggacagaactcttactgtgaatggattttccaaggcctttgcaatgactggttggcggcttggatatattgctggtccaaaacattttgttgcagcatgtggaaagatccaaagtcagttcacttcaggggccagtagtatagctcagaaagctgcagttgctgcattaggactaggccatgctggtggggaggcagtttctaccatggtgaaagcatttagggagcgaagggatttcttggtaaaaagttttagagaaatagatggtgtcaagatatctgaaccccagggagcattttatctattccttgatttcagcttctattatggaagagaag

SEQ ID NO: 5720 - DNA, 249 bp, Glycine max
  Clone ID: 700830720H1
gaaagatcaagactgcttattctttgttcttcatctaacccaacgggatctgtctaccccaaagaattacttgaagagatagcccgaattgttgcaaagcaccccaggcttctggttctctctgatgaaatttacgaacacataatttatgcaccagcaactcacacgagctttgcatctttaccaggaatgtgggacagaactcttactgtgaatggattttctaaggcctttgcaatgactggttgg

SEQ ID NO: 5721 - DNA, 286 bp, Glycine max
  Clone ID: 701100721H1
caagagatagcccaaattgtagcaaagcaccccaggcttctggttctctctgatgaaaattatgaacacataatttatgcaccggcaactcatacaagctttgcatcgttaccgggaatgtgggacagaactctaattgtgaatggactttccaagacatttgcaatgactggttggcggcttgggtatattgctggtccaaaacattttgttgctgcatgtgaaaagattcaaagccagtttacttcaggggcaagtagtatatctcagaaagctggggttgctg

SEQ ID NO: 5722 - DNA, 233 bp, Glycine max
  Clone ID: 700958391H1
gatagcccgaattgttgcaaagcaccccaggcttctggttctctctgatgaaatttacgaacacataatttatgcaccagcaactcacacgagctttgcatctttaccaggaatgtgggacagaactcttactgtgaatggattttctaaggcctttgcaatgactggttggcggcttggatatattgctggtccaaaacattttgttgcagcatgtggaaagatccaaagtc

SEQ ID NO: 5723 - DNA, 247 bp, Glycine max
  Clone ID: 701119543H1
gctccagctactcatacaagttttgcatctttacctggaatgtgggaccgaactctaactgtgaatggattttccaagacatttgcaatgactggttggcggcttgggtacattgctggtacaaaacattttgttgcagcatgcggaaagattcaaagtcagttcacttcaggtgcaagtagtatatctcagaaagctggagttgctgcattaggactaggctatgctggtggggaagctgtttcaa

SEQ ID NO: 5724 - DNA, 239 bp, Glycine max
  unsure (1)...(239): unsure at all n locations
  Clone ID: 700669394H1
cgcaaagcgctttagaaaaatttcagacaacaatcttccncncaaatgagcttcanttgccatgcaaacatggagccataaaccttggtcaaggctttcccaactttgatggtccagaattgtaaaggaagcagcgattcaggcaatcagggatgggaaaaatcagtatgcccggggttatggagttccagacctgaacattgcnattgctgacagatttaagaaagatactggacttg

SEQ ID NO: 5725 - DNA, 225 bp, Glycine max
  Clone ID: 700753821H1
ttctctccgaccccaaagttctcatcttccttttccgccaccatgtccactctttccactcagaacgacaatcccaaccacaaaacgcagcaacctttgcagattgcaaagcgcttagagaaatttcagacacaatcttcactcaaatgagcttgcttgccatcaaacatggggccataaaccttggtcaaggctttcccaactttgatggtccagaatttgtaa

SEQ ID NO: 5726 - DNA, 260 bp, Glycine max
  unsure (1)...(260): unsure at all n locations
  Clone ID: 700999272H1
ctgaacttggagagccatgggtactaccatgcgttcggaaaactgagctgttgatggcgcagaatgattcgcttaatcacgagtacctccccgtgttggggttcgaaccatttngtaaagctgctgtcactcttttgctcggtgacgtcgagacttccacacnactagccgacgcnagggctttnggagtgcaaacactgngtggtatggagcatangngttacagntgaatnccgagaaaattcncatanannanattt

SEQ ID NO: 5727 - DNA, 414 bp, Glycine max
  unsure (1)...(414): unsure at all n locations
  Clone ID: LIB3055-011-Q1-N1-G1
gaagtttatgacaagttggcttttgatatggagcacatatcgatggcttctttgcctggaatgttcgaaaggacagtgacattgaactccttggggaagacattctccttaacaggatggaagattggttgggccatagcacccccacacttatcatggggagtgcgacaggcacacgctttcctcactttcgcaactgcccatccttttcagtgtgctgctgcagcggctctgagagcaccagactcttactatgtagagctgaagagggattatatggcaaaagagagctattttgattgaaggattgaaggctgttggcttcaaggtattcccatccagtggaacctactttgtggttgtagatcacaccccttttggactgggaaatgatgttgcattntgtgaatatct

SEQ ID NO: 5728 - DNA, 244 bp, Zea mays
  unsure (1)...(244): unsure at all n locations
  Clone ID: 700049393H1
atacggcgaggatgatctccctctagtatcatttcagtctgtctccanaggatactatggagagtgtggtanaagaggaggttacatggagattactggcttcagtgctccggtaagagagcagatctacaaggtagcttcagtgaacctgtgctccaatatcactggtcagatccttgcgagcgtcgtcatgaatccgacaagggtgnggacgatcatatgctcctacaagcagagaagatgg

SEQ ID NO: 5729 - DNA, 308 bp, Zea mays
  Clone ID: 700104304H1
ggcgaggaaacctctcgactacgaggagctgaacgagaacgtcaagagggtgcagtacgcggtgcgcggggagctgtacctccgcgcctccgagctgcagaaggagggcaagaagatcatcttcaccaacgtcggcaacccgcacgccctcggccagaaaccgctcaccttcccgcgccaggtggtggcgctgtgccaggctccgttcctcctcgacgatccccacgtcggcctcatgttcccggcggacgccatcgctagggccaagcactatctcgccatggcgcccggcggtctaggtgcgtaca

SEQ ID NO: 5730 - DNA, 164 bp, Zea mays
  Clone ID: 700172189H1
ggcggcaagatgagccggcaaatcagcggacgtcttctactgcctcaagctcctggtggcgacaggaatctccactgtcccgggctctggttttgggcaaaaggatagggtgttccaccttcggaccactatccttccagcggaggaagacttccctgccatca

SEQ ID NO: 5731 - DNA, 278 bp, Zea mays
  Clone ID: 700222553H1
gaagaggctaactggagcctcgactttgtgaatatccggcaaacagtggcggaggcacggtccaagggaatctctgttcgagcgatggtgatgataaatccaggaaatcccactggccaatgccttagtgaagcgaatataaaggaacttctgcaattttgctaccatgaaaacttagttctgctagcagatgaagtgtatcaacagaacatttatcaagatgaacggccatttataagcgcaagaaaggttatgttcgacatgggtccaccaataag

SEQ ID NO: 5732 - DNA, 283 bp, Zea mays
  Clone ID: 700257069H1
ctacaatactgaactgtgaccaggtgccgtacaatctcactgaagataacggttggggcctagagatctttgaagtcaagaggtgcttggaagacgctcgttcggctggcctcactgttagagctatggtggtaataaatcccggcaaccctactggacaggtgctatccgtcacaaaccaggaggagatagtagagttttgtcggaaggaaggtctggttatacttgctgatgaggtataccaggaaaatatctacgcagagaacaagaagttccattcctt

SEQ ID NO: 5733 - DNA, 289 bp, Zea mays
  Clone ID: 700264090H1
tggaaaacgaggcggttatatggagataactggattcagtcctgaagtacgggaacaaatttacaaggtggcatcagtaaacctgtgctccaatgtttcggggcaaattcttgctagccttgtaatgaacccaccaaaggctggggatgaatcctttgaatccttcatgtcagagaaggatggtatcctttcatcgttggctcggcgtgcaaaggctttggaagaagcattcaacagtctagaaggaattcactgcaacaaagccgaaggtgcaatgtatctgttccca

SEQ ID NO: 5734 - DNA, 305 bp, Zea mays
  Clone ID: 700264413H1
ttctcgtcagccttgcaatggatccaccgaagctaggagatgaatctttcgagtcatttgataaggagaaggaacagatccgttcatccttctgcaagcgagccaagaccctggagaaagctttcagcggcctggagggcgtgacttgcaacaagttagagggtgcgctgtacttgttcccacggctccacctcccctccgctgcgatcagggccgccgatttcgagggagtttcacctgacatattctacgctcaccgcctgcttgatgccaccgggattgccgttgtgccgggctctgggttc

SEQ ID NO: 5735 - DNA, 277 bp, Zea mays
  Clone ID: 700457290H1
gtcaatttgcagtccggggagagattgtcacacgtgctcagaaactgcaacaagaactgcagagaaatccagagtcgcttccttttgatgagatactctactgtaacattggaaatccccattccattggccaacagccagttacctatttcagagaagttctatctttatgtgagaatccagctctcctggacaaaagtgaaacgcatgctttatacaggtcagatgctatagagagagcacggaaaattctagacaaaataccaggaagagctac

SEQ ID NO: 5736 - DNA, 287 bp, Zea mays
  Clone ID: 700461128H1
atcgattgcagcctcagcaatccacagtccatgggacagcggccaaacaagttcttccgagaggttcttgccttgtgcaaccatccccatcttctagaacagagcggaactaattccttgttcagctctggtgcgatagcaagggcacgggagattctagacctctttcccgggagagcaacaggaggatatagccactctcagggcactgaaggattgcgcgacataatcgccgctggaatagccgctcgagataatttcccctgctacgcggatgacattttcct

SEQ ID NO: 5737 - DNA, 269 bp, Zea mays
  Clone ID: 700461228H1
atcgattgccgcctcagcaatccacagtccatggtgacagcggccaaacaagttcttccgagaggttcttgccgttgtgcaaccatccccatcttctagaacagagcggaactaattccttgttcagctctggtgcgatagcaagggcacgggagattctagacctctttcccgggagagcaacaggaggatatagccactctcaaggcactgaaggattgcgcgacataatcgccgctggaatagccgctcgagataatttcccctgc

SEQ ID NO: 5738 - DNA, 261 bp, Zea mays
  Clone ID: 700579019H1
ctctggtcccatactacttggaagaagaggctaactggaaccttgactttgcagacatccgacaagcagtggccgaggcacgttcgaagggaatcactgttcgagcgacggtgattataaatccaggaaatcccactggccagtgccttgtgaagcaaatataagggaacttgtgcgatattgctaccatgaaaacttagttctgcttgcagacgaagtgtatcaccagaacgtagtaccagatgagcgcccattataagc

SEQ ID NO: 5739 - DNA, 166 bp, Zea mays
  Clone ID: 700584206H1
ggagatatctcatacccgaagttcactgccgaaagcaagtccatcctcgaatctttgaggaggagagcgcgcatgatgacagacggtttcaacagctgccgaaatgtggtgtgcaatttcacagaaggagctatgtactctttcccccaaatacagctgccagcaa

SEQ ID NO: 5740 - DNA, 324 bp, Zea mays
  Clone ID: 700617436H1
cagcggacgatatctttctgacagatggagccacctcagcgatcaactgcaagatgcagatactcatcaggtctcacgaagtaggcatcttgagccctctacccgaataccccttgtactcggcctccatcatactgcacggtggaacgatggtgccgtacaatctcactgcagataacggttgagggctagagatctttgaagtcaagaggtgcttggtagaagctcgtacggctggcctcactgttagagctatggtggtactaaatcacggcaactctactggacaggtgctatccgtcactaaccaggaggagatagtag

SEQ ID NO: 5741 - DNA, 320 bp, Zea mays
  Clone ID: 700624223H1
cggctcgagctctcttctctccccgcggcccgtgactcatccacccacagtccactcgccaatccccccggaacggcggcggcggcgacggcggaggagtaacgcaagatggcgaggaaacctctcgactacgaggagctgaacgagaacgtcaagagggtgcagtacgcggtgcgcggggagctgtacatccgcgcctccgagctgcagaaggagggcaagaagatcatcttcaccaacgtcggcaacccgcacgccctcggccagaaaccgctcaccttcccgcgccaggtggtggcgctgtgccaggctccgttcct

SEQ ID NO: 5742 - DNA, 297 bp, Zea mays
  Clone ID: 701164032H1
cgaaatccaacaggacagggtcttgatgatgaataccaaaagaacattgtcgaattctgctagaatgaacgacttgctcttctcgcagatgaggtttaccaggtaaatatatatgtagaagattagccattccactcattcaaaaaaattgcacggtcactgggatacactgatgatgatcttcctttgggatcattccagtcagtttctaaaggctactacggagaatgtgcaaaacgaggcgtgtatatggagataactggattcagtcctgaagtacgggaacaaatttacaag

SEQ ID NO: 5743 - DNA, 247 bp, Zea mays
  Clone ID: 701166826H1
cgcaggaagacaagatccccgcggtgatcagccgcttcagggctttccatgaggcgatcttggccgaataccgcgactaaactgttacgctgtgtgtgagttaagttggagggtcagtagaactgttgaagagctcagtgacagcgcagaatgaggcagtgttagaaaggcttaggtccttcttcacaggagcaacagttgtcttgtctcatcaaggagaaataaaaattttagttttacaacttct

SEQ ID NO: 5744 - DNA, 266 bp, Zea mays
  Clone ID: 700801716H1
cgttttgatggattcttcggtgggaagtttgggctttgacgagacagaaagaagcactgtggatgtgctgcgttctgcatatccctgattcatctgagccgcggctttgattctcgtttgcttgagaaatttggggtgaaaagattatccttgattcgctgcagtggtcttgaaatgtgagtatgcagtccgtggcgagattgtcatccatgctcagcgcttgcagcaacaactacaaacacaaccagggtctcttccttttgatg

SEQ ID NO: 5745 - DNA, 249 bp, Zea mays
  Clone ID: 700806781H1
gttttgatggattcttcggtgggaagtttgggctttgacgagacagaaagaagcactgtggatgtgctgcgttctgcatatccctgattcatctgagccgcggctttgattctcgtttgcttgagaaatttggggtgaaaagattatccttgattcgctgcagtggtcttgaaatgtgagtatgcagtccgtggcgagattgtcatccatgctcagcgcttgcagcaacaactacaacacaaacagggt

SEQ ID NO: 5746 - DNA, 308 bp, Zea mays
  Clone ID: 700102926H1
atctttgaggaggagagcacgcatgatgacagatggtttcaacagttgccgaaacgtcgtgtgcaatttcactgaaggagctatgtactctttcccccaaatacgtctgccaccgagagctattgaggcggcaagaagagccggcaaatcagcggacgtcttctactgcctcaagctcctggaggcgacaggaatctccactgtcccgggctctggttttgggcaaaaggaaggggtgttccaccttcggaccactatccttccagcggaggaagacttccctgccatcatgtcgagcttcaagaagt

SEQ ID NO: 5747 - DNA, 287 bp, Zea mays
  Clone ID: 700423101H1
gaggaggagagcacgcatgatgacagatggtttcaacagttgccgaaacgtcgtgtgcaatttcactgaaggagctatgtactctttcccccaaatacgtctgccaccgagagctattgaggcggcaagaagagccggcaaatcagcggacgtcttctactgcctcaagctcctggaggcgacaggaatctccactgttccgggctctggttttgggcaaaaggaaggggtgttccaccttcggaccactatccttccagcggaggaagacttcactgccatcatgt

SEQ ID NO: 5748 - DNA, 258 bp, Zea mays
  Clone ID: 701172883H2
agcaattccactcgttcaaaaaaatcgcacggtcgctgggatacactgatgacgaccttcctttggtatcgttccagtcgatttctaaaggctactatggagaatgtggaaagcgaggtggttacatggagataactgggttcagtcctcaagtacgggaccaaatctacaagatggcatcgataaatctgtgctccaatatcaccggccaaattcttgctagccttgtcatgaacccaccaaaggctggggatgaat

SEQ ID NO: 5749 - DNA, 256 bp, Zea mays
  Clone ID: 701172884H2
agcaattccactcgttcaaaaaaatcgcacggtcgctgggatacactgatgacgaccttcctttggtatcgttccagtcgatttctaaaggctactatggagaatgtggaaagcgaggtggttacatggagataactgggttcagtcctcaagtacgggaccaaatctacaagactgcatggataaatctgtgctccaatatcaccggccaaattcttgctagccttgtcatgaacccaccaaaggctggggatga

SEQ ID NO: 5750 - DNA, 309 bp, Zea mays
  Clone ID: 700099203H1
ccgccgctgaaacaatctgcacccccacgcacaagcacgaagcagtcagcagtggagtacaaatcctcgcctgcttcctggttttctctccccgccactccagcggaacggcggcgagggagtgagtgacggcagcgaggcaagatggcgaggaggaggccgatggactacgaggagctgaacgagaaagtcaagaaggcgcagtacgcggtgcgcggggagctgtacctccgcgcctccgagctccagaaggagggcaagaagatcatcttcaccaacgtcggcaacccgcacgccctcggccagaag

SEQ ID NO: 5751 - DNA, 306 bp, Zea mays
  Clone ID: 700210632H1
cggacgcgtggtgactcccgcggcatcccgggaatcaggaaggaagttgccgacttcatccacaagcgagatggatatcccagtgatccggaactcatctacctcacagacggtgccagcaaaggtgtgatgcagatcctgaacaccatcattagcaacgagatggacgggatcttggtccctgttcctcagtacccactttattccgccaccatttccctctatggtggttctctggtcccgtactacttggaagaagaggctaactggagcctcgactttgtgaatatccggcaaacagtggcg

SEQ ID NO: 5752 - DNA, 281 bp, Zea mays
  Clone ID: 700580511H1
gatcatcttcaccaacgtcggcaacccgcacgccctcggccagaagccgctcaccttcccgcgccaggtggtggcgctgtgccaggctccgttcctcctcgatgaccccaatgtcggcctcatgttcccgcccgatgccatcgtgcgggccaagcgctatctcgccatggcgccgggaggtctaggtgcgtacagtgatgcccgtggtatccccggaatcaggaaggaagttgctgacttcatccacaagcgtgatggatatccgagtgatccagaactca

SEQ ID NO: 5753 - DNA, 259 bp, Zea mays
  Clone ID: 700217635H1
tgagccatagtcagggtataaaaggtttacgtgatgaaattgctgctggaattgctgctcgtgatgggtttcatgcaagtggagataacatctttctaacagatggagcaagcccagcagtgcacatgatgatgcagttgttgataagttctgagagcgatggcattctctgccctattccacagtacccactgtactctgcatcgattgctcttcacggtggttcccttgttccttatgtccttaatgaagagacagg

SEQ ID NO: 5754 - DNA, 292 bp, Zea mays
  Clone ID: 700349242H1
tgaaattgctgctggaattgctgcccgtgatgggtttcatgcaagcggagataacatctttctaacagatggagcaagcccagcagtgcacatgatgatgcagttgttaataagttctgagagcgatggcattctctgccctattccacagtacccactgtactctgcatcgattgctcttcacggtggttcccttgttccttatttccttaatgaagagacagggtggggactcgatgttgatgagctgaagaaacaactggaggaggctcgatctaagggcatcactgtc

SEQ ID NO: 5755 - DNA, 297 bp, Zea mays
  unsure (1)...(297): unsure at all n locations
  Clone ID: 700473110H1
ttctatccctttccaagagataatatactgcaacctcgggaacccccaggtccttggtcagccgccactaactttctttcgtgaggttctctccctgtgcgacaacccagccctcatggacagagatgaagctcgtgccttattcagcccttgtagcataagaagggcaggaggatcctaaactcgatccccagcaaagacactggtggatatactgattgccggggaatcaaatgcctgcgtcaagnagtagcagatgggattaccgcaagagacggttttccatcgacagcggac

SEQ ID NO: 5756 - DNA, 312 bp, Zea mays
  Clone ID: 700264510H1
atgttctctccctgtgcgacaacccagccctcatggacagagatgaagctcgtgccttattcagcccttgtagcataagaagggccaggaggatcctaaactcgatccccagcaaagacactggtggatatactgattgccggggaatcaaatgcctgcgtcaagtagtagcagatgggattaccgcaagagacggttttccatcgacagcggacgatatctttctgacagatggagccacctcagcgatcaacttgatgatgcagatactcatcaggtctcacgaagacggcatcttgagccctctacccg

SEQ ID NO: 5757 - DNA, 291 bp, Zea mays
  Clone ID: 700262355H1
ctctccctgtgcgacaacccagccctcatggacagagatgaagctcgtgccttattcagcccttgtagcataagaagggccaggaggatcctaaactcgatccccagcaaagacactggtggatatactgattgccggggaatcaaatgcctgcgtcaagtagtagcagatgggattaccgcaagagacggttttccatcgacagcggacgatatctttctgacagatggagccacctcagcggtaagactctgcatttcagaacctacatctacatgacgcagcacagat

SEQ ID NO: 5758 - DNA, 232 bp, Zea mays
  Clone ID: 700263001H1
atctccctgtgcgacaacccagccctcatggacagagatgaaactcgtgccttattcagcccttgtagcataagaagggccaggaggatcctaaactcgatccccagcaaagacactggtggatatactgattgccggggaatcaaatgcctgcgtcaagtagtagcagatgggattaccgcaagagacggttttccatcgacagcggacgatatctttctgacagatggag

SEQ ID NO: 5759 - DNA, 224 bp, Zea mays
  Clone ID: 700474691H1
ccaggttctctccctgtgcgacaacccagccctcatggacagagatgaagctcgtgccttattcagcccgtgtagcataagaagggccaggaggatcctaaactcgatccccagcaaagacactggtggatatactgattgccggggaatcacatgcctgcgtcaagtagtagcagatgggaccaccgcaagagacggatttccatcgacagcggacgatatct

SEQ ID NO: 5760 - DNA, 122 bp, Zea mays
  Clone ID: 700615134H1
ccaggtccttggtcagccgccactaactttctttcgtgaggttctctccctgtgcgacaacccagccctcatggacagagatgaagctcgtgccttattcagcccttgtagcataagaaggg

(The sequence listing continues in the following parts.)

We claim:

1. A substantially purified nucleic acid molecule comprising a nucleic acid seciuence that shares between 100% and 98% sequence identity with the nucleic acid sequence of SEQ ID NO: 4 or the complete complement thereof.

2. The substantially purified nucleic acid molecule according to claim 1, wherein said nucleic acid molecule comprises a nucleic acid sequence that shares between 100% and 99% sequence identity with the nucleic acid sequence of SEQ ID NO: 4 or the complete complement thereof.

3. The substantially purified nucleic acid molecule according to claim 2, wherein said nucleic acid molecule comprises a nucleic acid sequence having 100% sequence identity with SEQ ID NO: 4 or the complete complement thereof.

* * * * *